United States Patent 11,098,302 (IDENTIFICATION OF POLYNUCLEOTIDES ASSOCIATED WITH A SAMPLE) - sequence listing, part 15

SEQ ID NO: 48492 - DNA, 794 bp, Homo sapiens
  misc_feature: GYAE6OF01EC699.23.23.C01.1.454.CMB.1.raw
  modified_base (155)..(155): a, c, t, g, unknown or other
  misc_feature (155)..(155): n is a, c, g, or t
  modified_base (232)..(232): a, c, t, g, unknown or other
  misc_feature (232)..(232): n is a, c, g, or t
  modified_base (455)..(455): a, c, t, g, unknown or other
  misc_feature (455)..(455): n is a, c, g, or t
tcagacgcgagtatcacgaccggtgctcgatttagtacacgtgattaggggattggggggaggaactgctcagtttggacccagagggaaccatggaagccccagctcagccttctcttcctcctgctcctctgctcccagacgacccaccgganattactttcttttagaccacacgttctacccgagtacctattccggtgttccgttgtcgttccgtaccggagggganacgacgcccctacccctcgtcctaggcgacgggcctagtcaggtagttggttccgccgtaccttccgttacggcccgttaacggtaaacccaaaaccgtaaaacccgtcggacccgaaccgtccccgtacccgaggtcccgttccgtacctagttaccgtaggtacggaccaccgtacctaacccgaaccggaccgggccgtacgtcggactacccacccggnggtacggttacgttacgaggtcggacgtaggtcggtcttcgggacggaacgtacgtaccttacccgtaaccgttcaccgtaacgtacgtccgacggacgttacggtacccggtcccgtaaccgttcggtacttttacggttacgtactttaacggtttacttaacgtcggtaacctggtaaccgtacggtccgggcctcggttacgtaccttcgtaacccgttaccgggtaccggtaccgaacgggtaccctagggtaccgtaggtaacgaaccgtaagggtaaaccggccgttaggccgtacgtcggtacctacgtacttcttccgtacgtttacccg

SEQ ID NO: 48493 - DNA, 709 bp, Homo sapiens
  misc_feature: GYAE6OF01EY28Z.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtcgtccgaggggagagacgccaccctctcctgcgagggccagcagagtgttcgccgtactccgtggcctcggtaaccaaacaaaaccgtcggaccacgccctcccgaggtctcgtctacttcagtcggcacactacccaacgacgggaccctacggtcgacctaccgtcccgaaggtccgtaacgggtttcaggtcggacgtagggtcgggtaccgttcggtacgggaacgtacgtaccgtttacccacgttcccgtaccgaaccgtaacttaccgaacggtaccggtacggttaccgtacccgtaaccccgttgttaaaccgtttacgttttcgacttttagtttttaactacgtttacgtactaacggcgttaaccggtcggtacccgtaccgttacgggaccctttacggttaccgttacccggttaccggaacccgtaagggtccctaggtacgtaggacgtaagtacgaacggtacgtggtcgaccgtacgtacccgtatagtcctagttcctac

SEQ ID NO: 48494 - DNA, 737 bp, Homo sapiens
  misc_feature: GYAE6OF01EL9EI.23.23.C01.1.454.CMB.1.raw
  modified_base (108)..(108): a, c, t, g, unknown or other
  misc_feature (108)..(108): n is a, c, g, or t
  modified_base (197)..(197): a, c, t, g, unknown or other
  misc_feature (197)..(197): n is a, c, g, or t
tcagacgcgagtatcacgaccggtgctcgattttagtacacgtgattagggtagttgggggagtcaacaacccacagtctgtcctcgagaggacaccctgtggaccanagctcctcaccagtcggactggacctggacgtatcctcttcttggtggcagctaggcagaagtcgtaccactccgacgaggtaattggngcgtacgtcgtggcctgaggtgaagagccgtgggcatcagtgaaacgtcacgtgagaagcgttacgaggtactactactactaactaattatatatactacgtggacgacgacgacgtaccgaagggaacgtcgtacgtaggtaggagtcgggacgtggtgtacgtcgtagttaggtaggaacggtacggtaccggtatacgttacgtagtaacggtacgtacggaacggtcgtaggtccgtacgtaacgtaccgttaacggttaccgttaaccgtaaacccttaccgtaacgaaacggtaaacgtaccgtaaccggtaccggttaagttaacgggtacgtccgggaacggtccggtaccttacgtaccgtacgtacgtaaccggtaccggtaacggttgttaacgttagttacgtacggtacggacggtacgggtccgggtacgggtaccggtaccggttaggttttaagggttaacggtagttaacgttaggtaacgggttacgtcgggtacggttcgggtaccgggtaacggacggg

SEQ ID NO: 48495 - DNA, 704 bp, Homo sapiens
  misc_feature: GYAE6OF01ESH8P.23.23.C01.1.454.CMB.1.raw
  modified_base (203)..(203): a, c, t, g, unknown or other
  misc_feature (203)..(203): n is a, c, g, or t
  modified_base (208)..(208): a, c, t, g, unknown or other
  misc_feature (208)..(208): n is a, c, g, or t
  modified_base (233)..(233): a, c, t, g, unknown or other
  misc_feature (233)..(233): n is a, c, g, or t
tcagacgcgagtatcacgaccggtgctcgatttagtacacgtgattagggattggggggaggaactgctcagtttggacccagagggaaccatggaagccccagctcagcttctcttcctcctgctcctctggctccagacgaccaccggagatattcttttgacacgagtctccagacatcgtgtctgtgtctcgagggganagacnccacctctctgcaggccagtcaagngtgttcgccgtactccgtcggcctaggtaacccaaacaaaaaccgtcggaccaacgcccgtacccacggtcctccgtctacttctactacggccacgacttaaccaacggtacgggccaacggtcggaccacctaccgacggtacgtacggttacgaggttggactaggtcggacgtcggtaggaaccgtagtaaccttcgactcgtacctaacggtctaacgcgaccgtaaggtccgttaccgtaacccggtagttaaccggtagttttacggtaccctttaagtttacgttacgtcggtaccgacgtaccgtaacggtccggcgttccgtacgtcctacgtcccgttaccggtaccgggaacctaacggggactaccggacgtagggtaactacggtaacgtaaaccgggtcgttacgggacggttccaaacggtccctaacgtaccgtttccggtacttcgttacccg

SEQ ID NO: 48496 - DNA, 617 bp, Homo sapiens
  misc_feature: GYAE6OF01E3QMF.23.23.C01.1.454.CMB.1.raw
  modified_base (202)..(202): a, c, t, g, unknown or other
  misc_feature (202)..(202): n is a, c, g, or t
  modified_base (347)..(347): a, c, t, g, unknown or other
  misc_feature (347)..(347): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagccaccctctcctgcagggccagtcagagtgttgccgactccgttggcctggtaaccaacaaaacctggccagcctccaggctcgtcattcatgcacatccaacgacggccactcggcactcccgaggcaggttccagtggnaggtcgctcgtgggacagtactcactcacacgatcgagctaggtctaccgacctgacgttagtttgacgttagtttaacttacgtgttaccgagtacgtaacggtcggtaccgtcccgttacgggtacccttacgtaccccgttaccggtttaccggaacccgtaaggggtacccctacggtaccgttgggaacggtacgtaacggaaaacccgttacggtggtaaccggcgttacggacccttaccgtattcccgttgtccctttaccg

SEQ ID NO: 48497 - DNA, 744 bp, Homo sapiens
  misc_feature: GYAE6OF01B7XCF.23.23.C01.1.454.CMB.1.raw
  modified_base (163)..(163): a, c, t, g, unknown or other
  misc_feature (163)..(163): n is a, c, g, or t
  modified_base (239)..(239): a, c, t, g, unknown or other
  misc_feature (239)..(239): n is a, c, g, or t
  modified_base (393)..(393): a, c, t, g, unknown or other
  misc_feature (393)..(393): n is a, c, g, or t
tcagacgcgagtatcacgaccggtgctcgatttagtacacgtgattagggattggggagtcaacaaccacatctgtcctcgagaggacaccctgtgaccacagcctcctcaccatggactggacctggacgatccctcttctgggtgcagcagccagaagtcncccactcccacgaggacttggtgacagtctgggacctgaggtgaagacgccgtagggcatcaggtagaagtcaccngtacaaggtctagaggactacctaccttaccaactaacttagaattacacgaaccgtgggtagccgacgacggtaccccgtaggggaaacggcgttacggaggtacggagtgggcgtgggtgacgttcgaggttacgtagacgtacgtaccggntactcgagtaggtaacttcgaacggtccgacgtcgtaccgacggtctaccgaccctaacggaacttaccgtaacgtaaggaaacccctaacgtaacgtaccccttaaagggtttcccgtaacggtaccggacccggtaccggtcccgttacccgtaaccgtacccggttaggaaccccggtaaccgtaccgggtcccgtttaacggttaactttccggttacggtaaggtcccggaaggggttacggggacccggggttacggtcccgggttaagtttacgggttaggtaactttggttaacggttacggttacggtgtaaccgggtcgggtccggggacgtacccggggg

SEQ ID NO: 48498 - DNA, 794 bp, Homo sapiens
  misc_feature: GYAE6OF01CNC74.23.23.C01.1.454.CMB.1.raw
  modified_base (168)..(168): a, c, t, g, unknown or other
  misc_feature (168)..(168): n is a, c, g, or t
  modified_base (212)..(212): a, c, t, g, unknown or other
  misc_feature (212)..(212): n is a, c, g, or t
  modified_base (217)..(217): a, c, t, g, unknown or other
  misc_feature (217)..(217): n is a, c, g, or t
  modified_base (228)..(228): a, c, t, g, unknown or other
  misc_feature (228)..(228): n is a, c, g, or t
tcagacgcgagtatcacgaccggtgctcgatttagtacacgtgattagggattgggggaggaactgctcagtttggacccagagggaaccatggaacgccccagctcagcttctccttcctcctgcctcctctcggcctccgagacgaccacggagattattcgtttnacactacgtcctccagactatcgtgtctgtcgtcgcggaggganagacncccacctctcncgcgacggccagtcgagtagtgtcgccgtactcgtcggacctacggtaaccaaaacgtaaaccgtcgaccgaccgtcccgtaccgagtcctacgtacctacgttacgacggtacgaccaaccgtacctaacccgaaaccgtacgggtaccctaacggtcgacctaccgccgaaggtcgtacggtcgacggtcggacgtaggtccggacgttacgggacgaacgtccgtaacgtttccacccgttacgtaccgaacgtacgtaccgaacgtacgttacgggtacctacccggtaccgttaacgttaaccgtttagttaccgtttaacgtttaacgttttcacgtttaccgacgtaacggtaccggtaacggtccgaccggttaccgtaccggtaccgtttacccgtcccgggttaaccgttcccggggaaacccttaacgggggttaccttaacgggaaccggttacggggtaaattaacccgggtaaaggttaaaacccgtggtttaacgggccgggtaacccttcggaacccttacggttacgtttcttacccgttccgttaccc

SEQ ID NO: 48499 - DNA, 889 bp, Homo sapiens
  misc_feature: GYAE6OF01AIRE4.23.23.C01.1.454.CMB.1.raw
  modified_base (212)..(212): a, c, t, g, unknown or other
  misc_feature (212)..(212): n is a, c, g, or t
tcagacgcgagtatcacgaccggtgctcgatttagtacacgtgattagggattgggggaggaactgctcagttttggacccagagggaaccatggaagccccagctcagcttctcttcctcctgcttcctctggccttcccagacgacccaccggagtattattcttttgaccacagtcctccagacatcgtgtctgtcgtctccgaggggngagacgcccacctctcctgcagggccagtcagagtgttacgccgtacttccgtcggccgtaggtaacccaaacaaaccctcggccacgtcccctacccgtaggccttacggctacgttccaagtcggaccactacctacccgtaaacgcgggtcccaacgttcgggacctaccgtaccccgaagggtccgttacggttccgacggttcggacgtacggtcggaccgtttcggggtacgggaccgtaacgttacccgttacccgttaaccgttacccgttaccgtaacccggtaacttacccggaacgtaccgtacccggtttaccgggtaaccccctaccccgggttttagggtaaccggttttaacgtttttacccgggtaacttttaaccggttttttaacgtttaacccgggttccggtttaaccgtaggttaaaccccgggtaacgggttttcccggggaaccctttttcccggggaccggttacccctttaagtcccccggttaacccggtttccccgggaacccgggtaacgggttacccgtaccggttaacgggtacggggtaacctaaaccggggttaaccggtaaacccgtaacggtttccggggacggttccctacggtaccccgtaccggttaactttccgttaacccgggtttcctttaacccgg

SEQ ID NO: 48500 - DNA, 714 bp, Homo sapiens
  misc_feature: GYAE6OF01EZ1JU.23.23.C01.1.454.CMB.1.raw
  modified_base (213)..(213): a, c, t, g, unknown or other
  misc_feature (213)..(213): n is a, c, g, or t
  modified_base (415)..(415): a, c, t, g, unknown or other
  misc_feature (415)..(415): n is a, c, g, or t
tcagacgcgagtatcacgaccggtgctcgatttagtacacgtgattagggattgggggagggaactgctcagtttggacccagagggaaccatggaacgccccagctcagcttctcttcctcctgctcctctggcctcccagacgaccgaccggagattactttcgtttcgacactagtcctccagacatcgtgtctgtcgtctcggaggganagacgccctaccctctcctgccgacgggcctagtaccaggacgtgttcgccgtacttccgtttggaccttcggtaaccaaacgtaaaaccgtcggaccctacgaccctcccgaggtccttacgtacctacgttacctacgtcggacctacgaccgtaccgaacgcgggccaccgtcggactacgtaccgaggtctaggtacncggtcgacgtaggtacggtctcggtacgggactaccggtcttacaccttccgacgacgtactacgacgcgttagtccgtaccgtactggtaacctttagtttcgtaaccgttagttttccgtacgttacgtcaaagtccgtaacgggtcgtcgtaccgttacggaccttcgtaccgttccgtacggtaccggaagggttccccgagtacggttacggactaacgggtaaccgaaacggtgttaccgggaccgtcctaccgtacccgttacttacccttccggtttcctccgttaccccg

SEQ ID NO: 48501 - DNA, 780 bp, Homo sapiens
  misc_feature: GYAE6OF01C79NL.23.23.C01.1.454.CMB.1.raw
tcagacgcgagtatcacgaccggtgctcgatttagtacacgtgattagggattggggagtcaacaaccacatctgtcctcgagaggacaccctgtgaccacagcctcctcaccatggactggacctggacgatcctcttcgttggtggcagcagccagaagtcgcccactcccgaacggaggtaagttggtgcagtcgtgggcctggagggtagaacggtagccggtggggacagtacgaaggtacgaagtcccgtacgtgacgagtcttacgaaggtactaccgtacccttactaaaccttaaattttgaacttacgtacgtaacggttcgggtacggaccggaaccggaccccgggtaacccgggtaaacgggggtaaaacgggtcccggtacgggtaacgggtacggggtaacggtccgggggtacgggttacggggtacggttaacggtttccgttaagggttacggttaggaacggtaaaccggtaccggtacgttattacgtacgtaagtaacggttacgaacggaccgtacggtacgtcgaccggtactacggaccgtaacacctacgtacgaagaaccgacgaccgtacctaggttacgacgtcggcgccgactacgcgtacgacgaccgactaccgggtctagttaacgttcgtagggcgtacgggaggcgggtaaccgggcggtaccggttaggtttaaggtttaggtaacgtttaggtaggttacgggtagtacgggtagggtaccggtacggggcggttaaccggggg

SEQ ID NO: 48502 - DNA, 679 bp, Homo sapiens
  misc_feature: GYAE6OF01CSR8L.23.23.C01.1.454.CMB.1.raw
  modified_base (152)..(152): a, c, t, g, unknown or other
  misc_feature (152)..(152): n is a, c, g, or t
  modified_base (192)..(192): a, c, t, g, unknown or other
  misc_feature (192)..(192): n is a, c, g, or t
  modified_base (203)..(203): a, c, t, g, unknown or other
  misc_feature (203)..(203): n is a, c, g, or t
  modified_base (306)..(306): a, c, t, g, unknown or other
  misc_feature (306)..(306): n is a, c, g, or t
tcagacgcgagtatcacgaccggtgctcgatttagtacacgtgattagggattgggggaggaactgctcagtttggacccagagggaaccatggaagcccccagctacagcttctcttcctcctgactcctctgcttcagagaccaccgganattattctttgacactagtctaccagacatcgtgtctgtntctcgaggganagacgccaccgtctcgtgaccgacggctagtacagtacgtgtcgccgactcgtgcctagtaaccaaacgaaaacctggaccacgcctaccgagtctactactntacagtcgactacactaccgaagacggcctagtcgactacgtacccgagtacgtacgtcgacgtacgacgtaagtcgtcgacgtacgggactaacggttacccttagaaccgttcacggtaactacaccgtagtacgacgttacggtaccgaaccttagtaacgtttacgttagacgtttaagttacttaaccggtgtaccgaacgtaaccggtacggtacgtacccgtaccgtacgggttaacctaaccgttcctaaaccgtttcccgaacgggtaaacgtcggttacccgaaggtacgaaccgttaagaaaacccgggtaataccggttaaaggcgtacctgtaaaccctattacggcttgtaacccgttc

SEQ ID NO: 48503 - DNA, 721 bp, Homo sapiens
  misc_feature: GYAE6OF01CSQSO.23.23.C01.1.454.CMB.1.raw
  modified_base (244)..(244): a, c, t, g, unknown or other
  misc_feature (244)..(244): n is a, c, g, or t
  modified_base (541)..(541): a, c, t, g, unknown or other
  misc_feature (541)..(541): n is a, c, g, or t
tcagacgcgagtatcacgaccggtgctcgatttagtacacgtgattagggattgggggaggaactgctcagtttggacccagagggaaccatggaagccccagctcagcttctcttcctcctgccttcctctcggctcccagcgaccgaccgggatattacttttctttgaactactagttctccagactattcgtgtctgtgttcctccggaggggacagaccgtccctacccgtccttccgnggccgaacggggccaaggttcgaggtagttcggttacgcccgtactcggtttcggcccttaaggtaaccaaacgtaaaccgtcggaccacgccctaccgagtccgtcgtctattcgacttcgacactcgtaccaacgcggccacgtcgctacgtccgagcgtagtcgacggtgagtgtcgcgtcgaggacgtacgttactacgtcgtctaccgacgagtccagacggtactccggtaccgtaacgttaggtacgttagtttacgtagtttaacgttttaactacggttcgtaaccgnggttaacccggttagggccggttacccggtaccgtacggttacccgttacgtacccgttacccgggttaccgaacgggtccggtaacgttccgggaaattcggggaagttaaacgtaacggaactacgggttggacccgacgttcgaccgttacacggtttccgttacttccggttaacc

SEQ ID NO: 48504 - DNA, 1068 bp, Homo sapiens
  misc_feature: GYAE6OF01C8DR7.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctctttcttggtggcagcagccagaagtcgcccactcccacgagaattggtgctagtcgtggctgaggtgaagacgcgtgggacagtcagtagaaacgtcaccgtgcgaaggtcttacaggtacttaaccgtaccttacaaccgtaaaattttggaaacttattacgtaaacgttcggggtagaccggaaccgaccggcccccggttaaagggaaaaacggggtccttacgggaggttaacgggaggtcgggggtcccgggttagtaccggttaccgttaggttagggtttaacggtaagtaaaccggttcccggggtacgtaacgttttaacccttcggtaaacggttaaacggttttaaccggaaaccggtacccgtaacgggtcccgttaaccgaaacgggttccccttagggtaaccccgttaaccggttaaaccggtaacccctttacccgaaaacgggttaaaacggaaaccccgtaacccggtaaccccggtttaaagtttttaaccccggggaaccgtttacccgggaacccgggtacccccggggttaaccccgtttacggttaaaccccccggtttacccggttaccgggtaaaacccgggtaacccccgggtacccgggggttaacccccggtttaagttttaaacccggtttttaacgggttttcccgggttacggggttacccgggaaacgggggggttcgggtaaacccccgggggggaaaccgggggttacccccgggtttacgggttttttaaaaaacggggtttttttaacggggaaaacggggtttttaaaacgtttttaaacgggttttaggggtttaaaccggttttaccggggggtaaacccgggtttttcccggggggaaaccccgggggggtaaacccggggaaaaccggggggtttaaacccccccggggg

SEQ ID NO: 48505 - DNA, 697 bp, Homo sapiens
  misc_feature: GYAE6OF01B5SLE.23.23.C01.1.454.CMB.1.raw
  modified_base (204)..(204): a, c, t, g, unknown or other
  misc_feature (204)..(204): n is a, c, g, or t
  modified_base (239)..(239): a, c, t, g, unknown or other
  misc_feature (239)..(239): n is a, c, g, or t
  modified_base (679)..(679): a, c, t, g, unknown or other
  misc_feature (679)..(679): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccaggagaccaccggagatattctttttgacacagtctccagacatcgtgtctgtgtctccgagggganaggacgcccaccctctccgtgcgaggccagtcagngtgtgccgactcgtggcctgtaaccaaacaaaaccgtggaccacgccctccgaggcctcgtctattccagtgggcctaccgtactacccgaacggacgggtcccaacgtcggaccaccgttcccgaggccgtacgggtcgaggtcggacgtaggtcggtcttcggtacgggtactacggtaccctttacgaccttaccgtccaacggtacgtaccgtaacggcgtacgggtccgtaaccccggaccccttagggtaaccgtttaacgttttacgacgtttaagttttacttacggtcgtacgacgtacggtaacggtcgggccgtaccgtcggtacccttagtaccccgttaccggttaccgggaaccggtacgggtaccgtacggacgtaggaaccgttagtaacgtaaacggtacgttggacgtctacggaccttacngtccttcgtccgtaaccg

SEQ ID NO: 48506 - DNA, 583 bp, Homo sapiens
  misc_feature: GYAE6OF01AXZFN.23.23.C01.1.454.CMB.1.raw
  modified_base (183)..(183): a, c, t, g, unknown or other
  misc_feature (183)..(183): n is a, c, g, or t
  modified_base (219)..(219): a, c, t, g, unknown or other
  misc_feature (219)..(219): n is a, c, g, or t
  modified_base (358)..(358): a, c, t, g, unknown or other
  misc_feature (358)..(358): n is a, c, g, or t
  modified_base (365)..(365): a, c, t, g, unknown or other
  misc_feature (365)..(365): n is a, c, g, or t
  modified_base (554)..(554): a, c, t, g, unknown or other
  misc_feature (554)..(554): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtntctgtgtctccgaggggagagacgccaccctctccngcagggccagtcagagtgtgccgtactccttggccttacggtaaccaaaaccaaaaacctggccacgccctcccgaggctcgtcattcagtggtacacactaccaacgacgggccacgtgccactccacgcacggtacngtcggcngtgcgtcgtggacagtacttcactctcagtacactcgctagtgccgtaccgttaggacttagtttcgcttagtttacttacgtagtaccgtagacctacgggtcgggcttccgtacggtaccctcgttaccgtaccttcggaccgtaagggtacctcgtacgtggacgtagtacgaaacgtcgtcgggngtaccgcgtacgactatcttcgtcttacg

SEQ ID NO: 48507 - DNA, 796 bp, Homo sapiens
  misc_feature: GYAE6OF01BS9SQ.23.23.C01.1.454.CMB.1.raw
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagattattcttttgacacagtctccagacatcgtgtctgtctctcgaggganagacncccacctcgtcctgcgagggccagtccgagtaggtgtcgccgtacgttccgttcggccttacggaaccaaactaaaaccgtcggaccacgccctaccgacggtctccgtctacgttcagtcggaccacactacccgaaacggtacgggacctacgtccgggacctaccgtaccccggaggtacctaggtaccgtacggtacggtcggacgtaggtcggtcgtccggtaagggactaacgtacttaccacttcccgtacaacgtactacgaacgtcgacgttaccggtaaccccgtacgtacggtaaccgttttagtttacggttaacgttttaacggttttacctagtttaccggaccgttagggaaccggttcgggtacggtccccggttacggttccggttaacttaacccgggttaccctttacccgggtaaccggtaaccggggtaccgggtaacccttacggggtaaaccggttacggggaaacggttacggttaaacgggttaaaacccgggtccgttacgggtacggttacccgggttacctaaccccgaaacgttttccgttacggtttcccggtttaaccc

SEQ ID NO: 48508 - DNA, 742 bp, Homo sapiens
  misc_feature: GYAE6OF01AHJVM.23.23.C01.1.454.CMB.1.raw
  modified_base (437)..(437): a, c, t, g, unknown or other
  misc_feature (437)..(437): n is a, c, g, or t
tcagacgcgagtatcacgaccggtgctcgatttagtacacgtgattagggattgggggaggaactgctcagtttggacccagagggaaccagtggaacgcccccaagctcagccttctcttcctcctgcctcctctggcctccagacgacccgacggagattatttctttagacacagtcctcagacatcgtgttctgtcgtccgtacgaggggagagacgccctaccctcctccgtaggccgacgggaccgtacgtcgaggtacggttgtccgcccgtaccgttcccgttggtaccgttaccggaaacctaaaaccgaaaccgtccggaccaacgcccctacccgaggtccctactctaacgttcaacgtcgacacactaccgaaccgtacgggccacgtcgacgtaccgccgacgtacgtacgtagcggtacggngtacgggtcgtcgtaccgggtaggtacctacgttaccctaccgtaccttccgacgtacgtaacgtaagccgtacggtacggtcccgtaccgtaccgttcgttaaggttttccgtttagtacgtttaacgttttacgttacgttcgtacggtacccgtaggtacccggtcggtcccgtccggtttacctacgttacccgttaccggtaccccgtacggaaccggttaccggaccgttaggacgttaaggacgaacggttaacggacgttagcggcgtactcgaactccgtatttctcgttctaccg

SEQ ID NO: 48509 - DNA, 776 bp, Homo sapiens
  misc_feature: GYAE6OF01BV70G.23.23.C01.1.454.CMB.1.raw
tcagacgcgagtatcacgaccggtgctcgatttagtacacgtgattagggattgggggaggaactgctcagtttggacccagagggaaccatggaacgccccagctcagcttctcttcctcctgctcctctggcctcccagacgaccaccggagattattcttttgacactagtctccagacatcgtgtctgtgtctccggaggggagagacgcccaccctcgtccgtgaccgacgggccagtcgaggtacgtggtcggcccgtaccgttccgttcggccgttacggtaacccgaaaaccgaaaacccgtcggacccaccggtcccgtacccgacggccttaccggtaccacgttccgaggtaccggacctaaccgacctaaccgaaccggaccggtacccgaccgtaccggaccaccggtccccgagggtaccggtacggtttaccgacggtaggtaccgtagggtccggtccgtacgggtacgggtaccgtaccggtacccgtttaccacccgttacccgtacgtaccggtaactaccggacggtaccgtaacggggttccgtaacccccgttaccggtacgttaaccggttaactttttacggtaacggtttacttttaacgttacgtcgtaccgtacggtacgttaccggcggtaccgtcgtacgtaccctacgtccgtaccgttcccggaagtaccggtcgacgtacggacgtaggtaacgtaacggacggtaggtcggactcgacctacgactgtcgttcgtagttcccg

SEQ ID NO: 48510 - DNA, 715 bp, Homo sapiens
  misc_feature: GYAE6OF01D426W.23.23.C01.1.454.CMB.1.raw
  modified_base (185)..(185): a, c, t, g, unknown or other
  misc_feature (185)..(185): n is a, c, g, or t
tcagacgcgagtatcacgaccggtgctcgatttagtacacgtgattagggattggggagtcaacaaccacatctgtcctcgagaggacacccctgtgaccacagctcctcaccatggactggacctggacgatcctcttcttggtggccagcagccagaagtcgcccactcccagaggaattggngcagtctcgggcctgaggtgaagagccgtgggacatacgaggtacgaaagtccaccgtgacgtaaacgggtcttaccgaaggtaactacccgtaaccctttaccaaccgttaaaatttagtaacgtaactaccgtaacgttaggggtacgacggaaccgaaccgggtacccccgtaaaggggtaaaacggggtacctaccgggtaaggttacggggagttaacgggggtacggttggggtaccggtaggttaccggtaaggtttcgggttaggaaagtaacggtaccgggtacgtactttacacgtaaggtaagttacgaacgggtcacgggactcgaacggtccctagtaccgtaggaaccttactacgaacgtaaacggacaacgtcctaggttacggaactggccggcgcctacgtaccgtcacgaacgaccgacgtcggtatacttgttggtagcgtaaggcgggcgacggtcgtcgttaggttacggattagtacgtggtacgtgacgtggtagggccaacgggg

SEQ ID NO: 48511 - DNA, 688 bp, Homo sapiens
  misc_feature: GYAE6OF01CIVCG.23.23.C01.1.454.CMB.1.raw
  modified_base (184)..(184): a, c, t, g, unknown or other
  misc_feature (184)..(184): n is a, c, g, or t
tcagacgcgagtatcacgaccggtgctcgatttagtacacgtgattagggattggggagtcaacaaccacatctgtcctcgagaggacaccctgtgaccacagctcctcaccatggactggatctggacgatcctcttcttggtggcagcagccagaagtcgcccactcccacgaggaattggngcagtctgggcctggaggtgaagacgccgtggggcatcgagtagaaagtcacgtgacaaggcttcgaggactaccaccttacaacctaaattgaattactacaacgtgggtcgaccgacgaccggtccccgtaagggaaacgggctacggagtcggagtgggcgtggggtcgtacgtccgtaaggttgtaggaacgtaacgtaccgggactagttccagtaacgtagttaccgaacgggccgaggctaccgacgtaccgtacgaaccgtacggaacctacgttacccgaaaggaaacgaacgaccgtacccttagttacgggaactccggcggtaccgtccgtaccgtaccgtcgaacggaccgtaccgaccgggtcgttaacgttatttacggtggttacggcggtaacgggcggggtccggtaacggtcggttggtttaaggtttgggaactttaggtagttaagggttcgtaaggtccggttacgggcgggtaaacccggg

SEQ ID NO: 48512 - DNA, 778 bp, Homo sapiens
  misc_feature: GYAE6OF01C041R.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcgttggtggcagcagccagaagtcgcccactcccacgaggaattggtgcagtcgtgggcctggaggtaggaagaacgccgtggggcagtcagtagaagtcacgtgacgaggtcttacgaggactactacctacaacctaatttagatactacgtaacggtgggtcgacgacgaccggacccgaagggaaaacggcgtacggaggtggaggtgggacggtgggtagtacggttacgtaggttggtaggaacgtaacggtaccggatacgttactagaagtaagtacgaacggtacgacggtctacgacgtaccgtacggaacccgtacggtaaaccctaccgttaaccgaaacggtaaacgaaaccgtaacggtacccgttaaagttaaccgggaactcggcccggtaccgtcccgtaacgtacccgttcgaacggaacccgaaccggtaccggtcgttacgttagttacgttcggtaggaccgggtaagggaccggggtacgggaaccgggttacccgggttacgggtttttaagggttttaacgggaaacgtttaaaggtttacgggttaacgggttaacgggttacggggttaacggttcccggggtaaaccgggggtacccggtaaaacccgggggg

SEQ ID NO: 48513 - DNA, 831 bp, Homo sapiens
  misc_feature: GYAE6OF01BD5BT.23.23.C01.1.454.CMB.1.raw
  modified_base (187)..(187): a, c, t, g, unknown or other
  misc_feature (187)..(187): n is a, c, g, or t
  modified_base (195)..(195): a, c, t, g, unknown or other
  misc_feature (195)..(195): n is a, c, g, or t
tcagacgcgagtatcacgaccggtgctcgatttagtacacgtgattagggattgggggagtcaacaaccacatctgtcctcgagaggaccaccctgtgaccacagcctcctcaccatggactggaccgtggacgatcctcttcttggtggcagcagcagaagtcgcccactcccagaggtaattggngcagtcgngggctggaggtaggaagagccggtagggctagtcgaagtagaaacgtcacgtacgagaacggttctaggagactacctaccttaaccaactaagttcatactcgtaaggtggtacgacgacggaccggtaccgaagggtaacggtcgtaacggtaggtcgggtaaggtggggtacggtgggtacggtacgttacggttaggtacggttacgggaaacgttaccggtacggtatttaacgtaccgtaacggtaggttaaccgtaacggaaccgggtacggtacgtaccggtacggtaccgtaccgttaacgggtaacgtaaccggttaaccgtaaccgtttaaggaaaccgtaaaccggtaaccgtacccggttaaccgttaaccgggttttaaccgggaacgttccgggaacccgtaccccggtaccgttaacccggtcccggtttaacggacccggttaccggaaccgggttaccgttacggggtttaacgttacggttttacggttaggccggtaacgggtaacggcggggtacgaccgggtttacgggtacgtttagggttacgttaaagttcgtttaaaggcggttaaacgtcgggttaacccgggtgggtacccggggtaggtaaccgggg

SEQ ID NO: 48514 - DNA, 851 bp, Homo sapiens
  misc_feature: GYAE6OF01DRFSF.23.23.C01.1.454.CMB.1.raw
  modified_base (812)..(812): a, c, t, g, unknown or other
  misc_feature (812)..(812): n is a, c, g, or t
tcagacgcgagtatcacgaccggtgctcgatttagtacacgtgattagggattgggggaggaactgctcagtttggacccagagggaaccatggaacgcccagctcagtccttctcttcctcctgccttcctctggcctcccagacgacccgacggatattatttcttttagaccactagtcctaccaagtacctattcggtgttcttggttccgttaccacccgggaggggggacaacggaccgaccccctacccccttccgtccgtcggaccggaacgggtcccaacggtacgaaggtacggtttccgggttaccggaccccggttaccttcccggtttacgggtcccggttaaaccggtaaaaccctaaaaacccgaaaaaccgtcggacctaccgtccccgtacccggacggtccgtaccgtactacttacacgtcggaacctaacgacctaaccgaaccggaccgggtaccacgtcggacctaccgtacccggacgacgtacgggtcgacggtcggacggtaggttcggcgttacgggtaccggaacgtacgtaccgttcctacccgttacgtaccgaacggtacttaccgaacggtacccgttacgggtcccgttaccggtaaccttagggttacccgtttacggtttacgttaccgtttaacggttttacgttacgtacgtccggttaacgtccgtaacggtccgggtaccgttccgtaccgtaccttaaccgtcgttacccgtacggtaaccgtacggtaccgtaccgaggtacggataacggtaaccgaaacggtggtaccgngtaccctgtaaccttcctatttaccggtctttccgtacc

SEQ ID NO: 48515 - DNA, 778 bp, Homo sapiens
  misc_feature: GYAE6OF01AXIH6.23.23.C01.1.454.CMB.1.raw
  modified_base (233)..(233): a, c, t, g, unknown or other
  misc_feature (233)..(233): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctcgaggggagagacgccaccctctcctgcagggccagtcagngtgttcgccgaccttccgttcggacccttaggtaacccaaacgaaaaaccgtcggacccaacgcccctacccgacggtcctccgtctacgttacacgtcggacacctacgtacccaacggacgggaccctacgtcggaccacgtccccggaaggtccgtacgggttacgacggtacggacgtacggtcggaccttacgggtacgggtaaccacggtaaccttcgaaccgtttccgtacgaaccgtactaccgacgaccggttacgtaccgggttcccgtaaccccgtttaggtaacccggtttacgtttttcgggtaacgtttacgttttttaattaacccgttgggtttacccgaaggttacccgttaaccggggttcggttaacccggcccgttacgggtacccctaacgttcccgtaacccggttccgggaaccgttaacgggccttacggaccggttaggaacggtacgtaacgggaaacttcgggtacggttaccgagttacccggaacctaccgttagtcccgtttggttaacccttcg

SEQ ID NO: 48516 - DNA, 705 bp, Homo sapiens
  misc_feature: GYAE6OF01D2VC4.23.23.C01.1.454.CMB.1.raw
  modified_base (361)..(361): a, c, t, g, unknown or other
  misc_feature (361)..(361): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacatcctcttcttggtgcagcagccagaagtcgcccactcccagaggaattggtgcagtcgtcgggcctggaggtagaagaacgccggtggggcatcgagtagaaacgtccacctgacgaagtcttacgaggatacctaccgttaccaaccttaagtttcgaattactactaacgtgggtcgacgacgtaccggacccgtagggaaaggcgtgaggtagagtgggtcgtagggntacgtcgtagttggtgaagtacgtccggactagttcagtagtacgtacgaacggtcgacgctacgacgcctcgacgtaacgacctacgtacgaagtaacgaacacgtaccgtagtacgacgtcgccgacgtccacgtaccgcgtacgacgaccgaccggtacgttaccgttagtttacggtgtacggaggtaacgggacgggtccgggtaccggtacgggttaaccggttttagggtttttacgggttaaaggtttaccgttttaagggttcggggttaaacggttttacccggggtacggtttaacccgggggtacggggtaaacccgggttaaccccggggg

SEQ ID NO: 48517 - DNA, 828 bp, Homo sapiens
  misc_feature: GYAE6OF01CB11S.23.23.C01.1.454.CMB.1.raw
  modified_base (478)..(478): a, c, t, g, unknown or other
  misc_feature (478)..(478): n is a, c, g, or t
tcagacgcgagtatcacgaccggtgctcgatttagtacacgtgattagggagttgggggaggaactgctcagttggacccagagggaaccatggaacgccccagctcagcttctcttcctcctgcctcctcgtcgcctccagacgacccgaccggagtattatttcttttagacacgtacgttctccagactagttcgtgtctggtcgtcctccggaggggacgagaccgcccctaccctcctccgtggccggtacgggaccctaggtcaaggtcgtcgttccggccgtaccttcggttcggtacccgttacggaaaccctaaaaccgtaaaacccgtgggaccccacgtaccccgttacccggacggtccttccggtactacgttccgagttcggacctaacgtacctaccgaaaccgggccgggccctaacggtcggaccctacccggtaccgtacgggtaccgtaacggttcggnggtccgacgggtcggttgggccgttagggacgggtaacctaaccggtaccttccgtaacctccggtaataccggtaagtccgaagtccgtacggtccgtaccgttaccgtacgaacgttttgttacgttacctttacgtttaacgtgtccgtaacggtacagggtaccgtccggacgacgtaccgtacggtaccggttactaacgggtttccccgaacccggggttacggaaaacccggtaccgggtaccgaaacccggttaaggttaaaccgttaaaaggtaccccggtaaggttacgtccgggtagtcccgactaccggttactaacgtttcccgttaagttaccccg

SEQ ID NO: 48518 - DNA, 732 bp, Homo sapiens
  misc_feature: GYAE6OF01ESZ8G.23.23.C01.1.454.CMB.1.raw
tcagacgcgagtatcacgaccggtgctcgatttagtacacgtgattagggattgggggagtcaacaaccacatctgtcctcgagaggacaccctgtgaccacagctcctcaccatggactggacctggacgatcctctttcttgggtggcagcagccagaagtgcccactcccacgaggaattggtgcagtctgggcctggaggtgaagagccgtgggcatcagtgaaatcacctgcaaggcttacgaggactaccaccttacaacctaaatttgaattatactaacgtgggtacgcgacgacggaccccgtaggggaaaacgggtccgtacggagggtggagtcggggtcgtgggtgtaggtccgttaggttggttaggaagtaacgtaccggggatacgttcctacgtaaggtaacggtttacaacggccgacggtcctacgacgtaccgtacgtaaccgtacgggtaacctaccgttaccgaaacgtaaacgaaccgaacgtacccttaaggtttacggaacgttccggaccggtaccggtaccctacgtacccgtcgtaacggaacccgtaaccggaccgggtaccgttaggttaacttagttggacggtacggaggtaccggggccggacgggtccggtaggtttaggttttaagggaagtttaacggttaggtaagggttacgtaggggtaccgttcggggtcggggtacccgggtaaaccggggg

SEQ ID NO: 48519 - DNA, 889 bp, Homo sapiens
  misc_feature: GYAE6OF01EY6HM.23.23.C01.1.454.CMB.1.raw
  modified_base (187)..(187): a, c, t, g, unknown or other
  misc_feature (187)..(187): n is a, c, g, or t
tcagacgcgagtatcacgaccggtgctcgatttagtacacgtgattagggattgggggaggaactgctcagtttggacccagagggaaccatggaagccccagctcagtcttctctcctcctgctcctctcggcctcccaggacgtacccgaccggagacgttattcttttgacacagtcctccganaccatcgtcgtactgtcgtctaccgaggggacacgtacgtacccgacccttgtcccgtagaccgaacggggccctacgtctaacgtcggttcggttacgtacccggtacttacccgtttggggacccttaacggtaacccgtaaacgtaaaaacccgttggaacccaccggtacccttacccgacggggccctttaccgggtacacgttttaccggagttaccgggacctaaccggtacttaacccggaaacgtaccgggggtacccctacggttacgggacccctaacgttaccccgaccggttaacgcggtttaacccgaggtacggtcctaagggttcccggtccgttacgggtacgggaaccgttacggttacccgtttacccgaacgtttacccgaacgtaccgtaaacgttcccggaaacgtccgtaaggtttccgtaccggtaaaccgttcgttaaacggttctttaacggacctttacggtttaacttacggtctaaacggtacacggttaggcccgtaactcggtcccggaactacccggtaacgtttaccccggtacgaaccgggtacgttaaaccggtcgtacccgggttaaggaacgttaaccgaacggggtaaaaccgttcgtaaacgggttccggtaacccgttgtaaaccccggtacttaccctacgtttggtaaacccccgtttag

SEQ ID NO: 48520 - DNA, 769 bp, Homo sapiens
  misc_feature: GYAE6OF01E1XTS.23.23.C01.1.454.CMB.1.raw
  modified_base (241)..(241): a, c, t, g, unknown or other
  misc_feature (241)..(241): n is a, c, g, or t
  modified_base (563)..(563): a, c, t, g, unknown or other
  misc_feature (563)..(563): n is a, c, g, or t
  modified_base (736)..(736): a, c, t, g, unknown or other
  misc_feature (736)..(736): n is a, c, g, or t
  modified_base (747)..(747): a, c, t, g, unknown or other
  misc_feature (747)..(747): n is a, c, g, or t
tcagacgcgagtatcacgaccggtgctcgatttagtacacgtgattagggattggggggaggaactgctcaggtttggacccagagggaaccatggaacgccccagctcagcttctctctctgctcctctggctccagacgaccacggatatactttcttttagacacacgtcctacagtacacgtcgttgtcttgtgtccgtaccggaggggaaggaacgacggaccctacccttgtcgngcgacggcacgtgtagcggtcgttccggacctcgttccgtcggtaccgtaacggaacctaaaaccgaacgtccggtaacgacccttcgtaccgcggtcctaacggttccgtaacttcggattaccggaccttacgaacctcccgtaaaagggtccgtacccttgggaaccctaggtaacccgtcccggtaagggcccggttaagtttaccccgggaggttaccggaacgttacggttaccggggacttccggggttacggaacctaacggtttccgtaactaagtccggtacaaccgttagaacgtcgtacgtaccgggttntaccggaccgttattaacggtacttgacgtttagttacgttaccgttgtaaccgtagtacgtacgggtaaccgtcgaccggtaacctcgttaacgacccgttaacggcccggtaagaccggttacgacacgggttacacgggttaacaacgtaggtaacctgggaccttaacncggtaccttancccgttaagtcctacgttaacc

SEQ ID NO: 48521 - DNA, 977 bp, Homo sapiens
  misc_feature: GYAE6OF01CBUER.23.23.C01.1.454.CMB.1.raw
tcagacgcgagtatcacgaccggtgctcgatttagtacacgtgattagggatggggggaggaactgctcagtttggacccaggagggaaccatcgggaacgcccccagcctcagtcttcctccttccctccctgtcctcctcgtcggcctcccgaaggacgacccgaccggatacttatttctttacgactacgtacgttacctccagactgtcgttcgtctcgtcgtccgtacgggaaggggacaaccggtccgtacccctccccgttaccgtacctcggacggaaccggtacccgtacgtacgtaggtaccggtttccggttaccggtacccgtccgtttcccgggttaggttaccgttaaccggtaaaaccccaaaaccggtaaaacccgtcggtaccccgaaccggtcccccgtacccggttaacggtcccttaccggtacctacggttcctaacgaccggtaacctaccggtaaacccaaccggtaaccgggtaccggtccccaacgggttccgacccgttacccgacccggttaacgaccggtttacggtccggaacggttccggtaacggtccgggttaaggttccgtaccgggacggttaactaccggttaccttacgtaccgtaccgacggtacgttaccgtccgtaacgttaccgtacccggttaacgtacccggttaaccggttcgggttaaaccgtttcgttaaccgttacgtttacttttaacggttcgttaacccgtaccgtaccgggtaacgtaccgggttacccggacccgttccgggtacgtaccctttacccgtccgggttacccggttacggggtaacccgaccgggttccctaacggggttacccgttagggacccgttaaagggttaacccgaacgggttacggttaaccggtccggtaacccgttcgggtaaaccccttcggttaaaccggttccctttgttacccgttacccgg

SEQ ID NO: 48522 - DNA, 975 bp, Homo sapiens
  misc_feature: GYAE6OF01CMPYI.23.23.C01.1.454.CMB.1.raw
  modified_base (130)..(130): a, c, t, g, unknown or other
  misc_feature (130)..(130): n is a, c, g, or t
  modified_base (935)..(935): a, c, t, g, unknown or other
  misc_feature (935)..(935): n is a, c, g, or t
tcagacgcgagtatcacgaccggtgctcgatttagtacacgtgattagggattgggggaggaactgctcagtttggacccagagggaaccatggaagccccagctcagcttctcttcctcctgcctcctntcggctcccagacgaccgaccggagtattatttcttttaggacctacgtacgttcctccaagacctaacgttccggttgtccttggttcgtccgtccggagggggacacgacgtaccccacccttccgttcccgtggaccggaacgggtccgtagtaccgtaggtaggttcggtttaccggacccgttacccgtttcccggtttcgggtaccccgttaacggttaaacccgtaaaaaaccctaaaacccgtccgggaccctaacggtcccccgtaccccgtaagggtcccgttaccggtttacctacggtttaccgacggtttacggaacctaacccgtaaccgttacccgaaaccggttaccggggacccttaacggtaccgggacccttaaccggtccccggtaacgggtacggttaacccgggtttacgtaacccgggggcggttaacgtaaggggtttcgggacccggttttacgggacggggaacccctttaagggtacccgttttacaacccggtttacgtttacccgggacttaccggttaccgaacggttccgtaaaccgggtttcccgtaaccccggttaaccgttacgttaaccggtttacgttttaaccggacttttaacgggtttacgtttacgtacggttaaccggtacgttaaccggttaaccgggtccggtaacccggtttccgttaacgttaccgtaaccgtttaccgtacccggttaccggtaccggtaacgggtaccgttcggaccgtacgggtataaccgggtacaacggttacgtttcggggtcnccgttaacgcctaagtcccttacgttcgtaccgttacccg

SEQ ID NO: 48523 - DNA, 856 bp, Homo sapiens
  misc_feature: GYAE6OF01CN4QS.23.23.C01.1.454.CMB.1.raw
tcagacgcgagtatcacgaccggtgctcgatttagtacacgtgattagggagttgggggaggaactgctcagtttggacccagagggaaccagtggaagccccagctcagcttctcttcctcctgtcctcctctcggcctcccagacgaccaccggagtattatttcttttacgacacacgtctccagaccatcgtgtctgtgtccgtcggaggggagagaccgccgtccctctccgtggccgacgggcctacgtcgagtagttcggttacgccctacgttccgttggccgttaggtaacccaaaaaccgtaaaaccgtccgggacctaaccgcccccgttaccccggacggtccgttccggttaccctattaccgacggtccggaacctaccgtaccgtaacccggaaaaccggccgggtacccgtaccggttacggtaaccctaacccggtcccgacgggtaccgggttaacgggttacggacgggttaccggtcggtaacggggtcgggtacccgtttcgggaccgggtaacgaccggtttaacccttacctaccgtcctccgtaacccgttagtcgacggttccgtaagggttcccgttaccccgtacccgttagtttacgtttaacgtttacgtaccgtttttacgttacgtttacggtcgtacgtcccggtaacggtaacccggttccggtcgtacccggtcgttcccgttaaccgttccggtaccggttaccccggaaggtaccggttaccgtacgtacggtacggacggtaaacggtaacggttaacgtacggtcggtttacggccgttaaccggtctaacccgttagtaccttccgtaactttcccg

SEQ ID NO: 48524 - DNA, 840 bp, Homo sapiens
  misc_feature: GYAE6OF01DXWN6.23.23.C01.1.454.CMB.1.raw
tcagacgcgagtatcacgaccggtgctcgatttagtacacgtgattagggattgggggaggaactgctcagtttcggacccagagggaaccatggaacgccccagctcagcttctcttcctcctgcctcctctcggcctcccagacgacccacggagtacttatttctttcgaactactacgtcctaccagactagttcggtcgtcttgttcgtcgtaccggaggggtacgacgaccgccctaccctctccgtcggccgacgggccagtcgtagtaggttcgtccggccgtaccttccggttacggaccctaacggtaaacccaaaaccgtaaaccgtccggaccaccgtaccctccggtaggtccctacgtcctaacttcgtacgtccggaccaccgtaacctaacccgtaaccggccggtaccacggtcggaccgtaccgtaccggacggtacgttacggtacgcggggtacgtacgtacgggttcgtcggtaccggtcggaaaccgttcgtccgtttacaccgttaaccgtcgaaacgttccgacgtacgtcgttaccggtaccggtaccgttaccggttaacgttacggtttacgtttacggttaaccttttacggtttaacgttacgttaccgtacgttaacggtccgttaacgggtcccggaccgtttcccggtaccgtcccgttaaccgttcccggttaacccggtcgggtaaccggtaaccgggtacctaaccggtacgggtaacggtaagttaaccggtaccggaaaccgttacgggtcgacggttacccgaacgtaccgtactaccgttttcggaaccttcccggtaccg

SEQ ID NO: 48525 - DNA, 736 bp, Homo sapiens
  misc_feature: GYAE6OF01EZPAS.23.23.C01.1.454.CMB.1.raw
  modified_base (237)..(237): a, c, t, g, unknown or other
  misc_feature (237)..(237): n is a, c, g, or t
  modified_base (696)..(696): a, c, t, g, unknown or other
  misc_feature (696)..(696): n is a, c, g, or t
  modified_base (716)..(716): a, c, t, g, unknown or other
  misc_feature (716)..(716): n is a, c, g, or t
tcagacgcgagtatcacgaccggtgctcgattttagtacacgtgattagggagttgggggaggaactgctcagtttggaccagagggaaccatggaacgccccagctcagcttctcttctcctgctccgtgtggcctacccgagacgacccgtaccgggagtattatttcgttttacgaactactacgtctaccgaagacctacgtcgttgttcgttggttcgtactcggagggganacggacgccctaccctctccgtggcgacgggccgagtacgtaggaggttggtccgaccgtcgttcgttacggccgtacggtaaccaaacgaaaccgtcgaccaccgtcctaccgacgtcttccgtcgtaatcgtacgtcggacctacaccgtaccacggaccggtacacgtccgacaccgtccgacggtacgtaggtcgaccggtacggtagcgggtcggtacgtacgggtacggaacgtccggttacttccaccgttcgaccgtacgttacgccggtactcggtacgtccgttacgtacccgggttataccggtttatttccggtaagtttaggtttacttccggtagtacccgtaggtaccgtcgggtaccggtctccggtactaccgtacgtccgtaccgtccgtaacgtacgccgttcgggacgttaccgaagttccgtaacgacggtttaccgnggtacctaccgccgtaacgnttccggtccttgtaccctcg

SEQ ID NO: 48526 - DNA, 882 bp, Homo sapiens
  misc_feature: GYAE6OF01BWDD2.23.23.C01.1.454.CMB.1.raw
tcagacgcgagtatcacgaccggtgctcgattttagtacacgtgattagggattggggggaggaactgctcagtttggacccagagggaaccatggaagccccagctcagcttctcttcctcctgctctctggctccagagaccgacggagattattcttttgacacagtctccagacagtcgtgtctgttcgtcgtccgagggggagacggtacgccctacccgttcctaccgtgacgacggccgtagtcgaaggtagtggttcgacccgtactccgtttcggccttacggtaacccaaaccgaaaaacccgttcggacccgtaaccgtccccgtacccgacggtcccgttaccggttacctacgttttaccagtcggtaaccaacgtaccgtaacccggtaaacgaccgggtaccgtaaccgttacggacctaacccgtacccgtaacgggaccgtttaacggtaccgtaacgggtcggacgtacgggtcgggaccgtttcgggtaacgggacgtaaccgtacgttactaccgttaccgtaacgacgttacgtaccgtaacgtaccgggtaacgtttccgacccgttaaccgtacggtttaaccgtttaggtttttcgtaacgtttaagtttttaaccgttaagttccggttaaccgtacgtaccggttaaccgggttaccgaccggtttaaccggttacccgttaccgtaaccgggttaccccctaacccgggtttaccgaaccgggttaccggtaaccgttaccgggtacgtaccgggaagtaaccgttaaacgggtaaacccgttacgggttacggttaacggacccggttacaacccggttacttacgggttcttacccggtttccttaaccccgg

SEQ ID NO: 48527 - DNA, 796 bp, Homo sapiens
  misc_feature: GYAE6OF01CCX4G.23.23.C01.1.454.CMB.1.raw
  modified_base (233)..(233): a, c, t, g, unknown or other
  misc_feature (233)..(233): n is a, c, g, or t
  modified_base (785)..(785): a, c, t, g, unknown or other
  misc_feature (785)..(785): n is a, c, g, or t
tcagacgcgagtatcacgaccggtgctcgatttagtacacgtgattagggattgggggaggaactgctcagtttggacccagagggaaccatggaacgccccagctcagctttctcttcctcctcgcctcctcgtggcctccagacgaccgaccggagtacttactttcttttacgaacactacgttcctccagactagttccggttgttctgttcgttacctcggaaggganacggaccgccctccctccgttcgcgaccggacgggtaccgtacgtacgtaaggtcgttcggttccgaccgttaccgtttccgtcggtacccgttaacggtaaacccaaaaccgtaaaaccgtcggacctacgtccccgacgacgtccgttcgtctacttcgcgtacgaccacgtacgtaccggaacgtacggaccaggtaccgacgtaaccgtcggacgtaccgttacgtcgacggttcgcggcgtcggtccgttaggtacgggaacttaccgttactcgttaaccctcctaacggtctacggactacggtaccgtacggttacccgtacggtaaccctcggttaaaccgtttcgtttaagtaacgttttagttttaccgtaacgtttcgaacgttacgacggttaacccggtcgttcccgtcgttacccgttacttaccgtaccctacgggttccgtaaccggtccgggtaacgtaccggacggttacggaacgaacgtacgttaacggtagtcgtaccgggacttacccgcgttaactgtttaccgtttntccgttacccg

SEQ ID NO: 48528 - DNA, 755 bp, Homo sapiens
  misc_feature: GYAE6OF01D6V42.23.23.C01.1.454.CMB.1.raw
  modified_base (150)..(150): a, c, t, g, unknown or other
  misc_feature (150)..(150): n is a, c, g, or t
  modified_base (199)..(199): a, c, t, g, unknown or other
  misc_feature (199)..(199): n is a, c, g, or t
  modified_base (718)..(718): a, c, t, g, unknown or other
  misc_feature (718)..(718): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccacggantattcttttgacacagtctccagacatcgtgtctgtgtctccgaggggnagacgcccaccctctccgtgcgacgggccagtcagtgtgttcgaccgtacttccgttggcctaggtaaccaaacgaaaaaccgtcggacccacgtccctacccgaggtccgttaccgtactacgttacacgtcggaccaccgtaactacccaaaccgacgggcccacggtcggccaacgtcccgacggtcgtaacggttccgaggtcggacgtaggttgggtccgttacggtacggggaactaacgttaccgttaccctaacgttcgtaaccgtacgtaacttacgacggtacgtacggttaccggtaccccgtaccgttaacggtacgtttacgttttacgacgtttaagtttttaacgtttacctacggtttacaaccggtacgttaccgggtaggtcccgtacggttccggtaccgtttaccgtacccttaccggtttaccggaccgtaaaccggggtacttaacggtagggtaccgaggtttaagaaacggtaaacggtacgttggtacggtacnccggtaacacccgttattccgttccgttgttaccccg

SEQ ID NO: 48529 - DNA, 897 bp, Homo sapiens
  misc_feature: GYAE6OF01C9B3I.23.23.C01.1.454.CMB.1.raw
  modified_base (205)..(205): a, c, t, g, unknown or other
  misc_feature (205)..(205): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatccctctttcgttggtgcagcacgccagaagtcgcccacctcccgacgaggaattggtgcagtcgcggctaggnggagaagacggtccgtgggactagtcgaagtacgtaacgtccgtacgtcggacgaacggtctacgagtactaccgtacctactaacctaattacgaatatacgacggtgggtcgacgaccgacggtaccccggtaaggaaacggtcgtaggtaggtacggaggtcgggtacgtgggtaggtacgtcgttaggtgtaacggtaacggaaacccggtacggacttacgtacgtacgaaaggttaacgtacggaacggtccgtaacgggcttaccgggtaaaccgtaccggttaccggacccggttaacgaaaccccgttaaccgtaaccggaaacgtaaaccgtaaccgtaccgttaaacccggtttagttaaccgggaccggttccgacccggggtacccgttaacccggttacccgtacccggttacgtacccggtaaaaccggggtccccggggttaacccgttaccggtttaaggtttaaaccggttaaggtttaccgggtaccggggtaacgggaaccggggtaaccggggaaccgggggtaccgttaacccggggggttttagttttaaacgggggttttaacgggttaaacgtttaacgggttttaacgggtttacgggggtaagtttacccggggtagggtttacccggggtaaccgggggggttaacccggtaaaccccgggggg

SEQ ID NO: 48530 - DNA, 754 bp, Homo sapiens
  misc_feature: GYAE6OF01DWEGR.23.23.C01.1.454.CMB.1.raw
  modified_base (154)..(154): a, c, t, g, unknown or other
  misc_feature (154)..(154): n is a, c, g, or t
  modified_base (174)..(174): a, c, t, g, unknown or other
  misc_feature (174)..(174): n is a, c, g, or t
  modified_base (671)..(671): a, c, t, g, unknown or other
  misc_feature (671)..(671): n is a, c, g, or t
  modified_base (715)..(715): a, c, t, g, unknown or other
  misc_feature (715)..(715): n is a, c, g, or t
tcagacgcgagtatcacgaccggtgctcgatttagtacacgtgattagggattgggggaggaactgctcagtttggacccagagggaaccatggaacgccccagctcagtcttctcttcctcctgcctcctgtggcctccagacgaccacgganattattctttgacacgatcncagtacatcgtgtctgtgtcctacggaggggacgagacacccacccgtctccgtcggacggaacgggccaggtacgaggttaggttcggtaccgaccgttcgttaccggttcggtaccgtaaaccggtaaacccaaaacgtaaaccggccggaccaccgtcccgtacggacggtaccttactactacgttacgacgacgtaccaaccttacaccgaacggtaccggacacggtaacgccctacgtccgagtaccggtgtacgcggactggtaaggttcggacccgtaggtaacggacttaacgtaccctttacgaaccgttaccgtcggaacctaagtaccgtacgacgggttaccgtacggttaccccgtaccgtaagtttaccggtttaattcggtaacgtttttacgtaaagtttccacgtaacgcggaccggttaaggccgaccgttcggtacggaccccttagggaccccttaaccggggaccaaacccggnggtacctaagggctaaacggaaagtacacggtaacttcgggacncggtacacggtaccctagtccgttacttcgacttacccg

SEQ ID NO: 48531 - DNA, 747 bp, Homo sapiens
  misc_feature: GYAE6OF01BDUYR.23.23.C01.1.454.CMB.1.raw
  modified_base (206)..(206): a, c, t, g, unknown or other
  misc_feature (206)..(206): n is a, c, g, or t
  modified_base (731)..(731): a, c, t, g, unknown or other
  misc_feature (731)..(731): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagattatttcttttgactacagtctccagactatcgtgtctgtgtctccgagggganagacgcccaccctctccgtgcgacgggccaggtcaggtacgtgttcgccgtactccgttggcctacggtaacccaaacgaaaaaccgtcggacccacgtcccctacccgacggtccttccgtctacttcacgtggccactacctaccgaacgacggggccacgtcggactacgttaccgtagggaccgtaggttaccgacggttcggacgtagggttggaccgttcggtacgggtaacctacggttacccttaccgtaccgttaccgttacggaaccggttacgttaccacggtaccgtacgggtttcccggttaccccgtaacccggttacggtaaccggtttaacgtttttacggtaaccgtttaacgtttttaacgttacgttcggttaccgaacgttaccgtaaccgggtcggtacgtccgtaccggtccttagtcccgttaccgttaccgggacgaacggtcctacggtacgtaggagtaacgtacggtaacacgtcggtacgtccgacgtacgaccgtnttcgttcgtcttaccg

SEQ ID NO: 48532 - DNA, 714 bp, Homo sapiens
  misc_feature: GYAE6OF01ED9RL.23.23.C01.1.454.CMB.1.raw
  modified_base (293)..(293): a, c, t, g, unknown or other
  misc_feature (293)..(293): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgacggaattggtgcagtcgtgggcctgaggtggaagaacgccgtgggcagtcgagtagaaacgtccaccgtgacgtaacggtcttacgaggtactacctacccttacctaaactaaatttnaactattacgaacgtcgggtacgaccgacgaccgggtacccccgtaaggggaaacgggtccgtacggtaggtcgggtacggtggggtcgtgggtacgtacggtccgttagggttagtacgaacggtaacggtaccggcgttaattccgtagtaaggtaacgtaccggaacggtccgaggtccacgtacgccgtcgaacgtacgtaactacgttacaacgtaacacgtactacgtacgttacgacgtcggccgtaccgtaccgtacgtacctacgtccggacgaaccgtaccggttacgtagtttagtttacgtcgggtagaggtacggacggacggaccgggttcggtaacggtttaggttaggtaagttacgtttaggtaggttcggtacggtggttacggtacgggtcggtaaccgggg

SEQ ID NO: 48533 - DNA, 770 bp, Homo sapiens
  misc_feature: GYAE6OF01EQRA5.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctggaggtgagaagccgtggggcagtcagtgaaacgtccaccgtgcgaaggcttagaaggtactacgaccttacaacctaaattttcgattactacgaacgtgggttgccggaactacggacccccgtagggaaaacggctcggaaggttggaacggtcgggaccgttggggtacgtacggttacccgttaggtggttaggaacggttaaacggaccccggggtactaacgtttaccgttacgtaaacggtaacgtttaccggaaacggtaccccgtaagggtcccgttaaccggaaccggttcccgtacggtaacccgtacggtaaaccccgtaccgtttaacccgaacgggtaaacgtaaacccgtacgtaccccgttagtttaccgggaaccgttcggtaccccgccggtaccgtacgtacctccgagtaccgacggtaccggtcgttacgttactttagtgtaccgacggtaggtaccgggcggtacgggaccggtacggttaaggttttacgggaactttacggttattcgggtacgtggtaacggtcggttacgggccgggttaaccggg

SEQ ID NO: 48534 - DNA, 703 bp, Homo sapiens
  misc_feature: GYAE6OF01A9HIO.23.23.C01.1.454.CMB.1.raw
  modified_base (220)..(220): a, c, t, g, unknown or other
  misc_feature (220)..(220): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagacgccacccgtctccngcgagggccagtcgagagtgttcggccgacttccgttcggcctaggtaacccaaaaccgaaaaacctcggacccacgccctcccgaggctcgtcagttcagtggccacataccaacgacgggccacgtcggacacgtcccgaggctagggttcgacggtggcgaggtcggtcgtcggtacgggactagtacttcgactaccgtacaacgactcgacgtacgacggttcgtaccgacccgttggtaaccgttaagttttcgactttagtttaacgttacgtgtaccgagtacccgtaaggtcggacgtcccggttagtcctaacgtcccgtaccgtttccgggaaaccgggtacgggtacccgcggttaacggtcgggtaaaaccgtaggtaaccgggaaaacccggtaccggtttaccgggacgggtacgttaccccggttaacgaacccgttaagtttcccgttacggttccctttacccgg

SEQ ID NO: 48535 - DNA, 724 bp, Homo sapiens
  misc_feature: GYAE6OF01DM1OJ.23.23.C01.1.454.CMB.1.raw
  modified_base (320)..(320): a, c, t, g, unknown or other
  misc_feature (320)..(320): n is a, c, g, or t
  modified_base (409)..(409): a, c, t, g, unknown or other
  misc_feature (409)..(409): n is a, c, g, or t
  modified_base (693)..(693): a, c, t, g, unknown or other
  misc_feature (693)..(693): n is a, c, g, or t
tcagacgcgagtatcacgaccggtgctcgatttagtacacgtgattagggattgggggaggaactgctcagtttggacccagagggaaccatggaacgccccagctcagctttctcttcctcctgcctctctgctaccagagacccacggagtattatttcttttagactaacaattcctacaagacagtcgtgtctgtagtcctacgaggggagagacgcccaccctccgtccgtgaccggacgggaccagtcgagagttcgtcgacccgtcgtccgtgtccgagtaaaccaaacaaaccgtcgaccaccgtccaccgngtcctacgtctacttcgacgtcgaccacaccgtaccgaacggaccgccgtaggccggtaccaccgtacccggaggtacgtacggttacncggggttacgaccggtagggtccgttaaccggtgggtaaccgggaacgtaaccgtttacctacccgttaactaccgttacgaaccgtcgtaacgacgttaccgtacggttccgtaccgtaacgttacggttactttacgttacgttacgtttaacgttttacgtacgttacgaaccggttacggttaacgaccggttcgggtacctacccgtgttacctcgttacccgcgttacggaccgtacgacgtacgtacggataacggtagtaacgaaggtcgtcgganccggtacacgtacgtagttctagtcttaccc

SEQ ID NO: 48536 - DNA, 851 bp, Homo sapiens
  misc_feature: GYAE6OF01EME8D.23.23.C01.1.454.CMB.1.raw
tcagacgcgagtatcacgaccggtgctcgatttagtacacgtgattagggagttgggggaggaactgctcagtttggacccagagggaaccatggaacgccccagctcagcttctcttcctcctcgctcctctggcctcccgagacgacccgaccgggagtattatttcgttttacgactactaggttcctaccaagtactagttccgtgttcgttgttcggtccgtaccggaggggacgacggtaccgcccctacccgtccgtccgtacggaccggacgggtacctagtacgaggtagttccggtccgcccgttaccgtttccggtacggtaccgttaccggtaaacccaaaacctaaaccggtccggaacccaaccggtcccctacccggacggttaccttaccgtacgtacttaccggtcgtaccgtaacctaccgtaacctaaccggaccggtcggacccgtacggcgtacctaccgttaccggacggtacgttaacggtccgtaacggttcggacctacggggtcgttacccgttacgggtaaccggaaccttacggttaaccctttaccccgaaccgtttccccgaaaccgtaccgtaacggttccgtacgggtacccggtacggtttacccggtaaccccgttacggtttaccggttaacgtttcgtttaaccgtagttttaaccgtttcgttaacgtacgttaccggtaacgtccgtacggtcctaccggtgtacccgttactgttacccgtcgtaaccggcgttacggtcacggacggttagaacgttacggaactaggtacggtcggtacactacgtctacgtatttcgtctaccgttccg

SEQ ID NO: 48537 - DNA, 677 bp, Homo sapiens
  misc_feature: GYAE6OF01BCS5C.23.23.C01.1.454.CMB.1.raw
  modified_base (291)..(291): a, c, t, g, unknown or other
  misc_feature (291)..(291): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtcgccccactcccacgaggaacttggtcgcagtcgtgggcctggagggtagaagaacgccgtggggcatcgagtagaaacgtccaccgtgacgaaggtcttacgaggtactacctacctacaacctaaattnaatactacaacgtggtcgcgacgcggaccgtagggaaaggtcgtagaggtggagtcgggtgtgggtagtcgtcgtaggtgtagagtaacgtccggactattcgtagacgtagttacgacggtaccgacgtacgcgcgcgtacgaccgtacggtaacctacgtaacgaacgtaaacgaacgacgtaccgtaagttacggacgtcggaccggtcgtcctacgtacctcgtacgaccgtacgtaccggtacgttacgttaatttggttcgagggtacggagggtacgggccgggtaccggtcggttacggtttaaggtttacggtaagtttacgttaggttacggttacgtacggggtaccggttcgggtccggggcggtaaccggggg

SEQ ID NO: 48538 - DNA, 750 bp, Homo sapiens
  misc_feature: GYAE6OF01DF4SL.23.23.C01.1.454.CMB.1.raw
  modified_base (358)..(358): a, c, t, g, unknown or other
  misc_feature (358)..(358): n is a, c, g, or t
  modified_base (377)..(377): a, c, t, g, unknown or other
  misc_feature (377)..(377): n is a, c, g, or t
  modified_base (546)..(546): a, c, t, g, unknown or other
  misc_feature (546)..(546): n is a, c, g, or t
tcagacgcgagtatcacgaccggtgctcgatttagtacacgtgattagggattgggggaggaactgctcagtttggacccagagggaaccatggaagccccagctcagccttctcttcctcctgccttcctctcggcctacccaggacgacccgaccggatattatttcttttgaacacgtagtcctaccaagactatcgtgtctggtcgtccgtaccggaggggacagtacgcccctaccctcctccgtgccgtaacgggcctagtccgagtagtcgttcgaccgtctccgtgccgtagaaaccaaacgtaaaacgtcgacaccgtccctacgagtctctagacttcgagtcgacanaccgtacaacgacggaccngcgactaccgaccgagtcgtaggtcaggtcgacgtacgtccggtcgtaacggtcggaaaccgtacgttaacccttacgtacgtttaccaaacgggtacctaacgttacgaaccggaccggttcgtaccggggtttacccaacccgtaggttaccgtttaagtttaaccnggttttaacgtttacgtacgttccgaaccgttagacccgttacgggtccgtccgtacggtacttacccgtaactacccggtaccgttaccgggtacgaacggtccgaagtaccggttaggacgtaacgttaaacggaaacggttccgtacgggtctaaccggttacacccttaaaggttcccttaagtcctttaaccgtacccg

SEQ ID NO: 48539 - DNA, 924 bp, Homo sapiens
  misc_feature: GYAE6OF01AL2SQ.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgcttcctcgtcggcctccgagacgacccgaccgggacgtattatttcgttttacgacgtacagtcctaccgtacgactacgtttcgtcgttcgttcgtcggttaccgttacccggaaggggtacggacggaccggtacccctccccgttaccttacccgttcggaaccggtcgggtaccgtacgggttacgagggttaacggttccgggttaccgggtccccggttaccgtttccggttaccggggtacccggttaaccggtaaaacccccaaaaccgttaaaaccccgggttccgggtaccccgtaaacccggtttacccccggtaccccggtaacgggtacccttttacccgggttacttaaaccgtttccgtaaccgggtaccggtacctaacccgtaaccccgtacccgaaacggacccggggtccaccgttacggacctaaccccggtcccggtaacgggtaccgttacgggttaccgtagggttccgtacgggacggttccgggtaccgttaccgggtaacggtaacccgtaggtttaccctaccgtaccgtaccgtacgtacacgttaaccacgttaaccggtagtaccggttacccgtcgttaaacggtccgtttagtttacgtaccgtttagtttaccgtactccggtagtaccgtaacgtcgggtaccgtcgtaccggtactaccgttaccgtccctacggttaccgcgggttacgccgttcgagtacgtacgtaagaccgtaagcgtacgggtcaccgttatcccgtactcgttcgttaccgtcctaccgg

SEQ ID NO: 48540 - DNA, 748 bp, Homo sapiens
  misc_feature: GYAE6OF01EUEVO.23.23.C01.1.454.CMB.1.raw
  modified_base (714)..(714): a, c, t, g, unknown or other
  misc_feature (714)..(714): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagacgaccaccggagattatttcttttgacacagtctccagacatcgtgtctgtgtctcgaggggagagacgccaccctctctcgcgacgggccagtcagtagtcgttcgaccgtactccgttcggccgtacggtaacccaaaccgaaaaccgtcggacccacgccctacccgaggtccgttaccgtctacttacgaacgttcggacctacctaaccgtacccgaacggtaccgggccctaacggttcgggaccaccgttccccgaaggtaccgtacgggttaccacggggtcggacgtagggttcggtacgtcggtacgggactacggtaccttaccgaccgttccgtaccgtacgtacgtaccgacgtccgttacggtccgttacccgtacccggttagtacggtttacgtttacgacgtttaacggttttaacttacggttgtaccgaaggtcccgtaacggttcgggtaccttaccgttccggtaccttaccggtcccgttaaccggttcccggaacggtacggtccgtacgtaacgtcgggaataacggtacgtaaaggcgtggtaccggtntaaccgacttacgtgttaccgttgtccgttaccg

SEQ ID NO: 48541 - DNA, 630 bp, Homo sapiens
  misc_feature: GYAE6OF01AHANI.23.23.C01.1.454.CMB.1.raw
  modified_base (207)..(207): a, c, t, g, unknown or other
  misc_feature (207)..(207): n is a, c, g, or t
  modified_base (226)..(226): a, c, t, g, unknown or other
  misc_feature (226)..(226): n is a, c, g, or t
  modified_base (457)..(457): a, c, t, g, unknown or other
  misc_feature (457)..(457): n is a, c, g, or t
  modified_base (613)..(613): a, c, t, g, unknown or other
  misc_feature (613)..(613): n is a, c, g, or t
  modified_base (620)..(620): a, c, t, g, unknown or other
  misc_feature (620)..(620): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagacccgaccggagtattatttcttttgacacagtcctccagacatcgtgtctgtgtctcgagggganagacgcccaccctctccgngcgacgggccagtcagtgtgtcgccgtacttcgtggcctacggaacccaaacaaaccgtcggaccacgccctacccgaggtcctcgtactattcagtcggacactacacccgaacgacgggcctacgtcggacctaccgtacccgaggccgtaggttcgaaggtcggacgtagggtcggtccgtacgggtacggtacgtacgttctacctcgtacctaccgacgtacacgngtacgtaggtccgtaccgtacccgttgaaccgtttcgtttagtaacgtttacgttttagtaccgtgtacgtacgtacggacgtcggcctcggtcgacctctaccgtcgtcggaacacggtctacgcgtagacgtacgtaaacgacgtggtgtggcngccctanttctctctcg

SEQ ID NO: 48542 - DNA, 497 bp, Homo sapiens
  misc_feature: GYAE6OF02HB619.23.23.C01.1.454.CMB.1.raw
  modified_base (201)..(201): a, c, t, g, unknown or other
  misc_feature (201)..(201): n is a, c, g, or t
  modified_base (366)..(366): a, c, t, g, unknown or other
  misc_feature (366)..(366): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaacctggccagcctccaggctcgtcattcatggcacatccaacagggccactggcatcccaggcaggttcagtgcagtggctcgtgggacagacttcactcncacgatcagcagtgtcgaccctgacgtatttgctagtttattctgtcagcaagtgcgcctggcctatcaccttcggaccaaggcctcgactggagtagtcgaaacgactggtagctgcaccatcctgtctc

SEQ ID NO: 48543 - DNA, 553 bp, Homo sapiens
  misc_feature: GYAE6OF02HI44Z.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccacctctcctgcagggccagtcagagtgttgccgactccttggcctggtaccaacaaaacctggccagcctccaggctcgtcattcatggcacatccaacagggccactggcatcccaggcaggttcagtgcagtggctcgtggacagtacttcactctcacgatcagcagtcgtcgacctgacgtatttcgctagtttacttacgtgtacagtctaacgtcggacgtccgtaggtcctagtcctaccgttcggacctaaagggtcctcgtacgtgggtaacgtacgtacggaaaccgtacttcggtacggtacttcggacctaccgtagtccgttgtaccttaccg

SEQ ID NO: 48544 - DNA, 515 bp, Homo sapiens
  misc_feature: GYAE6OF02JVQ1Z.23.23.C01.1.454.CMB.1.raw
  modified_base (200)..(200): a, c, t, g, unknown or other
  misc_feature (200)..(200): n is a, c, g, or t
  modified_base (404)..(404): a, c, t, g, unknown or other
  misc_feature (404)..(404): n is a, c, g, or t
tcagacgcgagtatcacgaccggtgctcgatttagtacacgtgattagggattggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaacctggccagcctccaggctcgtcattcatggcacatccaacagggccactggcatcccaggcaggttcagtgcagtggctctgggacaggacttcgactctcacgatcagcagtgtcgaccctgacgatttgctagttnttactgtcagcaacgtggcgcctggcctatcaccgttcgcctaaacgggactcgactgggagtacgtgaaacgacgtcgtggacttggactaccgatccgtagtccttacg

SEQ ID NO: 48545 - DNA, 489 bp, Homo sapiens
  misc_feature: GYAE6OF02HG1QW.23.23.C01.1.454.CMB.1.raw
  modified_base (201)..(201): a, c, t, g, unknown or other
  misc_feature (201)..(201): n is a, c, g, or t
  modified_base (427)..(427): a, c, t, g, unknown or other
  misc_feature (427)..(427): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccacctctcctgcagggccagtcagagtgttgccgactccttggcctggtaccaacaaaacctggccagcctccaggctcgtcattcatggcacatccaacagggccactggcactcccaggcaggttcagtggcagtggctcgtgggacagacttcactctcacgatcagcagtgtcgaccctgacgtatttgactagtttattactgtcagcaacgtgcncctggcctatcaccttcgcaaggctcgactggagatgaacgactgtgctgcacatctgtctc

SEQ ID NO: 48546 - DNA, 542 bp, Homo sapiens
  misc_feature: GYAE6OF02GWKJ7.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaacctggccagcctccaggctcgtcattcatggcacatccaacagggccactggcatcccaggcaggttcagtggcagtggctcgtgggacagacttcactctcacgatcagcagtgtcgaccctgacgtatttgctagtttatactgtcagtctaacgtggcgtccgtggcctatcctacccgtttccggaccgaaacgggtacctcgacgtgggaacgtacgtacggaaaccggtacgtggtacggtctaggccaaccgtattccgtgttcttacc

SEQ ID NO: 48547 - DNA, 497 bp, Homo sapiens
  misc_feature: GYAE6OF02F0N1E.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaaacctggccagcctccaggctcgtcattcatggcacatccaacagggccactggcatcccaggcaggttcagtggcagtggctctgggacagacttcactctcacgatcagcagtgtcgaccctgacgtatttgctagtttattactgtcagcaacgtggcgcctggcctatcaccttcgccaagggctcgactggagatggaaacgactggtggctggcaccatctgtctc

SEQ ID NO: 48548 - DNA, 508 bp, Homo sapiens
  misc_feature: GYAE6OF02HU7H7.23.23.C01.1.454.CMB.1.raw
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
  modified_base (306)..(306): a, c, t, g, unknown or other
  misc_feature (306)..(306): n is a, c, g, or t
  modified_base (423)..(423): a, c, t, g, unknown or other
  misc_feature (423)..(423): n is a, c, g, or t
tcagacgcgagtatcacgaccggtgctcgatttagtacacgtgattagggattggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctntcctgcagggccagtcagagtgttgccgactccttggcctggtaccaacaaaacctggccagcctccagctcgtcattcatggcacatccaacngggccactggcatcccaggcaggttcagtgcagtgctctggacagacttcactctcacgatcgagcagtcgtcgaccctgacgtatttgctagtttattactgtcagctaacgtgcncctggcctatcacttcggccaaggctcgacgtggacgtacgtgaaaccgtactggtacgctgcctacctagtcttcgtcttaccg

SEQ ID NO: 48549 - DNA, 497 bp, Homo sapiens
  misc_feature: GYAE6OF02HB91U.23.23.C01.1.454.CMB.1.raw
  modified_base (201)..(201): a, c, t, g, unknown or other
  misc_feature (201)..(201): n is a, c, g, or t
  modified_base (479)..(479): a, c, t, g, unknown or other
  misc_feature (479)..(479): n is a, c, g, or t
  modified_base (492)..(492): a, c, t, g, unknown or other
  misc_feature (492)..(492): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaaacctggccagcctccaggctcgtcattcatggcacatccaacagggccactggcatcccaggcaggttcagtggcagtggctcgtgggacagacttcactctcacgatcagcagtgtcgaccctgacgtatttgctagtttattactgtcagcaagtgcgctggcctatcaccttcgccaaggcctcgactggagagtagaacgactgacggntgcaccatctgtnttccg

SEQ ID NO: 48550 - DNA, 497 bp, Homo sapiens
  misc_feature: GYAE6OF02FYL1Q.23.23.C01.1.454.CMB.1.raw
  modified_base (201)..(201): a, c, t, g, unknown or other
  misc_feature (201)..(201): n is a, c, g, or t
  modified_base (489)..(489): a, c, t, g, unknown or other
  misc_feature (489)..(489): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaaacctggccagcctccaggctcgtcattcatggcacatccaacagggccactggcatcccaggcaggttcagtggcagtggctcgtgggacagacttcactctcacgatcagcagtgtcgaccctgacgtatttgctagtttattactgtcagcaacgtggcgctggcctatcaccttcggccaagggctcgactggagagtagaacgacgtggtgctgcaccntctgtctc

SEQ ID NO: 48551 - DNA, 525 bp, Homo sapiens
  misc_feature: GYAE6OF02ISNW2.23.23.C01.1.454.CMB.1.raw
  modified_base (521)..(521): a, c, t, g, unknown or other
  misc_feature (521)..(521): n is a, c, g, or t
tcagacgcgagtatcacgaccggtgctcgatttagtacacgtgattagggattgggggaggaactgcttagtttggacccagagggaaccatggaagccccagctcagcttctcttcctcctgctcctctggctcccagagaccaccggagatattcttttgacacagtctccagacatcgtgtctgtgtctccagggggagagagccaccctctcctgcagggccagtcagagtgttgccgactccttggcctggtaccaacaaaaacctggccagcctcccaggctcgtcattcatggcacatccaacagggccactggcatcccaggcaggttcagtggcagtggctcgtgggacagacttcactctcacgatcagcagtcgtccgaccctgaccgtattttgctagtttattactgtcagcaacgtggcgcctggcctatcctaccgttcggccctaaagggcctacgactggagatacgaaacgtaactggtagctgacacctatctcgttccttntacg

SEQ ID NO: 48552 - DNA, 551 bp, Homo sapiens
  misc_feature: GYAE6OF02HICQ2.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaacctggccagcctccaggctcgtcattcatggcacatccaacagggccactggcatcccaggcaggttcagtggcagtggctcgtgggacagacttcactctcacgatcagcagtgtccgaccctgacgtatttgctagtttattactgtcagtcaacggtggacgcctgggcctatccgaccttcggacccgtaaacgggtacctccggacgtgggaacgtacgtaggaaaccggtaacgtggtacggtacgtcggacctacccgagttccgttgtcccttaccg

SEQ ID NO: 48553 - DNA, 513 bp, Homo sapiens
  misc_feature: GYAE6OF02G1IZC.23.23.C01.1.454.CMB.1.raw
tcagacgcgagtatcacgaccggtgctcgatttagtacacgtgattagggattgggggaggaactcggctcagtttggtacccagagggaaccatagggaagccccaggctcgagacgttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaacctggccagcctccaggctcgtcattcatggcacatccaacgacgggccactggcactcccagggcaggttcaggtggcagtggctctgggacagacttcactctcacgatcagcagtgtccgaccctgacgtatttgtagtttattcttgtcagcaagtgcgcgtggcctatcaccttcggctaaggctcgacgtgagatagaaacgactggtgctagcacctatcctgttcctatc

SEQ ID NO: 48554 - DNA, 495 bp, Homo sapiens
  misc_feature: GYAE6OF02HVZJ6.23.23.C01.1.454.CMB.1.raw
  modified_base (201)..(201): a, c, t, g, unknown or other
  misc_feature (201)..(201): n is a, c, g, or t
  modified_base (426)..(426): a, c, t, g, unknown or other
  misc_feature (426)..(426): n is a, c, g, or t
  modified_base (435)..(435): a, c, t, g, unknown or other
  misc_feature (435)..(435): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaacctggccagcctccaggctcgtcattcatggcacatccaacagggccactggcatcccaggcaggttcagtggcagtggctctgggacagacttcactctcacgatcagcagtgtcgaccctgacgtatttgctagtttattactgtcagcaacgtggcncctgcctanctaccttcgccaaaggctcgacgtggagagtgaaacgactgtgctgcaccatctgtcttc

SEQ ID NO: 48555 - DNA, 497 bp, Homo sapiens
  misc_feature: GYAE6OF02IEHQ3.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaaacaaaaacctggccagcctccaggctcgtcattcatggcacatccaacagggccactggcatcccaggcaggttcagtgcagtggctctgggacagacttcactctcacgatcagcagtcgtcgaccctgacgtatttgctagtttattactgtcagctaacgtgcgtctggtctatcaccgttcgaccaaggctcgactggagatggaaactactgtgctgacaccatctgtctc

SEQ ID NO: 48556 - DNA, 497 bp, Homo sapiens
  misc_feature: GYAE6OF02ISJB1.23.23.C01.1.454.CMB.1.raw
  modified_base (201)..(201): a, c, t, g, unknown or other
  misc_feature (201)..(201): n is a, c, g, or t
  modified_base (463)..(463): a, c, t, g, unknown or other
  misc_feature (463)..(463): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaaacctggccagcctccaggctcgtcattcatggcacatccaacagggccactggcatcccaggcaggttcagtggcagtggctctgggacagacttcactctcacgatcagcagtgtcgaccctgacgtatttgctagtttattactgtcagtcaacgtggcgcctggcctatcaccttcgccaaggctcgactgganagtgaaacgactgtgctgacaccatctgtcttcg

SEQ ID NO: 48557 - DNA, 515 bp, Homo sapiens
  misc_feature: GYAE6OF02HXFWM.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaaacctggccagcctcccaggctcgtcattcatggcacatccaaacacgggccactggcatcccaggcaggttcagtggcagtggctcgtgggacagcttcactctcagatcagcagtgtcgacctgacgtatttgctagtttattactgtcagctaacggtgcgtcctggtcctatcaccgttcggaccaaagggactagactggagtagtacggaaacgactggtacggctgaccaccatctgtcttcg

SEQ ID NO: 48558 - DNA, 522 bp, Homo sapiens
  misc_feature: GYAE6OF02GA20F.23.23.C01.1.454.CMB.1.raw
  modified_base (475)..(475): a, c, t, g, unknown or other
  misc_feature (475)..(475): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaacctggccagcctccaggctcgtcattcatggcacatccaacagggccactggcatcccaggcaggttcagtggcagtggctcgtgggacagacttcactctcacgatcagcagtcgtcgaccctgacgtatttgctagtttattactgtcagcaacggtggcgcctggccctatcctaccgttcggacccaagggcctcgacgtggganacgtaaggaaaccgtaacgtggtacggctaggcacctatctgtcttc

SEQ ID NO: 48559 - DNA, 558 bp, Homo sapiens
  misc_feature: GYAE6OF02HUAFJ.23.23.C01.1.454.CMB.1.raw
  modified_base (355)..(355): a, c, t, g, unknown or other
  misc_feature (355)..(355): n is a, c, g, or t
  modified_base (367)..(367): a, c, t, g, unknown or other
  misc_feature (367)..(367): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaaacaaaacctggccagcctccaggctcgtcattcatggcacatccaacagggccacgtggcatcccaggcaggttcagtgcagtggctccggganagacttcactcncacgatcagcagtgtccgaccctgacgtattttgacttagttttatacgttgtacagctaacggtggccgtccgtggccttatccgaccgttcggaccgtaaacgggtacctcggacgtgggagtacgtacggaaaaccgtcgtaggtcggacttacggacctaacctagttccgtacgttccttactacc

SEQ ID NO: 48560 - DNA, 515 bp, Homo sapiens
  misc_feature: GYAE6OF02GSCPA.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaaacctggccagcctccaggctcgtcattcatggcacatccaacagggccactggcatcccaggcaggttcagtggcagtggctcgtgggacagacttcactctcacgatcagcagtcgtcgaccctgacgtatttgctagtttattactgtcagctacgtggcgccgtggcctagtcctaccgttcggaccaagggactcgactggatagtacgaaacgactggtcgcgtcgccacctatctcgtcttcg

SEQ ID NO: 48561 - DNA, 501 bp, Homo sapiens
  misc_feature: GYAE6OF02GW828.23.23.C01.1.454.CMB.1.raw
  modified_base (470)..(470): a, c, t, g, unknown or other
  misc_feature (470)..(470): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaacctggccagcctccaggctcgtcattcatggcacatccaacagggccactggcatcccaggcaggttcagtggcagtggctctgggacaggacttcactctcacgatcagcagtgtccgaccctgaccgtatttgctagtttattactgtcagctaacgtggcgccgtggcctatccaccttcggaccaagggctcgactgganatggaaacacgtgtgctgcaccatctgtctc

SEQ ID NO: 48562 - DNA, 497 bp, Homo sapiens
  misc_feature: GYAE6OF02FPAZB.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgatccttggcctggtaccaacaaaaacctggccagcctcccaggctcgtcattcatggcacatccaacagggccactggcatcccaggcaggttcagtggcagtggctctgggacagacttcactctcacgatcagcagtgtcgaccctgacgtatttgctagtttattactgtcagcaacgtgcgctggcctatccaccttcgccaagggctcgacgtggagagtagaaacgacgtgtgctgcaccatctgtcttc

SEQ ID NO: 48563 - DNA, 520 bp, Homo sapiens
  misc_feature: GYAE6OF02I2Z5O.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaaacaaaaacctggccagccctcccaggctcgtcattcatggcacatccaacagggccacgtggcactcccaggcaggttcagtggcagtggctgtgggacagacttcactctcacgatcagcagtgtcgaccctgacgtatttgctagttttattactgtacagcaacggtggcgcctggcctatctaccgttccggaccaagggcctcgacgtggagagtaggaaaccgtatgtaggctcgacaccatcgtgtcttacg

SEQ ID NO: 48564 - DNA, 499 bp, Homo sapiens
  misc_feature: GYAE6OF02IKEWK.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaaacctggccagcctccaggctcgtcattcatggcacatccaacagggccactggcatcccaggcaggttcagtggcagtggctctgggacagacttcactctcacgatcagcagtgtcgaccctgacgtatttgctagtttattactgtcagcaacgtggcgctggcctatctaccttcggccaagggctcgacgtggagagtgaaacgtatggtaggctgcaccatctgtctc

SEQ ID NO: 48565 - DNA, 516 bp, Homo sapiens
  misc_feature: GYAE6OF02JEUN1.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaacctggccagcctccaggctcgtcattcatggcacatccaacagggccactggcatccaggcaggttcagtggcagtgctctgggacagacttcactctcacgatcagcagtgtcgaccctgacgtatttcgctagtttactcgtgtcagtcaacggtggcgctcggcctagtccaccgttcggcctaacgggcctcgactggacgagtaggaaccgtaagtgtacggctagcctaccatctagtcttacg

SEQ ID NO: 48566 - DNA, 499 bp, Homo sapiens
  misc_feature: GYAE6OF02FHU80.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaaacctggccagcctcccaggctcgtcattcatggcacatccaacagggccactggcatcccaggcaggttcagtggcagtggctctgggacagacttcactctcacgatcagcagtgtcgaccctgaccgtattttgcagtttattactgtcagcaacgtggcgcctggcctatcaccttcggccaagggctcgactggagagtgaacgaactgtggctgcaccatctgtcttc

SEQ ID NO: 48567 - DNA, 522 bp, Homo sapiens
  misc_feature: GYAE6OF02GVRS9.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaaacctggccagcctccaggctcgtcattcatggcacatccaacagggccactggcatcccaggcaggttcagtggcagtggctctgggacagacttcactctcacgatcagcagtgtccgaccctgacgtatttgctagtttattactgtcagcaacgtggcgcctggcctatctaccgttcggaccaagggacctcgacgttggaagagtacggaaaacgactggtaggcctggccaaccgatcgtcgtcttaccg

SEQ ID NO: 48568 - DNA, 545 bp, Homo sapiens
  misc_feature: GYAE6OF02I2YNS.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggagggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaacctggccagcctccaggctcgtcattcatggcacatccaacacgggccactggacactcccaggcaggttcagtcggcagtggctcgtgggacagacttcactctcacgatcagcagtcgtcgaccctgacgtatttcgactagtttattactgtcagctaacgtcggcgtaccgtcggacctatcctaccgtttcgccgtaaagggcctacgacgtggagtagtcggaaaacgtacgtggtacggcgttcgacctaccgtatccgtacgttcttacg

SEQ ID NO: 48569 - DNA, 502 bp, Homo sapiens
  misc_feature: GYAE6OF02GQUBI.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaaacctggccagcctcccaggctcgtcattcatggcacatccaacagggccactggcatcccaggcaggttcagtggcagtggctctgggacagacttcactctcacgatcagcagtgtccgaccctgaccgtattttgctagtttattactgtcagcaacgtgcgcctggcctatccacttcggcaagggctcgctggagagtgaaacgtactggtggctggcaccatctgtcttac

SEQ ID NO: 48570 - DNA, 545 bp, Homo sapiens
  misc_feature: GYAE6OF02HG8I0.23.23.C01.1.454.CMB.1.raw
  modified_base (200)..(200): a, c, t, g, unknown or other
  misc_feature (200)..(200): n is a, c, g, or t
tcagacgcgagtatcacgaccggtgctcgatttagtacacgtgattagggattggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctaggtaccaacaaaaacctggccagcctccaggctcgtcattcatcggcacatccaacagggccactggcatcccagacaggttcagtggcagtgctcgtggacagtacttcactctacacgatcagcagtgtaccacctagacgtatttgactagtttatactgtcagctaacgtggacgccgtggaccctatccctactttcggacctaaagggcctccgaccgtggaagtacgtacggaaaccgtacgtaggtcggcgttcggacctacccgtattccgtgttcccttacg

SEQ ID NO: 48571 - DNA, 641 bp, Homo sapiens
  misc_feature: GYAE6OF02JKFR9.23.23.C01.1.454.CMB.1.raw
  modified_base (201)..(201): a, c, t, g, unknown or other
  misc_feature (201)..(201): n is a, c, g, or t
  modified_base (300)..(300): a, c, t, g, unknown or other
  misc_feature (300)..(300): n is a, c, g, or t
  modified_base (362)..(362): a, c, t, g, unknown or other
  misc_feature (362)..(362): n is a, c, g, or t
  modified_base (378)..(378): a, c, t, g, unknown or other
  misc_feature (378)..(378): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactcttggcctggtaccaacaaaacctggccagcctccaggctcgtcattcatggcacntccaacacgggcctactggctactcccgaaggcaggttcagtggcagtcggctcgtgggacnggactcactctcacgntcagcagtgtccgaccctgaccgtagtttcgcttagtttacttacgtcgttacgacgtcgtaacggtcgggtacctccgttaggtacccttaagttcccgtaaccccgttttaccgggaccccgtaaaaggggtacccttaccgggtaaccgtacggggtacggtaaacgttccggaaaaaccggtaacgttcgggttaaccgggcccgtttaacggacctacccggttaacgtttaccggttacgtttaccccgtttaaccg

SEQ ID NO: 48572 - DNA, 691 bp, Homo sapiens
  misc_feature: GYAE6OF02J3J8C.23.23.C01.1.454.CMB.1.raw
tcagacgcgagtatcacgaccggtgctcgattagtacacgtgattaggattgggaggaactgctcagtttggacccagagggaaccatggaagccccagctcagcttctcttcctcctgctcctctggcctccagagaccaccggtatattattctttagacacagtctccagactatcgtgtctgtcgtcctaccgaggggacacgacgcccaccctctccgtgccgacggcctagtcaaggtcgttcgttcgccgtctccgtcggaccgtacggtaacccaaccgaaaccgtcgaccacgtccctccgaggtcctacgtactactacacgtacgacacctacgtaccgaacggccggtaccacgtcgactaccgtaccgtaggtacgtacggtacgtacggtcgacgtacggtcggtccgtcggtacggaactacgtaccttcacttccacgaacgtctacgagtaccgtacgtccgtaccgtaccttagtacgttagttacgtacttagtttactacgtcgtacgaccgacgtacggtcgtaccgtaccgtcgtacctacgaccgtaccgtacggaacctacggtacctacggtaacggtagacgtacgtaaccggaacttccggtaggccgttaccgtaccggttacctacccgttaccgttaccgtttacccgttccgttaacccg

SEQ ID NO: 48573 - DNA, 499 bp, Homo sapiens
  misc_feature: GYAE6OF02IBSMJ.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcgtctggctcccagagaccaccggagatattcttttgacacagtctccagacatcgtgtctgtgtctccaggggagagagccaccctctcctgcagggccagtcagagtgttgccgactccttggcctggtaccaacaaaaacctggccagcctcccaggctcgtcattcatggcacatccaacagggccactggcatcccaggcaggttcagtggcagtggctctgggacagacttcactctcacgatcagcagtgtcgaccctgacgatttgctagtttattactgtcagcaacgtggcgcctggcctatcaccttcggccaagggctcgactggagatggaaacgactggtagctgccaccatctgtcttc

SEQ ID NO: 48574 - DNA, 528 bp, Homo sapiens
  misc_feature: GYAE6OF02JBVTS.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaaacctggccagcctcccaggctcgtcattcatggcacatccaacagggccactggcatcccaggcaggttcagtggcagtggctcgtgggacagacttcactctcacgatcagcagtgtcgaccctgacgattttgctagtttattactgtcagcaacgtggcgcctggcctatccaccgttcggccaaacgggtactcgacgtgggatagtacggaaacgagtcggtacggcgtacgacctacctagtcgttgtccttaccg

SEQ ID NO: 48575 - DNA, 614 bp, Homo sapiens
  misc_feature: GYAE6OF02IT8VX.23.23.C01.1.454.CMB.1.raw
  modified_base (510)..(510): a, c, t, g, unknown or other
  misc_feature (510)..(510): n is a, c, g, or t
  modified_base (544)..(544): a, c, t, g, unknown or other
  misc_feature (544)..(544): n is a, c, g, or t
  modified_base (596)..(596): a, c, t, g, unknown or other
  misc_feature (596)..(596): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctccctgcgacgggccagtcagagttgttcgcccgacttccgttcggcctcggtaacccaaacaaaaacccgtggaccacgcccctaccgaggcctcgtctacttcatcgaccacactaccaaacgacgggaccacgtggaccactcccgaggctacggttcaggtcggacgtaggtcggtcttcggtacgggactacggtaccttcacctcgtaccgacgtactcgagctagtcgaccgtacccgtaggacgttatttcgacttaagtttacttactgtctagacctacggtggccncgtcgacctagtcctaccgttcgacgaacggtcncgtacgtggagtacgtaacggaaaccgtagtcggtacggctacgaccaaccncgttcctcgttcttaccg

SEQ ID NO: 48576 - DNA, 524 bp, Homo sapiens
  misc_feature: GYAE6OF02IR7X1.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccgtggcctggtaccaaacaaaaacctggccagcctccaggctcgtcattcatggcacatccaacgacgggccacgtggcactccaggcaggtcagtggcagtggctgtggacagacttcactctcacgatcagcagtcgtacgaccctgacgtatttcgacttagtttattacgtgttcagcaacggtgcgtccgtgtcctatccaccgttcggaccgaaggtcctcgacgtgggagtacgtagaaaccgactggtagctagctaccgatctcgtctac

SEQ ID NO: 48577 - DNA, 655 bp, Homo sapiens
  misc_feature: GYAE6OF02J05BG.23.23.C01.1.454.CMB.1.raw
  modified_base (203)..(203): a, c, t, g, unknown or other
  misc_feature (203)..(203): n is a, c, g, or t
  modified_base (433)..(433): a, c, t, g, unknown or other
  misc_feature (433)..(433): n is a, c, g, or t
  modified_base (485)..(485): a, c, t, g, unknown or other
  misc_feature (485)..(485): n is a, c, g, or t
tcagacgcgagtatcacgaccggtgctcgatttagtacacgtgattagggattgggggaggaacgtgctcagtttggacccagagggaaccatggaagcccagctcagcttctctcctcctgctcctctggcctccagagaccaccggacgatattcttttagactacagtctccagacatcgtgtctgtgtctccagggganagacgcccacccttcgtcctagccgagggccctaaggtccaagacgtgttgcccgactccttagggccttggtaccaacaaaaacctcggccacgcctcccgaggcctcgtccgtattcactcggcacactccaacgtcgggacctacgtcggcactccccgaggctacggtcagacggtccaagtcggccgtagtcgggacacgtacgttacacgtccgtacacgtacncgaagccaggtcgtaccggacccttaggaccgtactttcggactaacgtttnttaaccgtgtacctagaccgtaacgtcggtcgcgttccggaccttacgtccgtaccgttccggaaccgtaacgggtacctccggtaacgttcggagtaacgtacgggaaaccttagtacgggttcgaccgttaggtaccaacccggttctacggtttcgtacgtttaccc

SEQ ID NO: 48578 - DNA, 614 bp, Homo sapiens
  misc_feature: GYAE6OF02IZMB0.23.23.C01.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
tcagacgcgagtatcacgaccggtgctcgatttagtacacgtgattagggattgggggaggaactgctcagtttggacccagagggaaccatggaagccccaactcagcttctcttcctcctgctcctctggctcccagagaccaccggagatattcttttgacacagtctccagacatcgtgtctgtgtctccagggganagagccaccctntcctgcagggccagtcagagtgttgccgactccttggcctggtaccaacaaaacctggccagcctccaggctcgtccattcatggcacatccaacagggccactggcatcccaggcaggttcagtggcagtgctcgtgggacagacgttcactctcacgatcagcagtgtaccgacccgtgacgtattttcgactagtttattacgtgtactagccaacgttggaccgtccgtcggtcccttacgtccgtaccgtttccgggacctaaacggggtaccctacggtaaccgtacggggaacgtacgttaacgggaaaacccggtaaacgttgggtaccggtaccgtacggtaccgtaacccgtagtttacccggttacgtttacccgttaccgttaacccgg

SEQ ID NO: 48579 - DNA, 516 bp, Homo sapiens
  misc_feature: GYAE6OF02GF12H.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaaacctggccagcctccaggctcgtcattcatggcacatccaacagggccactggcatcccaggcaggttcagtggcagtgctctgggacagacttcactctcacgatcagcagtgtcgaccctgacgtatttgctagtttattactgtcagcaacgtggcgcctggcctatccaccgttcggcctaaacgggctacgtacgtggacgtagtaggaaaccgacgtgtggcctggccaccatcctgtcttacg

SEQ ID NO: 48580 - DNA, 501 bp, Homo sapiens
  misc_feature: GYAE6OF02HG248.23.23.C01.1.454.CMB.1.raw
  modified_base (465)..(465): a, c, t, g, unknown or other
  misc_feature (465)..(465): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaacctggccagcctcccaggctcgtcattcatggcacatccaacagggccactggcatcccaggcaggttcagtggcagtggctcgtgggacagacttcactctcacgatcagcagtgtcgaccctgacgtatttgctagtttattactgtcagcaacgtggcgcctggcctatccaccttcggccaaggctcgactgganagtaggaaacgacgtgtcggctgcaccatctgtctc

SEQ ID NO: 48581 - DNA, 537 bp, Homo sapiens
  misc_feature: GYAE6OF02IT0Q0.23.23.C01.1.454.CMB.1.raw
  modified_base (202)..(202): a, c, t, g, unknown or other
  misc_feature (202)..(202): n is a, c, g, or t
  modified_base (388)..(388): a, c, t, g, unknown or other
  misc_feature (388)..(388): n is a, c, g, or t
  modified_base (458)..(458): a, c, t, g, unknown or other
  misc_feature (458)..(458): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggganagagcccaccctctcctgcagggccagtcagagtgttgccgactccttggcctggtaccaacaaaacctggaccagcctccaggctcgtcattcatggcacatccaacacgggcccacgtcggccactcccgaggcaggttccaggtcggcaggtcggctcgtgggacagtacttcactctcacgntcagcagtgtaccgaccctgacgtatttcgactagtttattacgtgtcagtcacgtggcgcgtcgcctanccgtaccgttcgacgaaggcctcgactggatacgtacgaaacgtagtcggtagctcggcaccgattcgtacgtcttacg

SEQ ID NO: 48582 - DNA, 559 bp, Homo sapiens
  misc_feature: GYAE6OF02IIYLG.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactcttggcctggtaccaacaaaaacctggaccagcctcccaggctcgtcattcatggcacatccaacagggccacgtggcatcccaggcaggttcagtggcagtggctgtgggacagacttcactctcacgactcagcagtcgtccgaccctgacgtatttgctagtttattactgtcagtcaacgtggccgccgtgggcccttatccgtacccgttcgggacccgtaaagggtcctcggacgtgggaagtacgtacggaaaaccgtacgtaggtaggaccgtacggacctaccgtacttcgttcggtaccttaccg

SEQ ID NO: 48583 - DNA, 583 bp, Homo sapiens
  misc_feature: GYAE6OF02HILO0.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaactggccagcctccaggctcgtcattcatggcacatccaacacgggccactggcactcccaggcaggttcagtggcaggtggctcgtgggacagacttcactctacacgatcagcagtcgtcgaccctgacgtattttgacttagtttacttacgtgttacagtcaaaccgtgggccgtccgtcgggacccttacgtccgtaacccgttcggacccgtaaacgggtacctaccggacgtcgggacgtacgtacggtaaaccgtaacgttgggtacggaccgttacggaccgaacctagttccgtcggttaccttaccg

SEQ ID NO: 48584 - DNA, 570 bp, Homo sapiens
  misc_feature: GYAE6OF02IC5OF.23.23.C01.1.454.CMB.1.raw
  modified_base (201)..(201): a, c, t, g, unknown or other
  misc_feature (201)..(201): n is a, c, g, or t
  modified_base (307)..(307): a, c, t, g, unknown or other
  misc_feature (307)..(307): n is a, c, g, or t
  modified_base (406)..(406): a, c, t, g, unknown or other
  misc_feature (406)..(406): n is a, c, g, or t
  modified_base (427)..(427): a, c, t, g, unknown or other
  misc_feature (427)..(427): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgtgccgactcttggcctggtaccaacaaaaacctggaccagcctccaggctcgtcattcatgcacatccaacncggccactcggcactcccgaggcaggttccagtcggcaggtcggctcgtgggacaggtacttcgacttctcacgatcagcagtcgtccgacctgacgtntttgctagtttattacgtgtnacgctaacggtcggacgtccgttggcccttagtcccgtaccgttcgaccggtaaagggccttacggacgtaggacgtacgtacgtaaaccgtacgtcggtacggacgttcggaccgtaacctagttctacggttctttaaccg

SEQ ID NO: 48585 - DNA, 530 bp, Homo sapiens
  misc_feature: GYAE6OF02HCNW0.23.23.C01.1.454.CMB.1.raw
  modified_base (368)..(368): a, c, t, g, unknown or other
  misc_feature (368)..(368): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaacctggccagcctccaggctcgtcattcatggcacatccaacagggccactggcatcccaggcaggttcagtggcagtggctcgtgggacaggacttcactcncacgatcagcagtgtccgaccctgacgtatttgctagtttattactgtcagctaacgtggcgtccgtggcctatccgtaccgtttccggaccaaacgggtcctacggactagggatacgtaacggaaaccgacgtggcggctgacacctatctcgtcttacg

SEQ ID NO: 48586 - DNA, 544 bp, Homo sapiens
  misc_feature: GYAE6OF02FV8AL.23.23.C01.1.454.CMB.1.raw
  modified_base (201)..(201): a, c, t, g, unknown or other
  misc_feature (201)..(201): n is a, c, g, or t
  modified_base (538)..(538): a, c, t, g, unknown or other
  misc_feature (538)..(538): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaacctggccagcctcccaggctcgtcattcatggcacactaccaacacgggccacgtggacactcccaggcaggttcagtggcagtggctcgtgggacagactcactctcacgatcagcagtcgtcgaccctgtacgtatttcgactagtttacttacgtgttcagctaacggtggccgccgtggtcctatccgtaccgttccggaccgaacgggtcctcgacgtggacgtagtacgaaacgtacgtggtacggacgtcgacaccgtatccgtntcttcc

SEQ ID NO: 48587 - DNA, 538 bp, Homo sapiens
  misc_feature: GYAE6OF02GYQ96.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaacctggccagcctccaggctcgtcattcatggcacatccaacagggccactggcatcccaggcaggttcagtggcagtggctcgtgggacaggacttcactctcacgatcagcagtgtccgaccctgacgtagtttgctagtttattactgtaccagtcaaacggtgccgtccgtggccttatcctaccgttcggaccgtaacggactcgacgtggaagtagtaggaaaccgactggtacggtcgtacgccaaccgtatccttagtccttacc

SEQ ID NO: 48588 - DNA, 526 bp, Homo sapiens
  misc_feature: GYAE6OF02G2MIL.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagccaccctctcctgcagagccagtcagagtgttgccgactccttggcctggtaccaacaaaacctggaccagcctccaggctcgtcattcatggcacactcccaacgacgggccactggcatcccgaggcaggttcagtggcagtggctcgtgggacagacttcactctcacgatcagcagtcgtccgacctgacgtatttgcttagtttatactgtcagtcaacggtggccgccgtggccctatcctaccgttcggaccaagggcctcgacgtggagatagaaacgtacgtggtaggctcggaccacctattcgtagtcc

SEQ ID NO: 48589 - DNA, 562 bp, Homo sapiens
  misc_feature: GYAE6OF02JHCO5.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagccaccctctcctgcagggccagtcagacgtgttgccgactccgttggcctggtaccaacaaaaacctggccagcctccaggctcgtcattcatggcacactccaacacggccacgtcggacactcccgaggctaggttcagtggcgagtggctcgtggacagtactcactctacacgactcagcagtcgtccgacctgacgtatttcggactagtttactctgtacagtacacggtggccgtcgtcggtacctatccgtaccgttcggaccgaaggtaccctacggacctaggaacgtagtaacggtaaacgacgttggtacgtcgtacgccgtaacctagttcgtacgtcttacg

SEQ ID NO: 48590 - DNA, 513 bp, Homo sapiens
  misc_feature: GYAE6OF02HXN04.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaaacctggccagcctcccaggctcgtcattcatggcacatccaacagggccactggcatcccaggcaggttcagtggcagtggctctgggacagacttcactctcacgatcagcagtcgtcgaccctgacgtatttgctagtttattactgtcagcaacgtggcgcctggcctatccaccgttcgccgaaaggtcctcgactggagagtgaaaccgagtggtaggctcgacaccaacgttctgtcttac

SEQ ID NO: 48591 - DNA, 532 bp, Homo sapiens
  misc_feature: GYAE6OF02HDFVC.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgtgccgactccttggcctggtaccaacaaaaacctggccagcctcccaggctcgtcattcatggcacatccaacagggccactggcatcccaggcaggttcagtggcagtggctcgtggacagacttcactctcacgatcagctagtgtccgaccctgacgtatttgctagtttattactgtacagcaacgtggcgccgtggcctatcctaccgttcggccgtaaacgggcctacgactagggagtacgtaggaaaccgtacgtggtacggctgaccaccgtagttcctgtccttacg

SEQ ID NO: 48592 - DNA, 527 bp, Homo sapiens
  misc_feature: GYAE6OF02HYE15.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaaacctggccagcctcccaggctcgtcattcatggcacatccaacagggccacgtggcatcccaggccaggttcagtggcagtggctcgtgggacagacttcactctcacgatcagcagtcgtcgaccctgacgtatttcgctagtttattactgtcagcaacgtggcgcctggcctatccaccgttcggaccaagggcctcgactggagagtaaggaaaccgtacgtggtacggcttcggacaacccgattccgtgtccttc

SEQ ID NO: 48593 - DNA, 589 bp, Homo sapiens
  misc_feature: GYAE6OF02JXIC2.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaacctggccagcctccaggctcgtcattcatggcacactccaacgacgggccacgtcggcactccccaggccaggttcaggtcggcaggtggcctcgtagggacagtacttcactctacacgatcgagctagtcgtccgaccctaggaccgttatttcggactagtttattactgtacagactaacggtcggcgtccgtgggaccttacgtaccgtaccgtttcggaccgtaaacgggtacctaccggacgttggaacgtacgtaacggaaaccgtacgttacggtacggtaccgtagacctaccgtacttcgttgtaccttacg

SEQ ID NO: 48594 - DNA, 530 bp, Homo sapiens
  misc_feature: GYAE6OF02HVRM4.23.23.C01.1.454.CMB.1.raw
  modified_base (201)..(201): a, c, t, g, unknown or other
  misc_feature (201)..(201): n is a, c, g, or t
  modified_base (437)..(437): a, c, t, g, unknown or other
  misc_feature (437)..(437): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccacctctcctgcagggccagtcagagtgtgccgactcgttggcctggtaccaacaaaaactggccagcctccaggctcgcattcatggcacatccaacagggccatcggcatcccaggcaggttccagtgcagtcggctcgtgggacaggtacttcactctcacgatcagcagtgtcgaccctgacgtatttgctagtttattactgtacagcaagtggcgcctggcctanctaccttgccgaaaggcctcgacgtggacgtagtacggaaacgtacgtggtacggcctacggtaccaacccgtattacgttcggtacttaccg

SEQ ID NO: 48595 - DNA, 522 bp, Homo sapiens
  misc_feature: GYAE6OF02GUUXA.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctgtaccaacaaaaacctggccagcctcccaggctcgtcattcatggcacatccaacacgggccactggcatcccaggcaggttcagtggcagtggctcgtgggacagacttcactctcacgatcagcagtgtcgaccctgacgtatttcgctagtttacttactgtcagtcaagtggcgcctggccttatcctaccgtttccggccgaagggtacctcggactggagaagtcggaaacgtactggtacgctcgcgaccatcctgtcttac

SEQ ID NO: 48596 - DNA, 527 bp, Homo sapiens
  misc_feature: GYAE6OF02IPIA7.23.23.C01.1.454.CMB.1.raw
  modified_base (347)..(347): a, c, t, g, unknown or other
  misc_feature (347)..(347): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaccaaatttgatatcaactgggtgcgacaggcccctggaaaagggctcgagtggatgggctgggtgagtcctagtgttgagaataccgggnattctcagagttcaaggcaggctcagcctgacctggaacacttccagaagaacagcccattgaactgcgcggcctgacctctgacgacacggccgtgtattattgtgcgagaggcggaggccggcggtagttttagggaattagttagtaggttagtggacgttcgtagggcctaacggg

SEQ ID NO: 48597 - DNA, 592 bp, Homo sapiens
  misc_feature: GYAE6OF02JHRF5.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagccaccctctcctgcgagggccagtcagagtgttgccgactccgttggcctggtaccaacaaaacctggccagcctccaggcctcgtcattcagtcggcacactccaacgacgggccacgtggcactcccaggcaggttcagtcggcaggtggctcgtgggacagtacttcactctcacgatcagctagtgtaccgaccctagacgtatttcgactagttttacttacgtgtacagactaacggtggaccgccgttgggacccttagttcccgtacccgtttaccgggaccgtaaacgggtccgtacgacgtaggaacgacgttaacggaaaccgtacggttcggtacggacgtcggacctaccgtacgttccgttcgtccttaccg

SEQ ID NO: 48598 - DNA, 548 bp, Homo sapiens
  misc_feature: GYAE6OF02I20DA.23.23.C01.1.454.CMB.1.raw
  modified_base (413)..(413): a, c, t, g, unknown or other
  misc_feature (413)..(413): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcaggggcagtcagagtgttgccgactccttggcctggtaccaacaaaacctggccagcctccaggctcgtcattcatggcacatccaacgagggccacgtggcactcccgaggcaggttcagtggcagtggctcgtgggacagacttcactctacacgatcagcagtcgtcgaccctgacgtatttgctagtttnttactgtcgagctaacggtggaccgccgtcggcctagtccgtaccgttccggaccgtaacgggtacctcggacgtaggagacgttacggaaaccgtagtggtcggtaccgtggacctaccagttcgtgtccttac

SEQ ID NO: 48599 - DNA, 530 bp, Homo sapiens
  misc_feature: GYAE6OF02GO5XN.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaccaaatttgatatcaactgggtgcgacaggcccctggaaaagggctcgagtggatgggctgggtgagtcctagtgttgagaataccgggcattctcagaagttcaaggccaggctcagcctgacctggacacttccagaagaacagcccattggaactgcgcggcctgacctctgaccgacacggccgtgtattattgtgcgagaggcggaggccggcggtagtttttgggaattagttagtggttatgggtacgtcgtggggcctaacgggg

SEQ ID NO: 48600 - DNA, 502 bp, Homo sapiens
  misc_feature: GYAE6OF02GWC83.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaaacctggccagcctccaggctcgtcattcatggcacatccaacagggccactggcatcccaggcaggttcagtggcagtggctctgggacagacttcactctcacgatcagcagtgtcgaccctgacgtatttgctagtttattactgtcagcaacgtggcgcctggcctatccaccttcggccaagggacctcgactggagagtggaaacgactgtcggctgcaccatctgtcttc

SEQ ID NO: 48601 - DNA, 516 bp, Homo sapiens
  misc_feature: GYAE6OF02GJC8J.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctcaagggganagagccaccctctcctgcagggccagtcagagtgttgccgactccttggcctggtaccaacaaaacctggccagcctccaggctcgtcattcatggcacatccaacagggccactggcatcccaggcaggttcagtggcagtggctcgtgggacagacttcactctcacgatcagcagtgtcgaccctgacgtatttgctagtttattactgtcagcaacgtggcgcctggcctatccaccgttcgccgaagggctcgactgggagtagtaggaaacgtacgtggtcggctacggccaccgatcgtcgttcttac

SEQ ID NO: 48602 - DNA, 560 bp, Homo sapiens
  misc_feature: GYAE6OF02FR60K.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaacctggccagcctccaggctcgtcattcatggcacatccaacgagggccacgtcggcactcccgaggcaggttcagtggcaggtggctcgtgggacagacttcactctcacgatcagcagtcgcgaccctgacgtatttcgctagttttattactgttacagctaacggtggccgtccgtggtcccttagtcctacccgtttcgggaccgtaaacgggtcctaccggacgtcgggaagtacgtaacggaaaccgtacgtggtacggctacgctaaccgagttcctcgtcttaccg

SEQ ID NO: 48603 - DNA, 575 bp, Homo sapiens
  misc_feature: GYAE6OF02JDU0U.23.23.C01.1.454.CMB.1.raw
  modified_base (201)..(201): a, c, t, g, unknown or other
  misc_feature (201)..(201): n is a, c, g, or t
  modified_base (398)..(398): a, c, t, g, unknown or other
  misc_feature (398)..(398): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaaacctggccagcctcccaggctcgtcattcatggcacatccaacagggccactggcatcccaggcaggttcagtcggcagtcggctcgtgggacagacttcactctcacgatcagcagtgtcgacctgacgtntttcgctagtttattactgtacagtactacgtggcgtccgtggcctactccgtaccgtttccggaccgtaaacgggtacctcggaccgttcgggaacgtacggtaacggtaaaacggtaaccgttacggttacggaccgttcggaccgtacccgtacgtccgttacggtccttaccg

SEQ ID NO: 48604 - DNA, 561 bp, Homo sapiens
  misc_feature: GYAE6OF02J0BWO.23.23.C01.1.454.CMB.1.raw
  modified_base (201)..(201): a, c, t, g, unknown or other
  misc_feature (201)..(201): n is a, c, g, or t
  modified_base (544)..(544): a, c, t, g, unknown or other
  misc_feature (544)..(544): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccacctctcctgcagggccagtcagagtgtgccgactccttggcctggtaccaacaaaacctggccagcctcccaggctcgtcattcatggcacatccaacagggccactggcactcccaggcaggttcagtggcagtgctcgtgggacagacttcactctcacgatcagcagtcgtccgacctgtacgtatttgctagtttacttactgtcagtactaacgtggacgtcgtcggacctagtccgtaccgttccgggaccgtaacgggtacctccggtacgtagggaacgtacgtaacggaaaaccgtacgtaggtacggtctacggaccgtaaccgtntacgttacgtcttaccg

SEQ ID NO: 48605 - DNA, 585 bp, Homo sapiens
  misc_feature: GYAE6OF02IY0S8.23.23.C01.1.454.CMB.1.raw
  modified_base (309)..(309): a, c, t, g, unknown or other
  misc_feature (309)..(309): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaacctggccagcctccaggctcgtcattcatggcacatccaacgngggccactcggcactcccaggcaggttcagtggcaggtggctcgtgggacagtacttcactctcacgatcagcagtcgtccgacctgtaccgtatttcgcttagtttattactgtacagtactaacggtggccgtccgtgggaccctttagtcccgtaacccgtttccgggacccgtaaacggggccttaccggacgttgggaagtacgtaacggtaaaccgtacggttggtacggtacgtcggacctaaccgtacttccgttacgttccttaccg

SEQ ID NO: 48606 - DNA, 603 bp, Homo sapiens
  misc_feature: GYAE6OF02I0FVA.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactcctggcctggtaccaacaaaaacctggccagcctccaggctcgtcattcatggcacatacccaacgacgggccacgtggaccactccccgaggcctagggttccaggtcggcagtggcctcgtcgggacagtacttcactctcacgatcagcagtgtcgacctgacgtatttcgacttagtttattactcgttacacgtactaacggtcggccgtccgtcggtacctagtccgtaccgttccggacccgtaaacgggtaccttacgaaccgttcgggaaggtaacgtaacggtaaaccgtaacggttacggtacgggtacgttcggaccctaaccgtattccgttacgttccctttacg

SEQ ID NO: 48607 - DNA, 535 bp, Homo sapiens
  misc_feature: GYAE6OF02H1EHC.23.23.C01.1.454.CMB.1.raw
  modified_base (351)..(351): a, c, t, g, unknown or other
  misc_feature (351)..(351): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaaccaaatttgatatcaactgggtgcgacaggcccctaggaaaacggctcggagtggatgggactgggtgagtcctagtgttgagaataccgggnattctcagagttcaagcaggctcagctgaccgtggaacacttcagaagaacagccagttgaactgacgcggcctgacctctagaccgacacggccgtgcctattagttgtgcgagagggcggacgggccggacgttagttttgggaattagttagtggtagtgggacgttcgtggggtaaccgg

SEQ ID NO: 48608 - DNA, 546 bp, Homo sapiens
  misc_feature: GYAE6OF02IWQY2.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaacctggccagcctccaggctcgtcattcatggcacatccaacacgggccactggcactcccaggcaggttcaggtggcagtcggctcgtgggacagtacttcactctcacgatcagcagtcgtccgaccctgacgtatttcgactagtttattactgtcagtcacgtggcgccgtcggccttatccgtaccgttccgggacctaagggtcctacgacgtggaagtacgtaacggaaacgtacgtggtacggctacggaccaccgtattcgtcgttccttac

SEQ ID NO: 48609 - DNA, 523 bp, Homo sapiens
  misc_feature: GYAE6OF02FQSKG.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccacctctcctgcagggccagtcagagtgttgccgactccttggcctggtaccaacaaaaacctggccagcctccaggctcgtcattcatggcacatccaacagggccactggcatcccgaggcaggttcagtgcagtgctcgtgggacagacttcactctcacgatcagcagtgtccgaccctgacgtatttgctagtttattactgtcagtcaacggtggcgcctggcctagtcaccgttcggaccaaggactagacgtggaacgagtacgaaacgtacgtggtacggctacggctacctagtccttgtccttacg

SEQ ID NO: 48610 - DNA, 668 bp, Homo sapiens
  misc_feature: GYAE6OF02HVFVK.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccaggacgaccaccggagatattctttgacacagtcctccagacatcgtgtctgtgtctcgaggganagacgccacctctcctgcgacgggccagtcagtagtgtcgaccgtacctccgtcggcctaggtaaccaaaaccgtaaaaaccgtcggaccacgccctaccgaggtctcgtcacttcagtcggacacgtactaccgaaacggacggcctacgtcggactaccgtcccgaggcgtaggttcgaggtcggccgagtcggctcggtaggactacgtacttcgaccttcacgaacgtctacgacgcgtagtcgtacccgacccgtgtaacgtttacttgtaaccgttagtttaaccttacggtcgtacgaagtaccgtaaggttccggccgtccggttcggtacccttagtcccgttaaccggtccgggaaccgaacgggtactcgaaccgtgggaacgacgtaacggaaacgttacggtcggtacggtacgtacgcccgaaccttacgttccggttcgttaccttaaccg

SEQ ID NO: 48611 - DNA, 577 bp, Homo sapiens
  misc_feature: GYAE6OF02I3JLX.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaccaaatttgatatcaactgggtgcgacaggcccctggaaacggctcggagtggagtgggctgggtgagtcctagtgttgagaatacgggctagttctcagaagttcaaggccaaggctacgacgcctgacctacggaactacgttccagaacgaacacgccattcgaacgtgcgcggcctcgacctctacgacgacgaccggccgtgttattacgttggtcggcgtaggacgggccgggacgggccggtacggtaagtttttaggggaagttagtttaagtgggttagttggacggttcggtacggggaccgtaacgggg

SEQ ID NO: 48612 - DNA, 554 bp, Homo sapiens
  misc_feature: GYAE6OF02GSQNV.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaacctggccagcctcccaggctcgtcattcatggcacatccaacagggccactggcactcccgaggcaggttcagtggcagtggctcgtgggacaggacttcactctcacgatcagcagtcgtcgaccctgacgtatttgctagtttacttactgttacagtcaacggtgggcgtccgtggccctatcctaccgttcggaccgtaagggtacctacggacgtagggagacgtaggaaaccggtacgtggtacggtcctacgaccaaccgtatccgttacgtaccttaccg

SEQ ID NO: 48613 - DNA, 515 bp, Homo sapiens
  misc_feature: GYAE6OF02FZESZ.23.23.C01.1.454.CMB.1.raw
  modified_base (201)..(201): a, c, t, g, unknown or other
  misc_feature (201)..(201): n is a, c, g, or t
  modified_base (349)..(349): a, c, t, g, unknown or other
  misc_feature (349)..(349): n is a, c, g, or t
  modified_base (356)..(356): a, c, t, g, unknown or other
  misc_feature (356)..(356): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaaacctggccagcctcccaggctcgtcattcatggcacatccaacagggccactggcatcccaggcaggttcagtggcagtgctntgggacngactcactctcacgatcagcagtgtcgacctgacgtatttgctagtttattactgtcagctaacgtcggcgtccgtcgccttagtcctaccgttcgaccaagggcctcgacgtggagacgtagaaacgtactggtacgcgtcgcaccatcgtctcttac

SEQ ID NO: 48614 - DNA, 697 bp, Homo sapiens
  misc_feature: GYAE6OF02JP13C.23.23.C01.1.454.CMB.1.raw
  modified_base (200)..(200): a, c, t, g, unknown or other
  misc_feature (200)..(200): n is a, c, g, or t
  modified_base (203)..(203): a, c, t, g, unknown or other
  misc_feature (203)..(203): n is a, c, g, or t
tcagacgcgagtatcacgaccggtgctcgatttagtacacgtgattagggattgggggaggaactgctcagtttggacccagagggaaccatggaagcccagctcagcttctcttcctcctgctcctctggctcccagagaccaccggagatattcttttgacacagtctccagacatcgtgtctgtgtctccagggganagngccaccctctcctgcgagggccagtcagagtgttcgccgtactccgttggccttggtaccaacaaaaacctggaccagcctaccccgaggtcctccggttccacgtttcaacgtcgggacacctactaccaacgacgggccaacgtcgggacactcccgaggcgtaggtcaggtcgcgaggtgtccgtcgtgggacagtacttcactctcgacgtactacgacgctacggtcgtccgtacccgtgtaccgtatttcgacgttagttttactaacgttgtacgtacgtacgtaacggtcgggtctacccggtaggttacccgtaactcgttaaccccggttttaccggaaccggaacgggttaacccgtccgttaacggtcggggtaaacttaccgggtaacgtaaaaccggttaacgtccgggttaacgggtcggttacccggtaaccgtaacccgttacggttaacccggttttcgtaaccccggttttaacc

SEQ ID NO: 48615 - DNA, 580 bp, Homo sapiens
  misc_feature: GYAE6OF02I9CD6.23.23.C01.1.454.CMB.1.raw
  modified_base (201)..(201): a, c, t, g, unknown or other
  misc_feature (201)..(201): n is a, c, g, or t
  modified_base (307)..(307): a, c, t, g, unknown or other
  misc_feature (307)..(307): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgatccttggcctggtaccaacaaaacctggccagcctccaggctcgtcattcatggcacatccaacngggccactggcatcccaggcacggttcagtggcagtggctcgtggacagacttcactctcacgatcgagctagtcgtcgaccctgacgtatttcgactagtttattacgtgtcagtctaacggtcggcgtccgtcggtcctacgttcctacccgttcgggacccgtaaacgggtccttaccggtacgtgggaacgtacgtaacggtaaaccgtacgttcggttacgggtaccttcggacctaaccgtacgttcgttacggttaccgtttaccg

SEQ ID NO: 48616 - DNA, 556 bp, Homo sapiens
  misc_feature: GYAE6OF02H749P.23.23.C01.1.454.CMB.1.raw
  modified_base (201)..(201): a, c, t, g, unknown or other
  misc_feature (201)..(201): n is a, c, g, or t
  modified_base (378)..(378): a, c, t, g, unknown or other
  misc_feature (378)..(378): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagtccaccctctcctgcagggccagtcagagtgttgccgactctggctggtaccaacaaaactggaccagcctccaggctcgtcattcatcggcacactccaacacgggccactggcagtcccaggcaggttcagtcggcagtgctcgtggacagacttcactctcacgatcgancagtcgtacgaccctgacgtatttcgctagtttattcgtgttcagtacgtaacggtggcccgtactcgggtaccctataccgaccgtttacgaccgaaagggtacctcgaccgtggtaacgagtacggaaaccgtctacggtgccgttagaccgtacctaggtccttaggctttaccg

SEQ ID NO: 48617 - DNA, 527 bp, Homo sapiens
  misc_feature: GYAE6OF02FJCAC.23.23.C01.1.454.CMB.1.raw
tcagacgcgagtatcacgaccggtgctcgatttagtacacgtgattggggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaaacctggccagcctcccaggctcgtcattcatggcacatccaacagggccactggcatcccaggcaggttcagtggcagtggctctgggacagaccttcactctcacgatcagcagtgtcgaccctgacgtatttgctagtttattactgtcagctaacgtggcgccgtggcctatctaccttccggaccaacgggctaccggacttgggagtacgtaggaaacgtaacgtggttggctacggacaccatcctgtccttacc

SEQ ID NO: 48618 - DNA, 509 bp, Homo sapiens
  misc_feature: GYAE6OF02FP7LV.23.23.C01.1.454.CMB.1.raw
  modified_base (394)..(394): a, c, t, g, unknown or other
  misc_feature (394)..(394): n is a, c, g, or t
  modified_base (468)..(468): a, c, t, g, unknown or other
  misc_feature (468)..(468): n is a, c, g, or t
  modified_base (498)..(498): a, c, t, g, unknown or other
  misc_feature (498)..(498): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaaacctggccagcctcccaggctcgtcattcatggcacatccaacagggccactggcatcccaggcaggttcagtggcagtggctcgtgggacagacttcactctcacgatcagcagtgcgacctgactntttgctagtttattactgtcagcaacggtgccgctggcctatcaccgtttcggccaagggcctcggactggganagtagaaacgacgtggtggctgaccacctntcgttgtcttc

SEQ ID NO: 48619 - DNA, 524 bp, Homo sapiens
  misc_feature: GYAE6OF02FGI7L.23.23.C01.1.454.CMB.1.raw
  modified_base (202)..(202): a, c, t, g, unknown or other
  misc_feature (202)..(202): n is a, c, g, or t
  modified_base (352)..(352): a, c, t, g, unknown or other
  misc_feature (352)..(352): n is a, c, g, or t
  modified_base (429)..(429): a, c, t, g, unknown or other
  misc_feature (429)..(429): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggganagagccaccctctcctgcagggccagtcagagtgttgccgactccttggcctggtaccaacaaaacctggccagcctcccaggctcgtcattcatggcacatccaacagggccactggcatcccaggcaggttcagtggcagtggctcgnggacagacttcactctcacgatcagcagtgtcgaccctgacgtagtttgcagtttattactgtcagtcaacgtggcncctggcctatcaccgtttcggacctaaagggtctaccgctagggatagtacggaacgaacgtggtcggactcggaccaccgatctcggtacttcc

SEQ ID NO: 48620 - DNA, 620 bp, Homo sapiens
  misc_feature: GYAE6OF02IW1HS.23.23.C01.1.454.CMB.1.raw
tcagacgcgagtatcacgaccggtgctcgatttagtacacgtgattagggattgggggaggaactgctcagtttggacccagagggaaccatggaagccccaactcagcttctcttcctcctgctcctctggctcccagagaccaccggagatattcttttgacacagtctccagacatcgtgtctgtgtctccgagggggagagagcccaccctctcctgcagggccagtcagagtgttgccgactccttggcctggtaacccaacaaaacctggaccacgcctcccaggctcgtcattcatggcacactccaacgacgggaccacgtaggcactcccgaggcaggttcagtcggcaggtggctcgtgggacagtacttacactctacacgactacgagcgagttcgtaccgacccgtaggtacgtagttttcgactttaacggttttacttacgttacgttacacggtaccaacgggttcggaccggtccgtacggtaccttacttaccgtaccggttccggaccgtaaacgggtcctacggacgtacgggagtagtaacggaaacgtaacgttggtacggtactggacctaccgtacttacgtcgttccgtcgtacc

SEQ ID NO: 48621 - DNA, 587 bp, Homo sapiens
  misc_feature: GYAE6OF02HEBHS.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagccaccctctcctgcagggccagtcagagtgttgccgactccgttggcctggtaccaaacaaaacctggaccagcctccaggctcgtcattcatggcacactaccaacgacgggccacgtcggccactcccgaggctaggttcaggtggcaggtggctcgtgggacagtacttcactctcacgatcagcagtcgtaccgacctgacgtatttcgacttagtttattacgtgtacagctaaggtcggacgtccgtcggtacctacgtccgtaccgttccgggaccgtaaagggtcctaccggacgtagggacgtacgtaacggaaaccgtaacgtcggtacggtacgtacggaccaaccgtacttccgttacgttccttaccg

SEQ ID NO: 48622 - DNA, 537 bp, Homo sapiens
  misc_feature: GYAE6OF02HV4RB.23.23.C01.1.454.CMB.1.raw
  modified_base (475)..(475): a, c, t, g, unknown or other
  misc_feature (475)..(475): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattctttttgacacagtctccagacatcgtgtctgtgtctccaggggagagagccaccctctcctgcagggccagtcagagtgttgccgactccttggcctggtaccaacaaaaactgccagcctccaggctcgtcattcatggcacatccaacagggccactggcatccaggcaggttcagtgcagtggctcgtgggacagtaccttcactctcacgatcagcagtgtcgaccctgacgtatttcgactagtttattactgtcagtcaacgtcggacgtccgtggcctatccaccttcggccaaaggcctcgacgtggganacgtacggaaacgtaacgtggtacggcgttcggacctaaccgtagttacgtcgttcttaccg

SEQ ID NO: 48623 - DNA, 593 bp, Homo sapiens
  misc_feature: GYAE6OF02JAPC9.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactcctggcctggtaccaacaaaaacctggaccagcctccaggctcgtcattcatggacacactaccaacgaggccacgtggcactcccgaggcgtacggttcgagtcggcgaggtcggcctcgtagggacagtacttcactctcgacgatccgagcaggttcgtaccgaccctgacgttactttgaccttagttttacttacgtgtacagtaccgtaacgcgggaccgtccgtaggccttacgtcctaccccgttcggaacccgtaacggtactcggtaaccgtggaacgtacgtacggaaaacgtacgtggtacggtcttcgacctacctagtccgttacgtccttaccg

SEQ ID NO: 48624 - DNA, 528 bp, Homo sapiens
  misc_feature: GYAE6OF02G957A.23.23.C01.1.454.CMB.1.raw
  modified_base (370)..(370): a, c, t, g, unknown or other
  misc_feature (370)..(370): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgtgccgactccttggcctggtaccaacaaaacctggccagcctccaggctcgtcattcatggcacactccaacagggccacgtggcactcccgaggcaggtcagtggcaggtggctcgtgggacagacttcactcncacgatcagcagtcgtcgaccctgacgtatttgctagtttatctgtcagtcacgtggcgccgtgacctatccgaccgttcggaccgaagggtcctcgacgtggacgagtacggaaacgacgtggacggctacgacctaccgagttcctagtcttaccg

SEQ ID NO: 48625 - DNA, 550 bp, Homo sapiens
  misc_feature: GYAE6OF02I6381.23.23.C01.1.454.CMB.1.raw
  modified_base (201)..(201): a, c, t, g, unknown or other
  misc_feature (201)..(201): n is a, c, g, or t
  modified_base (535)..(535): a, c, t, g, unknown or other
  misc_feature (535)..(535): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaaacctggccagcctccaggctcgtcattcatggcacatccaacagggccactggcactcccaggcaggttcagtggcagtggctcgtgggacagtacttcactctcacgatcagcagtcgtcgaccctgacctatttgctagttttattctgtcagtcaacgtcggcgtcctggcccttatccctaccgtttcggaccgtaaacgggtcctacggtaccgtgggaacgtagtaacgaaacgtaacgttggtacggcttacgccaaccgtnttcgtgtccttaccg

SEQ ID NO: 48626 - DNA, 523 bp, Homo sapiens
  misc_feature: GYAE6OF02GWYCB.23.23.C01.1.454.CMB.1.raw
  modified_base (201)..(201): a, c, t, g, unknown or other
  misc_feature (201)..(201): n is a, c, g, or t
  modified_base (350)..(350): a, c, t, g, unknown or other
  misc_feature (350)..(350): n is a, c, g, or t
  modified_base (496)..(496): a, c, t, g, unknown or other
  misc_feature (496)..(496): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagcccaccctctcctgcagggccagtcagagtgttgccgactccttggcctggtaccaacaaaaacctggaccagcctccaggctcgtcattcatggcacatccaacagggccactggcatcccaggcaggttcagtggcagtgctntgggacagacttcactctcacgtatcagcagtcgtcgaccctgacgtatttgactagtttattactgtacagctaacgtggccgccgtggcctatccgtaccttcggccaaagggcctcgactggagtagtacgaaacgtacgtgnggctgaccgaccagtccttgtcttacg

SEQ ID NO: 48627 - DNA, 587 bp, Homo sapiens
  misc_feature: GYAE6OF02IV77C.23.23.C01.1.454.CMB.1.raw
  modified_base (430)..(430): a, c, t, g, unknown or other
  misc_feature (430)..(430): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagccaccctctcctgcagggccagtcagagtgtgccgactccttggcctggtacccaacaaaaacctggaccagccctcccaggcctcgtcattcatggcacatccaacgagggccactggcactcccaggcaggtcagtggcaggtggctcgtgggacaggacttcgactctcacgtatcagcagtcgtcgaccgtgacgtagtttcgactagtttattacgttntacgagtacgaaggtcgaccgtccgtcggaccttactccgtaccgttaccgggaccgtaaagggacctacgacgtacgggacggtacggtaaaacggtaacgttaggtcggtaccgtcggaccaaccgtaagttccgtcgttaccgttacgttaccg

SEQ ID NO: 48628 - DNA, 550 bp, Homo sapiens
  misc_feature: GYAE6OF02GZAGG.23.23.C01.1.454.CMB.1.raw
  modified_base (201)..(201): a, c, t, g, unknown or other
  misc_feature (201)..(201): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaaacctggccagcctccaggctcgtcattcatggcacatccaacagggccactggcatcccaggcaggttcagtggcagtggctctgggacagacttcactcncacgntcagcagtcgtcgaccctgacgtatttcgctagtttattacgtgttactagcgtaacgtcggacgtccgttacggcccttatcctacccgtttcggaccgtaagggacctcggacgtggacgtagtacggaaacgtacgtggtacggctacgaccgaacctagttctacgtccttacg

SEQ ID NO: 48629 - DNA, 702 bp, Homo sapiens
  misc_feature: GYAE6OF02IKYN4.23.23.C01.1.454.CMB.1.raw
  modified_base (205)..(205): a, c, t, g, unknown or other
  misc_feature (205)..(205): n is a, c, g, or t
  modified_base (281)..(281): a, c, t, g, unknown or other
  misc_feature (281)..(281): n is a, c, g, or t
  modified_base (316)..(316): a, c, t, g, unknown or other
  misc_feature (316)..(316): n is a, c, g, or t
tcagacgcgagtatcacgaccggtgctcgatttagtacacgtgattagggattgggggaggaacgtgctcagtttggacccagagggaaccatggaagccccagctcagcttctcttcctcctgctcctctggcctcccagagacccaccggagatattcttttgacacagtctccagacatcgtgtctgtgtctccgagggganagagcccaccctctcctgacagggccagtcagagtgtcgccgactcgttggcctgtaccaacaaaacctggaccancctccaggctcgtcattcatcgcacactaccaacncggccacgtcggccaacgtcccaagggtccacgggttccgtggccgtaggtcgggtccgtagggaccgtaggtacggttcctaaccttcgtaccgtacccggttccaggaccgtacggtacccgtcgggaacgtcccgtggtaacgttcggttaactttcggtcttaacgggtttttaccttcttacggtacctaggtacccgtaaggtcccgttacccgtccaacccggtcccgtcgtccttaaccgggtttccggggccgggggggtaacccgtaggggtcggtaaccgtaagtcgggaaccggtacggtaaaccgttgggtacgggtccgtacgtacccgtacggacgttaccgtttccgtcgttttacccacgtttccccgg

SEQ ID NO: 48630 - DNA, 672 bp, Homo sapiens
  misc_feature: GYAE6OF02HO6FR.23.23.C01.1.454.CMB.1.raw
  modified_base (202)..(202): a, c, t, g, unknown or other
  misc_feature (202)..(202): n is a, c, g, or t
  modified_base (276)..(276): a, c, t, g, unknown or other
  misc_feature (276)..(276): n is a, c, g, or t
  modified_base (296)..(296): a, c, t, g, unknown or other
  misc_feature (296)..(296): n is a, c, g, or t
tcagacgcgagtatcacgaccggtgctcgatttagtacacgtgattagggattgggggagggaacgtggctcagtttggacccagagggaaccatggaagcccagctcagctctcttctcctgctcctctggcctccagagaccaccggagatattctttgactacagtctcagacatcgtgtctgtgtctaccgagggganagagccaccctctcctgcagggccagtcagagtgttgccgactcgtggcctggtaccaacaaactggccagccnccaggctccgtcattcgttnatcgcctccaagtacggtccctgcgtcccagcctaggttcagttggaccagggtcggtcgtacgggtacaacgtaccgttcacgtcgtccaacgtataccgagtacaccgtccgtaggaccgccgtacggtaaagtacgtttttggttacgttttaacgttaccgttagttacaaccgggttaaccgtttaggcttaaaccgtgggttaacctacggtttttcggacccggaagggggtaccctaaagggtcctaacgggtataacgttagaaacgcggttaaaccttgggtaacggtctacgggtaaccaccgtaacgttccgtcgtttaccgtttaccaacgtttacccctttccccggacttaggttaaccgg

SEQ ID NO: 48631 - DNA, 714 bp, Homo sapiens
  misc_feature: GYAE6OF02I3902.23.23.C01.1.454.CMB.1.raw
  modified_base (277)..(277): a, c, t, g, unknown or other
  misc_feature (277)..(277): n is a, c, g, or t
  modified_base (348)..(348): a, c, t, g, unknown or other
  misc_feature (348)..(348): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagagcctgggcatcagtgaaagtcacctgcaaggcttcaggatacacttcacctaaattgatatcaactgggtnacgacacggcccctagggaaaacggctcgagtggatgggctgggtgagtctagtgttgagaagtaccgggntatctacgagtaagtttcgaaacggtccgaggctacgagtccttacgaccgtagggaacctacgttaccgaaggtaaacgtaaccaacgacccctaagttttacgggaaaccttggaccggaccgggtcctacggaccctacgtacggaccggtaaccgaaccggtccgttaggttaacgtttacgtttacggtacggtaccgggtaaacggtacggggtacccgggtaacgggtacccgggttacggtttaaaccggttttttaagggggaaacttttaaacggttaacgtttacggggttaacgttaccgggggttaaccggtttaccggggttaccggggggtaacccgtaaacccggggggg

SEQ ID NO: 48632 - DNA, 499 bp, Homo sapiens
  misc_feature: GYAE6OF02GA0BW.23.23.C01.1.454.CMB.1.raw
  modified_base (201)..(201): a, c, t, g, unknown or other
  misc_feature (201)..(201): n is a, c, g, or t
  modified_base (466)..(466): a, c, t, g, unknown or other
  misc_feature (466)..(466): n is a, c, g, or t
  modified_base (484)..(484): a, c, t, g, unknown or other
  misc_feature (484)..(484): n is a, c, g, or t
  modified_base (491)..(491): a, c, t, g, unknown or other
  misc_feature (491)..(491): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaaacctggccagcctccaggctcgtcattcatggcacatccaacagggccactggcatcccaggcaggttcagtggcagtggctcgtgggacagacttcactctcacgatcagcagtgtcgaccctgacgtatttgctagtttattactgttcagcaacgtggcgcctggcctatcaccttcggccaaggcctcgactgganagtgaaacgactggtcgntgcaccntctgtctc

SEQ ID NO: 48633 - DNA, 600 bp, Homo sapiens
  misc_feature: GYAE6OF02HA4UR.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggcctcccagagaccaccggagatattcttttgacacagtctccagacatcgtgtctgtgtctccgaggggagagagccaccctctcctgcagggccagtcagagtgttcgccgactccgttggcctacggtaaccaaacaaaaacctcggaccacgcctccaggctcgtcattcagtcgcacactaccaacgacggccactggcatcccaggctaggtcagtggcagtgctcgtgggacagacttcactctcgacgactacgagctagtcgtaccgaccctaggacgttatttcgacgttagttttactacgttgtactacgacgtaacggtggaccgtccgtacggtaccttacgtccgtacccgttcggaccgtaaaggtacctacgtacgtgggaacgtagtaacggtaaacgtacggtggtaccggtattacggacctaaccgtacgttacgtcgttacttaccg

SEQ ID NO: 48634 - DNA, 552 bp, Homo sapiens
  misc_feature: GYAE6OF02IE4TV.23.23.C01.1.454.CMB.1.raw
  modified_base (203)..(203): a, c, t, g, unknown or other
  misc_feature (203)..(203): n is a, c, g, or t
tcagacgcgagtatcacgaccggtgctcgatttagtacacgtgattagggattgggggaggaactgctcagtttggacccagagggaaccatgggaagcccccagctcagcttctcttcctcctgctcctctggctcccagagaccaccggagatattcttttgacacagtctccagacatcgtgtctgtgtctcaagggganagagccaccctctcctgcagggccagtcagagtgttgccgactccttggcctggtaccaacaaaaacctggccagcctcccaggctcgtcattctatcggcacgactccaacacgggccactggccatcccgaggcaggttcagtgcgagtggctcgtagggacaggtacttcaccttctcgaacgactcagcagtgtacgaccctggacgtatttcgctagtttattactgtcagtcacgtggacgtcctggcctagtcctaccttcgggccaaagggcctcgactagggacgtacgtaggaaaccgtaacgtggtcgacgttgacctacctatctcggttcttaccg

SEQ ID NO: 48635 - DNA, 564 bp, Homo sapiens
  misc_feature: GYAE6OF02FTGJL.23.23.C01.1.454.CMB.1.raw
  modified_base (362)..(362): a, c, t, g, unknown or other
  misc_feature (362)..(362): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaaacctggccagcctcccaggctcgtcattcatggcacatccaacacgggccacgtggcactcccgaggcaggttcaggtggcagtggctctgggacngactcactctcacgatcagcagtcgcgaccctgacgtatttgctagtttattacgtgttcagtcgaacgtcgggaccgccccgggtacctacgtcctaacccgttccgggaccgaaaggggccttcgacgtagggacgaagtacggaaaccgtaacttcggtacggtcgtacgcctaccgtagttcctcggttccttctacc

SEQ ID NO: 48636 - DNA, 547 bp, Homo sapiens
  misc_feature: GYAE6OF02HZUN2.23.23.C01.1.454.CMB.1.raw
  modified_base (451)..(451): a, c, t, g, unknown or other
  misc_feature (451)..(451): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctccagagaccaccggagatattcttttgacacagtctccagacatcgtgtctgtgtctccgaggggagagagccaccctctcctgcagggccagtcagagtgttgccgactccttggcctggtaaccaaacaaaaacctggccagccctcccaggcctcgtcattcatcggcacataccaacgacgggccacgtcggaccacgtccccgaggcgaggttcaggtcggcaggtcggctcgtggacagacttcactctcacgatcagcagtcgccgacctgacgtatttgactagtttattacgtgtcagcaacgtggcnccgtggcctactcctaccgttcggaccgaacggtctcgactggaagtacgaacgtaaacgtagtcggtaggactgacctaccatccgttgtcttac

SEQ ID NO: 48637 - DNA, 590 bp, Homo sapiens
  misc_feature: GYAE6OF02G4DPN.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagccaccctctcctgcagggccagtcagagtgttgccgactccttggcctggtaccaacaaaacctggccagcctccaggctcgtcattcatggcacactccaacgacgggaccacgtggacactcccgaggcctaggttccaggttcggcgtaggtcggcctcgtacgggacacggtacttcactctcacgtactcgagcagtcgtacgaccctggacgttatttcgacttagtttacttactgttacagtactaacggtggccgtccgtcggcctatccaccgttcggaccgtaacggtacctcggtacgtggaacgtacgtaacggaaacgtacgttcggtacggccttacggaccctacgtacgttacgttcgttccttacg

SEQ ID NO: 48638 - DNA, 857 bp, Homo sapiens
  misc_feature: GYAE6OF02JB11A.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagccgtgggcatcagtagaaagtcacctgacgaaggtccttcgagtactacctaccttccaacctaattgaactatactaacgtgggtcgacgacgaccggtaccccgtaagggaaacggtccgtacggaggtacgggaggtcgggtcggttggggtacggtacggttaccgttaggtttaggttaggaacggtaaaccgggttacccgggtacttacgtttaccgtaaccgtaagggttaaaccggtttacggaaaccgggtacccggaacggttcccgtacggtaccgtaccccggttacggaacccgtaaccgggtaaacccttaaccccgttaacccggaaacggtaaaaccgaaaccggtaacccgaacccgtttaaggttttaccggtaaaccgttacggtcccgggtacccggtacccgttacggtaaccccttcggtaaccggtaaccggtacccggaaccgggttcccgttaaggtttaacgtttaacggtttcggacggtaacgggtacgggaccggggtacgggaccgggtccgggttaccgggttttagggttttaagggtaacgtttagtttaacgggttggttaacggtacgggttaaccggttcggggtaccgggggtaaccgtaacccggggggg

SEQ ID NO: 48639 - DNA, 575 bp, Homo sapiens
  misc_feature: GYAE6OF02HM34K.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaaacaaaacctggaccagcctcccaggctcgtcattcatcggcacataccaacagggccatggccatcccaggcaggttcaggtggcagtggctcgtgggacagacttcactctcacgactcagcagtcgtccgaccctgacgtattttcgcttagtttacttacttcgtactacgtcgtaaaccggtcggcccgtccgtcgggtacccttacgtccgtacccgtttccggacccgtaaacgggtccttacggacgtaggacgtacgtaacgaaacgtacgttggcggtctcggaccaccgtagtcttcgtctacg

SEQ ID NO: 48640 - DNA, 552 bp, Homo sapiens
  misc_feature: GYAE6OF02HVQVM.23.23.C01.1.454.CMB.1.raw
  modified_base (204)..(204): a, c, t, g, unknown or other
  misc_feature (204)..(204): n is a, c, g, or t
  modified_base (447)..(447): a, c, t, g, unknown or other
  misc_feature (447)..(447): n is a, c, g, or t
  modified_base (457)..(457): a, c, t, g, unknown or other
  misc_feature (457)..(457): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccgggagattattctttttgacacagtctccagacatcgtgtctgtgtctccagggganagagccaccctctcctgcagggccagtcagagtgttgccgactccttggcctggtaccaaacaaaacctggccagcctccaggcctcgtcattcatggcacactccaagacgggccaacgtggcactcccgaggcaggttcaggtggcaggtcgctcgtgggacagacttcactcacacgatcagcagtcgtaccgaccctgaacgttatttgcttagtttattactgtcagcgaagtcggcncgtcgcctanccacgttcgacgtaacggctacgacgtaggacgtacgtaacggaaacgtacgtggtacggcttacgaccgtaacctattccgttcgttccttacg

SEQ ID NO: 48641 - DNA, 552 bp, Homo sapiens
  misc_feature: GYAE6OF02G7U2S.23.23.C01.1.454.CMB.1.raw
  modified_base (211)..(211): a, c, t, g, unknown or other
  misc_feature (211)..(211): n is a, c, g, or t
tcagacgcgagtatcacgaccggtgctcgatttagtacacgtgattagggattggggggaggaactgctcagtttggacccagagggaaccattggaagccccagctcagcttctcttcctcctgctcctctggctcccagtaggaccaccggagatagtttccttttgacacagttctccagacatcgtgtctgtgtctccgaggggganagaggccaccctctccgtgcagggccaggttccagagtcgttgccgacttccttggccttggtaccaacgaaaaaaccttggaccaaggcctcccaggtctcgtcattcatgggccacatccaacagggccaacgtggcatcccgaggcaggttcagtggcagtgctcgtgggacagacttcacttcacacgatcgacgcaagtcgtccgaccctgacgtatttagctagtttatactgtacagactaacgtgctcctaggcctactcaccttcgccaacggactcgactggagtagtcggaaacgagtcgtagtctcgacaccgtatcgtcgtcttaccg

SEQ ID NO: 48642 - DNA, 626 bp, Homo sapiens
  misc_feature: GYAE6OF02J22LA.23.23.C01.1.454.CMB.1.raw
  modified_base (201)..(201): a, c, t, g, unknown or other
  misc_feature (201)..(201): n is a, c, g, or t
  modified_base (309)..(309): a, c, t, g, unknown or other
  misc_feature (309)..(309): n is a, c, g, or t
  modified_base (417)..(417): a, c, t, g, unknown or other
  misc_feature (417)..(417): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagcccacctctcctgcagggtccagtcagagtgttgccgactccttggcctggtaccaacaaaactggccagcctccaggctcgtcattcatggcacatccaacgngggccacgtcgcactcccgaggctaacggttcacgtggcagtcggactcgtggacagtacttcgctcgtacacgactcagcacggttcgtaccgacccgtgaaccgtntttcgacgtagtttattacgtagttacgacgtacgtacgtccggcgtacccgttcgggacccttacgttcccgtacccggtttaccgggacctaacggggtaccttaccggtaacgtcgggaagtaacggtaacggtaaacggtaacccgttgggtaaccggtcgttacgaccgttaaccaggtttacccttacggtccgttttacccg

SEQ ID NO: 48643 - DNA, 596 bp, Homo sapiens
  misc_feature: GYAE6OF02GND3T.23.23.C01.1.454.CMB.1.raw
  modified_base (412)..(412): a, c, t, g, unknown or other
  misc_feature (412)..(412): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccgtggcctggtaccaacaaaacctggccagccctcccaggcctcgtcattcatggccacactccaacgagggcccacgtggcactccccgaggcaggttcaggtggcaggtggctcgtgggacagtacttcactctcgacgatcagcagtcgccgtaccctgacgtntttcgacttagtttattactgtacagacctaacggtcggccgtccgtaggcccttagtcccgtacccgtttccgggacccgtaaacgggtacctacggaacgtgggaacgtaacgtaacgggaaaacgttacgttcggtacggtactacggtacctaccgtagtttcccgtagttaccttaccg

SEQ ID NO: 48644 - DNA, 570 bp, Homo sapiens
  misc_feature: GYAE6OF02GB40W.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaacctggccagcctcccaggcctcgtcattcatggcacatccaacgagggccacgtggcactcccaggccaggttcaggtcggcaggtggctcgtgggacagacttcactctcacgatcagcagtgtccgaccctgacgtatttgacttagtttacttacgtgtacacgctaacggtggaccgtccgtggcccttagtccctaccgtttcgggaccgtaaacgggacctcgacgtggaacgtacgtaacggaaaccggtacgtcggtacggctacggaccgtacctagttccttagttccttaccg

SEQ ID NO: 48645 - DNA, 769 bp, Homo sapiens
  misc_feature: GYAE6OF02I9K5I.23.23.C01.1.454.CMB.1.raw
  modified_base (152)..(152): a, c, t, g, unknown or other
  misc_feature (152)..(152): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctcgtgcctccagacgaccgacgganattacttttcgttagacacgtacgtcctaccgaacgactacgtcgtcgtcgttggtcgtcctacgggaggggagagaccgaccctaccctcctccgtcgacggacggacctagtcaaggtgttcggtccgaccgtaccttccggtccggtaccgtacgtaaaccaaaacctaaaaccggtccggaccaccgtcccctacggacgtcctcgtactacttcagtcgaacactaccgtaaccgaacggacggaccctacggtccgactacccgtaccgacggtacggtacgtaccgtaggtcggacgtacgggtcgtacgtacgggtacgggaactacgttaccttactacgtaccttaccgacgtactacgacgtacgtaggtccgtacccgtacgtaggtaactttcgtttacgacgttttaagtttacttacgtcgtaccgtaacgacggttaacgggtcggtacccgtcggttacccgtacttacctacccgttacccggtaccggtaaccggtaaacggtccgtacggttacgacgggttaagaccggtaacggtaaaaccgttcgggtacgtcggtactcgtaacccacgttactccggttcgttacttacccg

SEQ ID NO: 48646 - DNA, 591 bp, Homo sapiens
  misc_feature: GYAE6OF02FUU7J.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagccaccctctcctgcagggccagtcagagtgttgccgactcctggcctggtaccaacaaaacctggccagcctccaggctcgtcattcatggcacataccaacacgggccactcggcactcccgaggcaggttcaggtggcagtggctcgtgggacaggacttcgactctcacgatcagcagtcgtaccgaccctggtacctattttcggaccttaagtttttacttacgttcgtactacgaccgtaacgtcgggaccgtccgtggtaccctagtccctacccgtttcggaaccgtaacgggtcctacggacgtgggacgtacgtaacggaaaaccggtaccgtggtacggacgtcggacctaaccgtatccgttagtcccttacg

SEQ ID NO: 48647 - DNA, 618 bp, Homo sapiens
  misc_feature: GYAE6OF02GMU8E.23.23.C01.1.454.CMB.1.raw
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
tcagacgcgagtatcacgaccggtgctcgatttagtacacgtgattagggattgggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaccaaatttgatatcaactgggtgcgacaggccccctggaaaagggctcggagtggatgggctgggtgagtcctagtgttgagaataccgggnattctnagaagttcaaggccaggctcgacgcctgacctaggaaccacgtttaccaagaacgaacgacgaccctagtttacggaacttcggaccgcgggccctcgtaccctccgtacgaccgaccgaccgggccgttagttaacgtttagttgtcggacggaggagggacgggacgggcccggtcggttaaggttttttacggggaatttagtttagttagggttacgttagggtaccggttcggtacgggggtaccgtaaaccggggg

SEQ ID NO: 48648 - DNA, 536 bp, Homo sapiens
  misc_feature: GYAE6OF02GMLG1.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaacctggccagcctccaggctcgtcattcatggcacatccaacagggccactggcatcccaggcaggttcaggtggcaggtggctgtgggacagacttcactctcacgatcagcaggtcgtccgaccctgacgtatttcgactagtttattactgttacagtcgaacggtgggacgccgtcggcccttatccgtaccttcggaccgtaagggactcgactgggaagagtaagaaacgtacgtgtacggctcgccaccattctagtccttacg

SEQ ID NO: 48649 - DNA, 535 bp, Homo sapiens
  misc_feature: GYAE6OF02GDQLC.23.23.C01.1.454.CMB.1.raw
  modified_base (377)..(377): a, c, t, g, unknown or other
  misc_feature (377)..(377): n is a, c, g, or t
  modified_base (480)..(480): a, c, t, g, unknown or other
  misc_feature (480)..(480): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagccaccctctcctgcagggccagtcagagtgttgccgactccttggcctggtaccaacaaaaacctggccagcctcccaggctcgtcattcatggcacatccaacacgggccactcggcatcccgaggctaggtcagtggcagtcggctcgtggacagactcactctcacgntcagcagtcgtcgacccgtgaccgtatttcgctagtttattactgtcagcgtacgtgcgtcctggtcctatcctaccgttcgaccgaacgggtcctcgtacgnggaagagtaacggaaaccgagtcggtaggactcgaccaccgtagtcttgtccttc

SEQ ID NO: 48650 - DNA, 524 bp, Homo sapiens
  misc_feature: GYAE6OF02GP4FS.23.23.C01.1.454.CMB.1.raw
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaccaaatttgatatcaactggtgcgacaggcccctggaaaagggctcgagtggatgggctgggtgagtcctagtgttgagataccgggnattcncagaagttcaaggccaggctcagcctgacctggacacttcagaagaacagccattgaactgcgcggcctgacctctgaccgacgacggccgtgtattattgtgcgagaggcggaggccgcggtatttttgggaattacgttagtggtatggtacgtcgtcggggtctaacgggg

SEQ ID NO: 48651 - DNA, 714 bp, Homo sapiens
  misc_feature: GYAE6OF02IC36D.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactcgtggcctggtaccaaacaaaacctggaccacgcctccaggctcgtcattcatcggcacactaccaacgacgggccacgtcgggacctacgtaccccgagggccgtacgggttcgaaggttcgggacctagggttcgggccttcggtacgggggaacacggtacctttaccaccgttaccttaccgaacggtactccgaacggcctaaggttcggtacccgtaacccgttggtaacgttattttacggactttaagtttttaactttaccgttgtacctaagtaccgtaaacgggttcggaccgtccgtaccgggtaccttacgtcccgttaacccgtttccgggaaccgtaaacgggtaccttaccggacgtacgggaacgtaacgtaacggtaaaaccgtacgttacgggtacggtaccgttcggaacccgtacccgttaacgtttccgttacggttacctttacccg

SEQ ID NO: 48652 - DNA, 563 bp, Homo sapiens
  misc_feature: GYAE6OF02F41SX.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaacctggccagcctcccaggctcgtcattcatggcacatccaacagggccactggcactcccaggcaggtcagtggcagtgctctgggacagacttcactctcacgatcagcagtgtcgaccctgacgtatttgctagtttattactgtcagcaacgtggcgtccgtggcctagtcctaccgtttccgggacctaaacggggtcctacggaccgttgggaacgtacgtacggaaaaccgtacgttacgggtacggacgttacggaccctaaccgtagttcccgttacggttccttaccg

SEQ ID NO: 48653 - DNA, 611 bp, Homo sapiens
  misc_feature: GYAE6OF02H7TS1.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagacccaccggagattattcttttgacacagtctccagacatcgtgtctgtgtctccagggggagagagcccaccctctcctgcagggccagtcagagtgttcgccgactctggcctggtaccaaacaaaacctggccagcctccaggctcgtcattcatggcacgactaccaacgacgggcccacgtggcaactccccgaagggtccagggttcaggtggcgtaggtggtctcgtcgggacaggtactttcaacttcgtacacgatcgagcaggtcgtccgaccctgtacgtatttcgcttagtttaactcgttgtcagtacacggtcggctccgtaggccttactccgtacccgttcggaccgaacgggtacctcggtaacgttacgggaacgtacgtacggaaaaccgtacgttacggtacggtaccgtcggaccctaaccgttacgttacctttcgttacctttaccg

SEQ ID NO: 48654 - DNA, 596 bp, Homo sapiens
  misc_feature: GYAE6OF02IPODH.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagttgttcgccgactccgtggcctggtaccaaacaaaacctggaccacgcctccgaggctcgtctattcatggcacactaccaacgacggccacgtggacactcccgaggctacggttcagtcggcagtggctcgtggactagtactcactcacacgactcagctagtcgtcgacctgactatttcgacttagtttacttacgttgtacagtactaacggtcggcgtccgttcggacctagtacccgttaccgtaccgggtaacgtaacgggtcctacgggtacgtagggaacgtagtaacggaaaacgtacggttcggtacggtaccttacggaccgtaccgtactcgtttacgttacttaccg

SEQ ID NO: 48655 - DNA, 560 bp, Homo sapiens
  misc_feature: GYAE6OF02H5O9W.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagccaccctctcctgcagggccagtcagagtgtgccgactccttggcctggtaccaaacaaaacctggaccagcctccaggctcgtcattcagtcggcacactccaacgacgggccacgtcggcacgtcccgaggcaggttcaggtcggcaggtcggctcgtggacagtactcactctcacgtactcagctagtcgtcgaccctgacgtatttcgattagtttatacgtgtcagtacgtaacgtcggcgtccgtagcctacgtccgtaccgttcggaccgtaagggcctacgacgtaggacgtagtacgaaacgtacgtggtacgcgtcgaccaccgtactcgttacgtcttaccg

SEQ ID NO: 48656 - DNA, 536 bp, Homo sapiens
  misc_feature: GYAE6OF02FWEES.23.23.C01.1.454.CMB.1.raw
  modified_base (375)..(375): a, c, t, g, unknown or other
  misc_feature (375)..(375): n is a, c, g, or t
  modified_base (464)..(464): a, c, t, g, unknown or other
  misc_feature (464)..(464): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaccaaatttgatatcaactgggtgcgacaggcccctggaaaaggctcgagtggatgggctgggtgagtcctagtgttgaggaataccgggcagttctcagaagttcaaggccaggcctnacgcctgacctggaacacttccagaagaacagcccattggaacttggcgcggcctgacctcgtcgacgacgacggccgtgtattattgngcgagaggcggaggccggcgtagttttgggaaattgttagtggttagtggacgttcgtggggcctaacgggg

SEQ ID NO: 48657 - DNA, 630 bp, Homo sapiens
  misc_feature: GYAE6OF02FF9MT.23.23.C01.1.454.CMB.1.raw
  modified_base (207)..(207): a, c, t, g, unknown or other
  misc_feature (207)..(207): n is a, c, g, or t
tcagacgcgagtatcacgaccggtgctcgatttagtacacgtgattagggattgggggaggaactgctcagttggacccagagggaaccatggaagccccagctcagcttctcttcctcctgctcctctggctcccagagaccaccgggagtatatttcttttgactactagtctccagtacatcgtgtctgtgtctccgagggganagagccctacccgttcgtcccgtggccaggggcccaggtccaggacgtggttcgccgtacttcccgttgggccttggtaccaacaaaaacctggccagccttacccaggtctcgtcattcatggcacatccaacacgggccacgtgggaccatccccaggcgaggttccagtggcaggtcggctcgtgggacagacttcactctcacgatcgagctacggtcgtaccgaccctgaccgtattttacggactagtttacttactcgttacacgtcctaacgtggacgtcctacggcctacgtccaccgtttcgaccgtaaacggctaccgacgttacggacgtagttaacggaaaccgtaaccgtggtttaccggacgttacggtaccgtaacccgtaacgttcccgttacggttcctttaccg

SEQ ID NO: 48658 - DNA, 541 bp, Homo sapiens
  misc_feature: GYAE6OF02G0C9I.23.23.C01.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (264)..(264): a, c, t, g, unknown or other
  misc_feature (264)..(264): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattgtgttgacacagtctccagccacctgtctttgtctccaggggaangccaccctntcctgcagggccagtcagagtgtagcagctacttagcctggtaccagcagaacntggccaggctcccaggctcctcatctatgatgcatccaacgagggcccacgtggccatcccgagccaggttcagtcggcaggtggtcgtgggacagtacttcgacctctacacactacagcacgcctagacgcctagacgtatttgactagtttacttactgtacagcagcgtacgactacgtcgcctacgttcggacgtacggaccgtaggtacggaaacgtcggaaacgtacgtaggtacggtacgtacgacgaccgtactcgttcgtacttacg

SEQ ID NO: 48659 - DNA, 547 bp, Homo sapiens
  misc_feature: GYAE6OF02JN7AW.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaaacctggccagcctcccaggctcgtcattcatggcacatccaacacgggccaactcggccactcccgaggccaggttcaggtggcagtggctcgtgggacagacttcactctcacgatcagcagtcgtccgacctgacgtatttgactagtttacttatgtacagctaagtcggccgccgtggcccttagtcctaccgttcggaccgtaagggaccttcggacgtggacgtatcggaaacgtacgtgtacggctacggacaccgtatcgttacgtccttacg

SEQ ID NO: 48660 - DNA, 599 bp, Homo sapiens
  misc_feature: GYAE6OF02HJZ9D.23.23.C01.1.454.CMB.1.raw
  modified_base (201)..(201): a, c, t, g, unknown or other
  misc_feature (201)..(201): n is a, c, g, or t
  modified_base (371)..(371): a, c, t, g, unknown or other
  misc_feature (371)..(371): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctcagacatcgtgtctgtgtctccgagggganagagccaccctctcctgcagggccagtcagagtgttgccgactccttggcctggtaaccaaacaaaaacgtggccagcctccaggctcgtcattcatggcacactaccaacgacggccacgtggccacgtcccaggctaggttcaggtcggcaggtggctgtcgggaacngtacttcacgtctacacgtctcgagcacggtcgtaccgacctggacgtagtttcgacttagtttattacgttgtacagtactaacggtcggaccgccgtacggccttaacttccgtacccgtttacggacccggtaaacgggaccgttaccgtacgtacgggaagtacggtaacgtaacgtaacgtggtacggtcgtagaccgaaccgtacttcgtccgttcttaccg

SEQ ID NO: 48661 - DNA, 784 bp, Homo sapiens
  misc_feature: GYAE6OF02IXVIK.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagacgccaccctctcctgcgagggccagtcagagtgttcgccgtactccgttcggccttaggtaaccaaacaaaaaccgtcggaccacgccctacccgaggcctcgtactacttcgactcggcacactaccgaacgacgggccaacgtcggaccacgtaccgacggacgtacggttaccgaggtcggacgtagggtcgggtcctacggtagggaaccgtagtaccgtttacgaccgttccgtacgtaacgtactaccgacggtaccgtaaggtaccggtacccgaacccttgggtaaccgttaacgtttttcgaccgtttaacgttttacgttacgttacgttaccgaacgtaccgtaaaccgggtcgggtacccgttaccggtacgggttaccctaagttaccccggttacccggtttacccgggtaccgggttaaaacgggtacccgttaacggtaccggtacgggtaaacgtacggttaaacgggtaaaacccggttacgggttacggtttaccgggaccgtttaaccgggaccctaaacccggttcgtttaacccggttcggtttacccttaaccggg

SEQ ID NO: 48662 - DNA, 634 bp, Homo sapiens
  misc_feature: GYAE6OF02IUIM6.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttagacccagagggaaccatggaagccccagctcagcttctcttcctcctgctcctctggctcccagagaccaccggagatattcttttgacacagtctccagacatcgtgtctgtgtctccaggggganagagcccaccctctcctgccagggccagtcagagtgttcgccgactccttggcctggaccaacaaaacctggccagccctcccaggctcgtcacttcatcggcacactcccaacgacgggcccacgtcggacactaccccgaggccgtaggttccgaaggtcggcgaggtggcgtcgtacgggacacgactttcactcgtaccacgactacgacgactagtcgtccgtaacccgtgaacggttactttacggactagttttaacgttactgttacagtaccgtaaccgtcgggccgtccgtcggtaccttacgtacccgtacccgttccgggaccgtaacggtccgtaccgtacgcgggtaacgtacgtacggtaaaccggtacgttcggtaggtccgtagacctaccgtacgttcgttaccgttcttaccg

SEQ ID NO: 48663 - DNA, 514 bp, Homo sapiens
  misc_feature: GYAE6OF02FG2PD.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaaacctggccagcctcccaggctcgtcattcatggcacatccaacagggccactggcatcccaggcaggttcagtggcagtggctctgggacagacttcactctcacgatcagcagtgtcgaccctgacgtattttgctagttttattactgtacagctaacgtggcgcctggcctatccaccgttcggccaaagggctcggacttggagagtaggaaacgaacgtgtcggctggcaccatctgtcttac

SEQ ID NO: 48664 - DNA, 627 bp, Homo sapiens
  misc_feature: GYAE6OF02IZAXJ.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagcccaccctctaaacctgcacgggccagtcagagtgttcgccgactcctggcctcggtaccaacaaaaacctggccagcctccaggctcgtcatcatggcacatccaacgacgggccacgtggcactcccaggcaggttcaggtggcaggtcggctcgtgggacagacttcactctcacgatcaacgcaagtcgtaccgaccctggtaaccgtattttcgacgttagttttaattaccttggtaccaggtaccgtaaacggtcgggaccgtccgttcgggtaccctttacgtccctacccgtttccgggaccctaaaggggtcccttaccggtaacgtcgggaagtaacgtacgggtaaaccgacggttacgtacgggtaccttcggacccgtaacgtacgtttccgttcggtacctttaccg

SEQ ID NO: 48665 - DNA, 599 bp, Homo sapiens
  misc_feature: GYAE6OF02JDSDY.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaaacctggccagcctccaggctcgtcattcatggcacatccaacgacgggccaactggccactcccaggcaggttcaggtggcagtggctcgtgggacagacttcactctcacctatcagcacgcctagggacgccgtagaaacgttatttttgggtagttttaacttacgttgtactaacggtaaccgttgacctaacgtggtaactacgttttcgggccgtaaggggacctaaaggctagggacgagtacgaacggaccggtaacgttggtacgggaccttacggacctaaccgttacgttaccgttcggttacctttaccgtactttccccg

SEQ ID NO: 48666 - DNA, 537 bp, Homo sapiens
  misc_feature: GYAE6OF02GM7S7.23.23.C01.1.454.CMB.1.raw
  modified_base (438)..(438): a, c, t, g, unknown or other
  misc_feature (438)..(438): n is a, c, g, or t
tcagacgcgagtatcacgaccggtgctcgatttagtacacgtgattagggattgggggagtcaacaaccacatctgtcctcgagaggacaccctgtgacaacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaccaaatttgatatcaactgggtgcgacaggcccctggaaaagggctcgagtggatgggctgggtgagtcctagtgttgagaataccgggcattctcagaagttcaaggccaggctcgacgcctgacctaggaactacttccagaaagaacagcccagttcgaactgcgcgcctgacctcngaccgacacggccgtgtatttagttgtgcgagacggcggacggccgtcggtagttttgggaattagttagtggtagtggacgtcgtgggcgtaacgggg

SEQ ID NO: 48667 - DNA, 657 bp, Homo sapiens
  misc_feature: GYAE6OF02H6EIG.23.23.C01.1.454.CMB.1.raw
tcagacgcgagtatcacgaccggtgctcgatttagtacacgtgattagggattgggggaggaactgctcagtttggacccagagggaacatggaagccccagctcagcttctcttcctcctgctcctctggcctcccagagaccaccggagatattcttttgacacagtctccagacatcgtgtctgtgtctccgaggggagagagccaccctctcctgcagggccagtcagagtgttgccgactctggctggtaccaacaaaactggacagcctccagctcgtcattcatcggacactactaccaacgacggaccacgtcgggacacgtacccgaggacctagggttaccaggttcggcgtaggttcggacttccggtacgggactacggtactttccaaccttccgtaccgacgtacttacacgctacggttcggtacgtacccgtaggacgttattttcgacttagttttacttacgttgttacgaagttacgaacggttcggccgtaccgttggacccttacgtcccgtacccggtttaccgaaccgtaacgggtacctccggaacgttacgggacgtaacgtaacggaaaccgtaacggtacggttacgaccgttacgaccaaccgtacgtttcgttaccgttcttaacccg

SEQ ID NO: 48668 - DNA, 594 bp, Homo sapiens
  misc_feature: GYAE6OF02JIJFM.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaccaaatttgatatcaactgggtgcgacaggcccctggaaaggctcgagtggagtgggctgggtgagtcctagtgttgagtaatacgggctattctcagaagttcaaggccaggctcagcctgacctggaactacttccaagaagaacacgacctagtttaggaactcggcgaccggcctacggtacctactcgaccgactaccggccgttacgttaacgtttagttcggtacggcggtaacggacgggccgggtacggaccgtaacggttagtttttacgggaattagtttaagttggttacgttaggacggttcggtacggggaccgtaaacgggg

SEQ ID NO: 48669 - DNA, 516 bp, Homo sapiens
  misc_feature: GYAE6OF02IZH5U.23.23.C01.1.454.CMB.1.raw
  modified_base (201)..(201): a, c, t, g, unknown or other
  misc_feature (201)..(201): n is a, c, g, or t
  modified_base (433)..(433): a, c, t, g, unknown or other
  misc_feature (433)..(433): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaacctggccagcctccaggctcgtcattcatggcacatccaacgagggccactggcactcccaggcaggttcagtggcagtggctcgtgggacagacttcactcacacgatcagcagtcgtccgaccctgacgtatttgactagtttattactgtcagctacgtcggcncctggcctatccaccgttcgactaacggctcgactggatacgtggaaacgacgtggtcggactcgctaccagttctgttctac

SEQ ID NO: 48670 - DNA, 549 bp, Homo sapiens
  misc_feature: GYAE6OF02JGB6L.23.23.C01.1.454.CMB.1.raw
  modified_base (201)..(201): a, c, t, g, unknown or other
  misc_feature (201)..(201): n is a, c, g, or t
  modified_base (350)..(350): a, c, t, g, unknown or other
  misc_feature (350)..(350): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaaacctggccagcctcccaggctcgtcattcatggcacatccaacagggccactggcatcccaggcaggttcagtggcagtggctntgggacagacttcactctcacgatcagcagtgtccgaccctgacgtattttgactagtttattacgtgtcagcaacggtcggcgtccgtggccctatccgtaccgttcggccaaacgggacctccgacgtggaacgagttacggaaaccgtaacgtggtacggcgttacggcctaaccgattcgttacgtcctttaccg

SEQ ID NO: 48671 - DNA, 685 bp, Homo sapiens
  misc_feature: GYAE6OF02F9XZ6.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagcccacctctcctgcagggccagtcagagtgttgccgactcctggcctggtaccaacaaaacctcggccagcctccaggctcgcattcatggcacactaccaacgtacgggccacgtcggacactccccgaggcgtacggttcaggttcggcgacggtgggcctcgtacggggacacgacttcactcctacacgtactcgagtacgagttacgaccgtacccgtagtaccgttattttcggaccttaaggtttttacttaacgttggttactacggtactaaccgggtcgggccggtccgtcgggtacccttacgtaccgttaacccgtttccgggaaccgtaaacgggtaccgtttaccggaaccgttcgggaacggtaacggtaaaccgggaaaaccggttaaccggttagggtaaccggtaccgtaccggtaacccgtaacccgttaccggttccgttccggttacctttaaccccgg

SEQ ID NO: 48672 - DNA, 583 bp, Homo sapiens
  misc_feature: GYAE6OF02GVJZG.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccacctctcctgcagggccagtcagagtgttgccgactccttggcctggtaccaacaaaaacctggccagcctcccaggctcgtcattcatggcacatccaacgacgggccactcggacactcccaagggcaggttcaggtggcagtcggctcgtgggacagtactcactctacgacgtatcagcagtcgtaccgaccctggacgtattttgacttagttttacttaactgttacagacctaacgtggccgtccgtgaccttagtccgtaccgttcggaccgtaaaggtccgtacgacgtaggagtaacgttacggaaaccgtaacgttggttaccggcgttacgaccctaaccgtacgttccgttacgtccttaccg

SEQ ID NO: 48673 - DNA, 608 bp, Homo sapiens
  misc_feature: GYAE6OF02I9O9A.23.23.C01.1.454.CMB.1.raw
  modified_base (203)..(203): a, c, t, g, unknown or other
  misc_feature (203)..(203): n is a, c, g, or t
  modified_base (368)..(368): a, c, t, g, unknown or other
  misc_feature (368)..(368): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagccaccctgtctttgtccccaggggaaangccaccctctcttgcagggccagtcaagacattaggaactacttagcctggtaccaacagaagcctgccaggctccgaggctgctcatctatgatgcatccagcagggcccagtggacatcccagccaggtcacgtgcaggtggctgggacagaccttcaactcncaccctatcccgcacgccctagcgacctggaactacgttcggtacgtttaacttacttgtaccaaacctaaccgtaaccaaccgtcggtccctaccggttccttacgggtaccgttacggtacccgtaacggggaccctaaaggggttacgtaaacgtaccgaaaccgtaacgtagggtaccggtcgtcgaccgtaccacgtaccgttcggtacttctacttaccgttccccgactaccg

SEQ ID NO: 48674 - DNA, 583 bp, Homo sapiens
  misc_feature: GYAE6OF02GIJK7.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagcccaccctctcctgcagggccagtcagagtgttgccgactccgttggcctggtaccaacaaaaacctggccagcctcccaggctcgtcattcatggcacatccaacagggccactggcatcccgaggcaggtcagtggcagtggctcgtgggacagacttcactctcacgactcagcagtcgtccgaccctgacgtatttgcttagttttacttactgtacacggtctaacggtcggccgtccgtcggcccttatcccgtaccgtttccgggacccgtaacgggtaccgtcgacggttacgggaacggtagtaacgggaaaaccgtacgttaggacggtccgtacggccaacccgtagtaccgttggtacctttaccg

SEQ ID NO: 48675 - DNA, 567 bp, Homo sapiens
  misc_feature: GYAE6OF02H2UZD.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaacctggccagcctccaggctcgtcattcatcggcacataccaacgacgggccacgtggcactcccaggcaggttcaggtcggcagtggctcgtggacagtactcactctcacgatcagctagtcgtcgacctgacgtatttcgacttagtttacttacgtgtacagtcaacggtcggccgtcctcgggacccttacgtccgtacccgttccggaccgaaagggtacctacgacgtcggaagtacgtaaggaaaccgtacgtggtcggtactacggacctaccgtatccgtacgttccttacg

SEQ ID NO: 48676 - DNA, 699 bp, Homo sapiens
  misc_feature: GYAE6OF02ISXXJ.23.23.C01.1.454.CMB.1.raw
  modified_base (203)..(203): a, c, t, g, unknown or other
  misc_feature (203)..(203): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggcctcccagagaccaccggagatattcttttgacacagtctccagacatcgtgtctgtgtctccgagggganagacgccaccctctcctgcgagggccagtcagagtgttgccgactccgttggcctggtaaccaactaaaaccgtcggccacgcctaccgacggctccgtcacttcatcggcacactaccaacgacgggccacgtcggccaacgtcccgaggccgtaaggttccgtaaggtcggccgtaggtcggaccttcggtacgggaactaacggtacgttaccgaccttaccgtaccgaacggtaactccgaagtccgtaacggttacgtaccggaccccttggaacgttaacgttttcgaacgttagttttaacgttacttagttaccacggtacgtaacggtcgggacgtcctcgggtacctacgtaccgtacccggttacggaccgaaacgggtaccttaccggacgttacgggacgtaacgtaacggtaaaccgtaacggttcggtacgggtaccttaccggaccgtaacccgtacgttacttacggttacctttaccg

SEQ ID NO: 48677 - DNA, 622 bp, Homo sapiens
  misc_feature: GYAE6OF02HJX3A.23.23.C01.1.454.CMB.1.raw
  modified_base (200)..(200): a, c, t, g, unknown or other
  misc_feature (200)..(200): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctcagggganagagccacctctcctgcagggccagtcagagtgttcgccgactccttggccttggtaccaaacaaaaacctggaccagcctccaggctcgtcattcatcggcacactaccaacgacgggccacgtggactacgtacccgaggacctaggttcaggtcggcgtaggtggcgtcgtgggactaggtacttcgactctacgaacgtactacgaacgtcgtaaggtcgtaccggtacccgtagtacggttaacttttcggaccttaaggttttaacttaacgttcgtacgtacgtcgtaacgtcggtccgtcgttcggccttacgtccgtaccgttccggaccgtaacgggtacctcggatacgggacgtacgtaacggaaacgtacgtggtcggtacgtcgacgtacctagtcgttacgtctacg

SEQ ID NO: 48678 - DNA, 608 bp, Homo sapiens
  misc_feature: GYAE6OF02JAUXL.23.23.C01.1.454.CMB.1.raw
  modified_base (202)..(202): a, c, t, g, unknown or other
  misc_feature (202)..(202): n is a, c, g, or t
  modified_base (404)..(404): a, c, t, g, unknown or other
  misc_feature (404)..(404): n is a, c, g, or t
  modified_base (571)..(571): a, c, t, g, unknown or other
  misc_feature (571)..(571): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagccaccctctcctgcagggccagtcagagtgtgccgactcgtggcctggtaccaacaaaacctgaccacgcctaccgaggctcgtcatcatcggacacactaccaacgacggccacgtcggcactcccgaggcacggttcacggttcgacgtaggtcggctcgtgggaacacgtacttcaactcgtacgacgctcgacnctagtcgacctaccgtgacgtagtttcgactagtttactaacgttgtacgtagcgtaacgtcgggtccacgtcggtacccttaacgtccgtaaccgttcggaacccggtaacggtaccgttcgaccgtagggacgtaacgtaacggaaacgtacgttgtaccgggtntacgtaccgtaccgtacgttcgtaccttacgttaccg

SEQ ID NO: 48679 - DNA, 508 bp, Homo sapiens
  misc_feature: GYAE6OF02GP79O.23.23.C01.1.454.CMB.1.raw
  modified_base (203)..(203): a, c, t, g, unknown or other
  misc_feature (203)..(203): n is a, c, g, or t
  modified_base (474)..(474): a, c, t, g, unknown or other
  misc_feature (474)..(474): n is a, c, g, or t
  modified_base (492)..(492): a, c, t, g, unknown or other
  misc_feature (492)..(492): n is a, c, g, or t
  modified_base (504)..(504): a, c, t, g, unknown or other
  misc_feature (504)..(504): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattctttttgacacagtctccagacatcgtgtctgtgtctccaggggganagagccaccctctcctgcagggccagtcagagtgttgccgactccttggcctggtaccaacaaaaacctggccagcctcccaggctcgtcattcatggcacatccaacagggccactggcatcccaggcaggttcagtggcagtggctctgggacagacttcactctcacgatcagcagtgtcgaccctgaccgtattttggctagttttattactgtcagcaacgtggcgcctggcctatccaccgttcggccaagggctcgacgtgganagtgaaacgactgtcggntgcacctatctntctc

SEQ ID NO: 48680 - DNA, 574 bp, Homo sapiens
  misc_feature: GYAE6OF02GDJA1.23.23.C01.1.454.CMB.1.raw
  modified_base (562)..(562): a, c, t, g, unknown or other
  misc_feature (562)..(562): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaaacaaaacctggccacgcctccgaggcctcgtcattcatggcacatccaacgacgggccacgtggcactcccgaggcaggttcaggtggcaggtggctcgtgggactagacttcactctacacgtatcagcgtagtcgtaccgaccctgacgtatttcgacttagtttattacgtgtcacgtacgtaacggtcggccgtccgtcggtacccttacgtcccgtaccgttaccgggaccgaaacgggtacctacgacgtggacgtagtacggaaacgtacgtaggtcggctacggactaccgtntcgttgtacttc

SEQ ID NO: 48681 - DNA, 614 bp, Homo sapiens
  misc_feature: GYAE6OF02F0QFJ.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggctcaggatacaccttcaccaaatttgatatcaactggtgcgacacggcccctaggaaaacgggctacggagtggagtgggctgggtgagtcctaggtgttagagaagtaccgggctattctacagtaagttcgaaggccgaggctacgacgtccgtgaccgtaggaacaccttaccgaagaaacgaacacgaccctagttacggaactcggcgccggccgtcgtacctcgtacgaccgaccgaccggtccgtagttatttacgttgtggcggtaggacgggcgggacggtccggtacggttagtttttaggggaactttagtttagttaggttacgttagggtaccggttcggttacggggacccggtaacgggg

SEQ ID NO: 48682 - DNA, 511 bp, Homo sapiens
  misc_feature: GYAE6OF02HG2BX.23.23.C01.1.454.CMB.1.raw
  modified_base (201)..(201): a, c, t, g, unknown or other
  misc_feature (201)..(201): n is a, c, g, or t
  modified_base (441)..(441): a, c, t, g, unknown or other
  misc_feature (441)..(441): n is a, c, g, or t
  modified_base (472)..(472): a, c, t, g, unknown or other
  misc_feature (472)..(472): n is a, c, g, or t
  modified_base (502)..(502): a, c, t, g, unknown or other
  misc_feature (502)..(502): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaaacctggccagcctccaggctcgtcattcatggcacactccaacgacgggccacgtggcactcccaggccaggttcagtcggcagtggctcgtgggacagacttcactctcacgatcagcagtcgtacgacccgtgacgtatttcgactagtttatactcgtcagcaagtgcgcgnggcctatccacttcggaccaaggctcgacgnggatagagaaactacgtgcggctcgcacgntctcgtctc

SEQ ID NO: 48683 - DNA, 541 bp, Homo sapiens
  misc_feature: GYAE6OF02FR2DY.23.23.C01.1.454.CMB.1.raw
  modified_base (441)..(441): a, c, t, g, unknown or other
  misc_feature (441)..(441): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaccaaatttgatatcaactgggtgcgacaggcccctagggaaaaggctcggagtggatgggctgggtgagtcctagtgttgagaagtaccggggcattctcaagtaagttcaaggccaggctcgagcctgacctggaactacttccagaacgaacacgcccattgaactgcgcgcctgacctcgngacgacacggccgtgtattattgtgcgagaggcggacggccgcggtagttttcgggaattagttagtggttacgtggtacggtcgtggggcctaacgggg

SEQ ID NO: 48684 - DNA, 503 bp, Homo sapiens
  misc_feature: GYAE6OF02FZSF8.23.23.C01.1.454.CMB.1.raw
  modified_base (366)..(366): a, c, t, g, unknown or other
  misc_feature (366)..(366): n is a, c, g, or t
  modified_base (371)..(371): a, c, t, g, unknown or other
  misc_feature (371)..(371): n is a, c, g, or t
  modified_base (465)..(465): a, c, t, g, unknown or other
  misc_feature (465)..(465): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaacctggccagcctccaggctcgtcattcatggcacatccaacagggccactggcatccccaggcaggtcagtggcagtgctctgggacagacttcacttcncacgntcagcagtcgtcgaccctgacgtatttgctagtttattactgttcagcagtcgcgcctggcctatcctccgttcgccgaaaggctcgactgganagtagaaacgactggtagctcgcaccatcgtgtcttcc

SEQ ID NO: 48685 - DNA, 539 bp, Homo sapiens
  misc_feature: GYAE6OF02IVY91.23.23.C01.1.454.CMB.1.raw
  modified_base (202)..(202): a, c, t, g, unknown or other
  misc_feature (202)..(202): n is a, c, g, or t
  modified_base (356)..(356): a, c, t, g, unknown or other
  misc_feature (356)..(356): n is a, c, g, or t
  modified_base (373)..(373): a, c, t, g, unknown or other
  misc_feature (373)..(373): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggganagagcccaccctctcctgcagggccagtcagagtgttgccgactccttggccctggtaccaacaaaaacctggccagccctccaggctcgtcattcatggcacataccaacagggccactggcactcccaggcaggttcagtggcagtgctcgngggacagacttcactcncacgactcagcagtcgccgacctgacgtatttgctagtttatactgtcagtctaacgtcggcgacctggacctgcctaccgttcggacaacggtacctcgacgtggagacgtcggaaaccgtacgttgtacgtcgtagaccgtaccagttaccgtgttccttaccg

SEQ ID NO: 48686 - DNA, 543 bp, Homo sapiens
  misc_feature: GYAE6OF02GA5E9.23.23.C01.1.454.CMB.1.raw
  modified_base (201)..(201): a, c, t, g, unknown or other
  misc_feature (201)..(201): n is a, c, g, or t
  modified_base (373)..(373): a, c, t, g, unknown or other
  misc_feature (373)..(373): n is a, c, g, or t
  modified_base (388)..(388): a, c, t, g, unknown or other
  misc_feature (388)..(388): n is a, c, g, or t
  modified_base (424)..(424): a, c, t, g, unknown or other
  misc_feature (424)..(424): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttgggcctggtaccaaacaaaaacctggaccagcctcccaggctcgtcattcatggcacatccaacagggccactggcactcccaggcaggttcagtggcaggtggctcgggacaggacttcactcncacgatcgagcagtntccgacctgacgtatttgactagtttatactgtacngacaacgtgccgccgtggaccttatccgtaacccttcgggaccaaagggtcctcggacttgggagtagtacggaaaactacgtgtcggctagacctaccagttctcggttcctataccg

SEQ ID NO: 48687 - DNA, 517 bp, Homo sapiens
  misc_feature: GYAE6OF02FR8F2.23.23.C01.1.454.CMB.1.raw
  modified_base (511)..(511): a, c, t, g, unknown or other
  misc_feature (511)..(511): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaaacctggccagcctcccaggctcgtcattcatggcacatccaacacgggccactggcatcccaggcaggttcagtggcagtggctcgtgggacagacttcactctcacgatcagcagtgccgacctgacgtatttgactagtttattcgtgtcagtcacgtggccgtctggcctagtcctaccgttcggaccaacgggctcgactggagagtagaaccgatggtacgctgaccaccgtatcgtctnttaccg

SEQ ID NO: 48688 - DNA, 605 bp, Homo sapiens
  misc_feature: GYAE6OF02GIKY0.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagccacctctcctgcagggccagtcagagtgttcgccgactccgttggcctaggtaccaaacaaaacctggaccacgcctccaggctcgtcattcagtggccacactaccaacgacgggccacgtggcactcccgaggctaggtcaggtcggcaggtcggctcgtagggacagtactcactctacacgatcgacgctaggtcgtaccgaccctggtacgtatttcgacttagtttacttacgtgtacgacgtaccgaacggtcggccgtccgtacggtacccttacgtcccgtaccgttccgggaaccgtaaacggtcctacggtacgtagggacgtacgtaacggaaacgtacgtcggtacggtacctacggaccgaccgtacttcgttcgttccttacg

SEQ ID NO: 48689 - DNA, 590 bp, Homo sapiens
  misc_feature: GYAE6OF02IHH4B.23.23.C01.1.454.CMB.1.raw
  modified_base (201)..(201): a, c, t, g, unknown or other
  misc_feature (201)..(201): n is a, c, g, or t
  modified_base (396)..(396): a, c, t, g, unknown or other
  misc_feature (396)..(396): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctcgagggganagacgccaccctctcctgcacgggccagtcagagtgttgccgactcctggcctcggtaccaaacaaaaaccgtcggaccacgcctccaggcctcgtcattcatcggacacactaccaacgcgggaccacgtcggaccactcccgaggctacggttcaggtggacaggtcggctcgtgggacagtacttcacttcncacatcagcagtcgtaccgaccgtagacgtactttcgactttagtttattaccgtgtacagtcgtaacggtcggcgtcgtacggtccttaacgtccttaccggttccggaccgaacgggtacctacggtacgtacggtaggacgtaacggaaacgtacgtggtacgctcgacctaccacgttctacgtcttacg

SEQ ID NO: 48690 - DNA, 578 bp, Homo sapiens
  misc_feature: GYAE6OF02F3X7T.23.23.C01.1.454.CMB.1.raw
  modified_base (201)..(201): a, c, t, g, unknown or other
  misc_feature (201)..(201): n is a, c, g, or t
  modified_base (415)..(415): a, c, t, g, unknown or other
  misc_feature (415)..(415): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccacctctcctgcagggccagtcagagtgttgccgactcctggcctggtaccaacaaaacctggccagcctccaggctcgtcattcatggcacactccaacgacgggccaacgtcggacactcccgaggctaggttcaggtcggacaggtcggctcgtgggacagtacttcactctacacgatcgacgcagtcgaccgtacctagacgtntttgactagttttactacgtcgtacgagtctaacggtggtcgtccgtcggtaccttacgtccgtaccgtttccgacctaaagggtcctacggacgtggagtaacgtaacggaaacgtacgtggtacggaccgtacgaccaccgtattccgtagttacttaccg

SEQ ID NO: 48691 - DNA, 611 bp, Homo sapiens
  misc_feature: GYAE6OF02HNPGA.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagccaccctctcctgcagggccagtcagagtgttgccgactcctggcctggtaccaaacaaaacctggaccagcctccgaggctcgtcattcatggcacatccaacgagggccacgtggcagtcccgaggtacggttcacggttgacgaggtcggctcggtgggacagtacttcactctacacgatcagtcagtcgaccgaccgtgacgttattttcgccttaagtttacttactgttacgaagtccgtaacggtcggaccgtcccgttgggtaccccttagtcccgtaaccggtttccggaaccgtaaacgggtaccttacggaaccgttgggacgtaacgtacggaaaaccgtacgtcggtacggcgttcgaccacgtacgttccgtaggtttccttagtacccg

SEQ ID NO: 48692 - DNA, 611 bp, Homo sapiens
  misc_feature: GYAE6OF02G1BC2.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaacctggccagcctccagctcgtcattcatggcacatccaacgagggccacgtcggcactcccgaggcaggttcagtcggcagtggctcgtggacagtacttcactctacacgatcgagctagtcgtcgacctgacgttatttcgacttagttttacttacttcggtacaggtaccgtaacggttcgggccgttaccgtcggtacccttacgttccgtaacccgtttcgggaacccgtaaacgggtaccgttccggacgttacgggtaagtaacggttaacgggaaaaccgtacggttcggtacgggcttacggacgtaccctagtttcccgtgttaccgttacccg

SEQ ID NO: 48693 - DNA, 536 bp, Homo sapiens
  misc_feature: GYAE6OF02HEPU6.23.23.C01.1.454.CMB.1.raw
  modified_base (202)..(202): a, c, t, g, unknown or other
  misc_feature (202)..(202): n is a, c, g, or t
  modified_base (309)..(309): a, c, t, g, unknown or other
  misc_feature (309)..(309): n is a, c, g, or t
  modified_base (404)..(404): a, c, t, g, unknown or other
  misc_feature (404)..(404): n is a, c, g, or t
  modified_base (427)..(427): a, c, t, g, unknown or other
  misc_feature (427)..(427): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagccaccctctcctgcagggccagtcagagtgttgccgactccttggcctggtaccaacaaaacctggccagcctccaggctcgtcattcatggcacatccaacngggccactggcactcccaggcaggttcagtgcaggtggcctgtggacagtacttcacttctacgacgatcagcaggtcgtaccgaccctgacgtntttcgcttagtttattacgtgtnagcacggtgcgtcgtggcctatccaccgttccggacgtaacgggctcgacgtgggaacaggtacggaaacctagtggtacggctcgaccaccgtatccgttgtcttacc

SEQ ID NO: 48694 - DNA, 581 bp, Homo sapiens
  misc_feature: GYAE6OF02JCUFM.23.23.C01.1.454.CMB.1.raw
  modified_base (201)..(201): a, c, t, g, unknown or other
  misc_feature (201)..(201): n is a, c, g, or t
  modified_base (407)..(407): a, c, t, g, unknown or other
  misc_feature (407)..(407): n is a, c, g, or t
  modified_base (459)..(459): a, c, t, g, unknown or other
  misc_feature (459)..(459): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccgtagatattcttttgacacagtctccagacatcgtgtctgtgtctccagggganagagccaccctctcctgcagggccagtcagagtgttgccgactccttggcctggtaccaacaaaacctggccagcctccaggctcgtcattcatggcacactaccaacgacgggccactcggacactcccgaggcacggttcagtcggactaggtggtctcgtgggacagacttcactctcacgatcagcagtgcgacctgacgtntttcgctatttacttactgtcacgctaacggtcggccgtcgttcggaccgtntaccgtacccgttacggacccgtaaacggtaccgtacgaccgtgggtaacgtacggtaacggaaaccggtacgttcggtacggtacgtacggacctaaccgtagtaccgttcgttcttaccg

SEQ ID NO: 48695 - DNA, 497 bp, Homo sapiens
  misc_feature: GYAE6OF02JGB6P.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaaacctggccagcctcccaggctcgtcattcatggcacatccaacagggccactggcatcccaggcaggttcagtggcagtggctctgggacagacttcactctcacgatcagcagtgtcgaccctgacgattttgctagtttattactgtcagcaacgtgcgcctggcctatcaccttcgcctaaggactcgactggagatgaaacaactgtaggctgcaccatctgtcttc

SEQ ID NO: 48696 - DNA, 656 bp, Homo sapiens
  misc_feature: GYAE6OF02I79Q9.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagcccaccctctcctgcagggccagtcagagtgttgccgactccgttggcctaggtaccaacaaaactggccagcctccgaggctcgtcattcatggcacatccaacgacgggaccacgtggacactcccgaggcctaggttcaggtcggactaggtggctcgtggaactacggtacttcactccgtacacgtactcacgtactagtcgtaccgaccgtgtaacgttatttcgactagttttacttaacgtgttacgagaccgtaacggtcggacctaccgtacggtacctaacgttacccgtacccggtttaccggaacccgtaaaacgggtccctaccggtaacgttacggggtaactaacggtaacgggaaaaccggttacgttacggtaccgggtaccgttacggaacccttaaccgtacgttaccggtttacgttaccctttaaccg

SEQ ID NO: 48697 - DNA, 744 bp, Homo sapiens
  misc_feature: GYAE6OF02JAVNO.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaccaatttgatatcaactgggtgacgacacggccccgtagggaaaacgggctacggaggtggagtgggctgggtgagtccgtagtggttagagaacgtaccggggctaagttcctacgaaggtaagttcgaaacgggccgaaggtccgtaccgacgtccctacggtacccgtacggaaacctacctttaccgaaacggaaacgaaacaaccggtaccccgtaagttttacgggaaaccgttcggacccggaccgggtacccgttacgaacccgttaccgttaccgaacccggaacccgacccgggtacccgttacgtttaacgtttacgttggttacggacgggtacggtacggggaccgggtaacgggtacccggtacggttaaggttttttaacggggaaagttttaacgtttaaggtttacgggttaacggttacgggttaacccggttacgggttacccgggggtaaccggtaaacccgggggg

SEQ ID NO: 48698 - DNA, 620 bp, Homo sapiens
  misc_feature: GYAE6OF02I3Y2V.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagacgccaccctctcctgcagggccagtcagagtgttgccgtactccgttggcctaggtaaccaaacaaaaaccgtcggaccacgccctccaggcctcgtcattcagtcggcactactccgaacgacgggccaacgtcggactactcccgaggcgtaggttcaggtcgctaggtcggctcgtgggactagtactcactctacgacgactcgagtactagtcgtccgaccgttgacgttagtttcgacttagtttacttacgtgttactacgccgtaacggtcggtaccgtcgtacggtacctaagtcccgtaccgttaccggaccgaacgggtactcggaacgtggacgtaacgtaacggtaaaccgtagtcggtacggtactacggtcctaaccgtagttccgttcgtaccttaccg

SEQ ID NO: 48699 - DNA, 668 bp, Homo sapiens
  misc_feature: GYAE6OF02FNRKT.23.23.C01.1.454.CMB.1.raw
  modified_base (330)..(330): a, c, t, g, unknown or other
  misc_feature (330)..(330): n is a, c, g, or t
  modified_base (403)..(403): a, c, t, g, unknown or other
  misc_feature (403)..(403): n is a, c, g, or t
tcagacgcgagtatcacgaccggtgctcgatttagtacacgtgattaggggagttgggggaggaactgctcagtttggacccagagggaaccatggaagccccagctcagcttctcttcctcctgctcctctggctcccagagaccaccggagatattcttttgacacagtctccagacatcgtgtctgtcgtcctccgaggggacaggacgcccacccgtctcctgccagggcccagtccaggtcgtgttggccgactccgttggcctggtaccaaccaaaacctggccagcctcccaggctcggtcattcagtcggcacatccaacgngggccacgtggcacgtcccaggctacggttcaggtggaccaggttcggcctcgtgggacagtacttcacttcncacgatccagtcaggtctacccgacccgtagtaccgttactttcgacttaggttttaacttacgtacgttcgacgtaccgtaaaccggtcgggcgtcccggtacggtaccctacgttacccgacccggttttcgggaaccccgtaaagggggtttccctaccgggtacgtacggggtaatacggtaaacgggtaaaaccgtaaccgggtttcggtacgggtacctcgggacccttaccgtacgtccgttcgtttacccttaccgg

SEQ ID NO: 48700 - DNA, 570 bp, Homo sapiens
  misc_feature: GYAE6OF02FLYNV.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagccaccctctcctgcagggccagtcagagtgttgccgactcctggcctggtaccaacaaaacctggaccagcctccaggctcgtcattcatcggcacactccaacgagggccacgtcggcactcccgaggctaggttccaggtggctaggtggctcgtgggacagtacttcactctcacgatcagctagtcgtccgaccctgacgttatttcgcttagtttattacgtgtcagtacgtaacgtggccgtccgtcggtaccttagtcctaccgtttccgggaccgtaaacgggtcctacggacgtggaacgtagtacggaaacgtacgtggtacggcgtacgaccgtaccgtatcgttcgtcttac

SEQ ID NO: 48701 - DNA, 543 bp, Homo sapiens
  misc_feature: GYAE6OF02HN6JC.23.23.C01.1.454.CMB.1.raw
  modified_base (372)..(372): a, c, t, g, unknown or other
  misc_feature (372)..(372): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaaacctggccagcctccaggctcgtcattcatggacacatccaacaggccactggcactcccaggcaggtcagtggcagtgctcgtggacagacttcactctcaacgntcagcagtcgtaccgacctgactatttgctagtttaattctagtcagtctaacgtggcgtccgtgtcctactctaccgtttcgaccgtaaacggacctacgacgtaggagtaacgtaggaaaccgtacgtaggtacggtctacggactacccgtatccgttagtacttccg

SEQ ID NO: 48702 - DNA, 533 bp, Homo sapiens
  misc_feature: GYAE6OF02F4684.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagccaccctctcctgcagggccagtcagagtgttgccgactccttggcctggtaccaacaaaacctggccagcctcccgaggctcgtcattcatggcacatccaacgagggccacgtcggcactcccgaggcaggttcagtggcaggtggctcgtgggacagacttcactctcacgatcagcagtcgtccgacctgacgtatttgctagtttattactgtcagcacgtggcgctggctatctaccgttcggaccaagggtctcgacgtaggacgtaagtacggaaacgtacgtggtacggcgtacgacctacctatccgtgttcttacg

SEQ ID NO: 48703 - DNA, 788 bp, Homo sapiens
  misc_feature: GYAE6OF02GHZJ9.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagacgccaccctctcctgcgagggccagtcagacgtgttcgccgactccgttggcctggtaccaaacaaaacctggccacgcctaccgacggctacgtcacgttcacgtggaccactactacccaacgacgggaccctacgtcggaccactacccgaggtcgtacggttcgaggtcggacgtagggttcggaccgttcggtagggaaccgtaacggtaccttaccgtaccgttaccgttaccgaaccggaacttaccgaacggtaccgtaacggttccggttacccggtaccccggttaggaaccggtttaagtttttaccggcgtttaacggtttttaactaccgttacgttacgtaacgtacccgttaaccgggtcgggtcccgtaccggttacgggttaccctttaaccgttcccggttacccgggtttacccgggaacccgttaaacggggttacccttaacggggtaacccgtaggggaaccttaacgggtaaacgggtaaaacccgttaaccgggttcggtaacccgggtaccgttacgggtaccctaacccgttagttcccgtttacgttccgtttaacc

SEQ ID NO: 48704 - DNA, 693 bp, Homo sapiens
  misc_feature: GYAE6OF02G4PI1.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccacctctcctgcagggccagtcagagtgttcgccgactcctggcctggtaccaacaaaaacctggccagcctccaggcctcgtcattcatggcacatccaactcgggaccactgggctactcccgaggactaggttccaggttcggactaaggtcgggccttcgtaggggacaggtaccttcgaccttcgtaccgaacgtactccgaacgtaccgtaggttcgtaccggtaccctaggtaccgtacgttttacgccgtttaaggttttaacttacgttacggttacctacggtaccgtaaccgggttcggcccggtaccgttcgggtaccctttaacgtcccgttaaccgtttccgggaacccgtaagggttaaccctcggtaccgttacgggacggtaacgttaacggaaaccggttaccggttaggtaccggtaccggttacggaaccgtaccgtacgtttccgttacgttacccgtttaacccg

SEQ ID NO: 48705 - DNA, 595 bp, Homo sapiens
  misc_feature: GYAE6OF02I3IBS.23.23.C01.1.454.CMB.1.raw
  modified_base (203)..(203): a, c, t, g, unknown or other
  misc_feature (203)..(203): n is a, c, g, or t
  modified_base (386)..(386): a, c, t, g, unknown or other
  misc_feature (386)..(386): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggganagagcccaccctctcctgcagggccagtcagagtgtgccgactccttggcctggtaccaacaaaacctggccagcctaccaggctcgtcattcatcggcacatccaacgacgggccactggcactcccgaggcaggttcaggtcggcaggtgcttcgagggacagtacttcactctacacgtntacgagcagtcgtccgaccctgacgttatttgacttagtttatacgttgtactagacgtaacggttgggaccgtccgttacggtacccttacgtaccgtacccggtttcggacccgtaacgggtccgtacgaccgttagggacgtagtacgggaaaccgtacgttggtacggcctaggacccaccgttagtccttcggttaccttaccg

SEQ ID NO: 48706 - DNA, 716 bp, Homo sapiens
  misc_feature: GYAE6OF02JEL5Z.23.23.C01.1.454.CMB.1.raw
  modified_base (205)..(205): a, c, t, g, unknown or other
  misc_feature (205)..(205): n is a, c, g, or t
  modified_base (239)..(239): a, c, t, g, unknown or other
  misc_feature (239)..(239): n is a, c, g, or t
  modified_base (242)..(242): a, c, t, g, unknown or other
  misc_feature (242)..(242): n is a, c, g, or t
tcagacgcgagtatcacgaccggtgctcgatttagtacacgtgattagggagttgggggagggaacgtgctcagtttggacccagagggaaccatggaagcccagctcagcttctcttcctcctgctcctctcggctcccagagaccaccggagatattcttttgacacagtctccagacatcgtgtctgtgtctccgagggganaggacgcccaccctctcctgcagggccagtcagngtntgccgactccttggcctggtaccaacaaaacctggccacgcctccagctacgtcacttcagtggcactactaccaacgacgggacccacgttcggaccgactccccgaaggtccgtaacggttcgacggtggacctacgggttcggctccggttcggggaacgacgtaacgtttccaaccgttcctacgaaccggtataccggaacgacgtaacggttcggtaccgaccccgttaggaccgttagttttacggacgttaaggtttacttacgtcgttacctacggtcctaaacgggttcggtaccggtacccgttcggtaacccttacgttacccacccggttttaccgggaccccgtaaaaggggtccctacggtaaccgtaggggacgtacgtaaccgggtaaaaccgtaacgttcggtacggtaccgtacggtaaccctaaccgtagttcccggttagttacccgttaccg

SEQ ID NO: 48707 - DNA, 610 bp, Homo sapiens
  misc_feature: GYAE6OF02F3R97.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactcctggcctggtaccaacaaaaacctggccagcctccaggctcgtcattcatggcacatccaacacgggccacgtggcactcccgaggcaggttcagtggcaggtggctgtgggacaggtacttcacttctacacgatcagcaggtcgtaccgaccctggtacgtagtttcgacgttagttttaacttacgttcgttacgacgtactaaccggttcggccgtacccgttcggcccttaagtcccgtacccgttacgggacccgtaaacgggtccgtacggaccgttagggacgaacgttaacggaaaaccgtaacgttggtacggtcgtacgacccgtaaccgtagttccgtaccggttacttaccg

SEQ ID NO: 48708 - DNA, 709 bp, Homo sapiens
  misc_feature: GYAE6OF02JU60T.23.23.C01.1.454.CMB.1.raw
  modified_base (205)..(205): a, c, t, g, unknown or other
  misc_feature (205)..(205): n is a, c, g, or t
tcagacgcgagtatcacgaccggtgctcgatttagtacacgtgattagggattgggggagggaacgtgctcagtttggacccagagggaaccatggaagccccagctcagcttctcttcctcctgctcctctggctcccagagaccaccggagatattcttttgacacagtctccagacatcgtgtctgtgtcctccgagggganagacgcccacccttctcctgccagggcccagtcagagtgttcgcccgacttccgttggcccgttggtaccaaaccaaaaacctcggaccacgcctcccgaggtcctccggtcacgttcatcggaccacactaccaacgtacggccacgtcggcgactcccgaggtccgacggttacagtcggctaggttcgccgtcggtacggaccgagtaaccgttccaccgttccttaccgaccggtactacgaacggctaacgtttcggtaccgtaccccgtgtaccggttaatttcgaccgttaattttaccgttaacgtcgtactaccggtacgtaacggtccggtacgtccgttaccggaccgtttacgtccgtacccgttttaccgggacccgtaaacgggtaccttccggtaaccgttcgggaacgttacgtaacggtaaaccgtaaccggtgggttaccgacggttacgtaccgtaccgtaacgtaccggttcgtacctttaccg

SEQ ID NO: 48709 - DNA, 580 bp, Homo sapiens
  misc_feature: GYAE6OF02G5K4X.23.23.C01.1.454.CMB.1.raw
  modified_base (201)..(201): a, c, t, g, unknown or other
  misc_feature (201)..(201): n is a, c, g, or t
  modified_base (404)..(404): a, c, t, g, unknown or other
  misc_feature (404)..(404): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccgttggcctggtaccaacaaaaacctggccagcctccaggctcgtcattcatggcacatccaacagggccacgtggcactcccgaggcaggttcagtggcaggtggctcgtgggacagcttcactctacacgatcagcgagtcgtccgaccctgacgtntttgctaggtttattactcgttacacgtacgtaacgtcggcgtcccgtaggccctagttccgtacccgttccgggacctaaacggggtactaccggtacgtagggaacgtacggttaacggaaaccggtaacgtggtacgtcgtacgccgtacctaaggttccctgtaccttaccg

SEQ ID NO: 48710 - DNA, 555 bp, Homo sapiens
  misc_feature: GYAE6OF02FJT5T.23.23.C01.1.454.CMB.1.raw
  modified_base (349)..(349): a, c, t, g, unknown or other
  misc_feature (349)..(349): n is a, c, g, or t
  modified_base (354)..(354): a, c, t, g, unknown or other
  misc_feature (354)..(354): n is a, c, g, or t
tcagacgcgagtatcacgaccggtgctcgatttagtacacgtgattagggattgggggagtcaacaaccacatctgtcctcgagaggacaccctgtgaccacagctcctcaccatggactggacctggacgatcctcttcttggtggcagcagccagaagtgcccactcccacgaggaattccggtgcagtctgggcctgaggtgaagaagcctggggcatcagtgaaagtcacctgcaaggcttcaggatacaccttcaccaaatttgatatcaactgggtgcgacaggcccctaggaaaagggctcgagtggagtgggctgggtgagtctagtgtgagataccgggnatctnagaagttcaaggccaggctcagcctgacctaggaactacttccaagaacgaacacgccctaagttcggaactgcgccggcctgaccctcgtgaccgacgaccggccgttagtattagttgtgcgaggacggcgggaggccggtgtagttttgggaattagttagttggtagtacggtacgtcggtggggaccgtaacgggg

SEQ ID NO: 48711 - DNA, 732 bp, Homo sapiens
  misc_feature: GYAE6OF02FFGPS.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggagttgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagcccaccctctcctgccgagggccagtcagagtggttcgccgtactccgttggcctggtaacccaacaaaaacctggaccaggcctacccgaggtctcgtcacttcagtggactacactaccaacgcgggcctacgtcggaccacgtccccagggtacctacgggttacaggtcggaccgagggtcggtaccgttcggtaggggaacacggtacctttaccgaaccttcgtacgaaccgtaactaccgaacgtccgtaaggtttccgaccccggtaacccgttacggtaaccgtttacgttttacggaccttaagggtttttaaccttacgtacggttaccaaccgggtaacgttaaacccgggttcgggaacccgtccggttacgggttaccctaacgttcccgtaacccgttttaccgggaccgtaaacgggtccttacggacgttacgggaataggttaaccggaaacgtacggttacggacgggactaccggtacaaccttagtccgttacgtaccgtttacc

SEQ ID NO: 48712 - DNA, 774 bp, Homo sapiens
  misc_feature: GYAE6OF02H1ECP.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctctttcctcctgctcctctggctcccagagaccaccggagatattcttttgacacagtctccagacatcgtgtctgtgtctccagggganagagccaccctctcctgcagggccagtcagagtgttgccgactccgttggcctggtaccaaacaaaacctggccagcctccaggctcgtcattcatcggcactataccaacacgggccacgtcggccacgtccccgagggcctacgggttcgaggtcggcgaggtcggtcgtcgtagggacaggtaccttcaacttcctcgaacgattcgaagtcgaacggttcgtaccgacccgtggaaccgttacgttttcggacctttaaggtttttacgtttaccgttacggttacgtaacggtaccgtaaaccgggtcgggttcccggtaccccgttacgggtaccccgttttaaacgttccccgttaaccccgggttttacccgggacccggttaaaacgggggtccccgtttaccggggtaaaccgttacggggtaaacgttaacgggtttaaaaccgggtaaaaccccgggttaaacgggtttaacgggttaccggggttaacccgttaccggggtacccctaaaccccggtttacgtttacccggttttacggtttaccccgttttaaccccg

SEQ ID NO: 48713 - DNA, 571 bp, Homo sapiens
  misc_feature: GYAE6OF02GWHJI.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaaacaaaacctggccagcctccaggctcgtcattcatggcacatccaacgacgggccactggcactcccgaggcaggttcagtgcgagtggctcgtgggacagtactcactctcacgatcagcgagtcgtccgaccgtagacgttatttcgacgttagttttacttacgttgtacagtacgtacggtggccgtccgtcgggtaccttacgtcctaccgttccgggaccgtaagggtaccgtacgacgtggaacgtagtacgaaacgtacggtggtacggactacggacctaccgacgttctcggttactccg

SEQ ID NO: 48714 - DNA, 730 bp, Homo sapiens
  misc_feature: GYAE6OF02J1ZNW.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggaccagagggaaccatggaagccccagctcagcttctcttcctcctgctcctctggctcccagagaccaccggagatattcttttgacacagtctccagacatcgtgtctgtgtctccgagggganagacgccacccgtctcctgacgagggccagtcagagtcgttcgccgtacttccgttggacctggttaaccaaaaccgtaaaaaccgtcgggaccaacgtccccgttaccccgacgggtccttccggtacaacgtttacacgttcggaccaacctactaccaaacggacgggacctacgtacgggcctacgtacccgacgggtacacgggttcacggtcggactacggtggccgtttcggtagggtaaccgagtaccgtttaccgtacttccgtaccgtaacgtacgtaccgtacggtcgtaaggttccggtaccgacccgttggaacgtttacgtttacgacgtttagtttaacttcgttacgttacgtacgtacgtaacgtcgggtcctaccggttcgtaccttacgtaccgttaccgttaccggacgtaacgggtacctcgggtacctaggaacgtacgtaaacggtaaccggtacgtcggtaacgccggtacgaccgtacgttacgtccgttcgttacccgttacg

SEQ ID NO: 48715 - DNA, 599 bp, Homo sapiens
  misc_feature: GYAE6OF02F4EEY.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaacctggccagcctcccaggctcgtcattcatggcacatccaacagggccacgtggccatcccgaggcaggttcagtcggcagtggctgtggacagtacttcactctcacgatcgagctagtgtaccgtacctgtaacgtacttttgaccttagttttaactttacttggttacagtacctaacggttggccgccgttagggacccttacgtccgtaccgtttccgggacccgtaaacggggtcctaccggacgtcgggaagtaacgtaacggaaaaccggtaacgtggttacggccgttacggccgaaccgtatttcccgttagttccttaccg

SEQ ID NO: 48716 - DNA, 797 bp, Homo sapiens
  misc_feature: GYAE6OF02JYFXT.23.23.C01.1.454.CMB.1.raw
  modified_base (733)..(733): a, c, t, g, unknown or other
  misc_feature (733)..(733): n is a, c, g, or t
tcagacgcgagtatcacgaccggtgctcgatttagtacacgtgattagggagttgggggaggaacgtgctcagtttggacccagagggaaccatggaagccccagctcagcttctcttcctcctgctcctctggctcccagagaccaccggagatattcttttgacacagtctccagacatcgtgtctgtgtctaccgaggggacgagacggcccacccttctcccgtgccgacggggcctacggtcaggaggttcgttcggacccggtccttccggttggtcccgttaggggtaacccaaaacctaaaaacccgtcgggacccacggtccctacccccgagggtcctccgtacacgttcagtcgggaccaacacttaccgaaccgagggtccccaacgttcggcgtacaccccggaggaccgtaacgggtcgtaggtcggaccgaggtcggtccgttcggtacggggactacgtaccttaccgacccttacgtcgtaacggtacgtaccacggtcgaacgtttcgggtacccaccgttacgtacggttacttttacggaccgtttaacgttttactacgttttcgacgttacgtacggttacccggtcgggcccgttaccgggttccggtaccctttagttaccccgttacccgtttccggggaaacccggtaacggtaccgttacctaccggggttaaggacctttacgggaaacgtaaaacccggggttntaacgggttccgttaccgaacggttaccgaaccgttacggtttactccgggttttaccctaccg

SEQ ID NO: 48717 - DNA, 599 bp, Homo sapiens
  misc_feature: GYAE6OF02GD4JD.23.23.C01.1.454.CMB.1.raw
  modified_base (352)..(352): a, c, t, g, unknown or other
  misc_feature (352)..(352): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaacctggaccagcctcccaggctcgtcattcatggcacatccaacgagggaccacgtggacactcccgaggctaggttcaggtggacnggtcggctcggtgggacacgacttcgactctacacgatcagcagtcgccgacctgacttagtttgacttagttttacttacgtgtacagccgtaacgtggaccgtccgtcgggccttacgtcccgtacccgttacgggaccctaacggggtccctacgggaccgttagggaacgtaggtaacggaaaaccggtacgtcgggttacggcgtacggacctaaccgttacgtcttacggttaccttaccg

SEQ ID NO: 48718 - DNA, 636 bp, Homo sapiens
  misc_feature: GYAE6OF02JYEBX.23.23.C01.1.454.CMB.1.raw
  modified_base (201)..(201): a, c, t, g, unknown or other
  misc_feature (201)..(201): n is a, c, g, or t
  modified_base (619)..(619): a, c, t, g, unknown or other
  misc_feature (619)..(619): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagcccaccctctcctgcagggccagtcagagtgttgccgactccgttggcctaggtaccaacaaaaacctggccagcctccagctcgtcattcatggcacactaccaacgacgggccaacgtcggaccactccccgagggccacggttcaacggtcggcaaggtcggctcggtacgggactacggtacttcgacgtcctcgaacgtatacgacgtctaacggttcgtacccggtaccctggaaccgtttagtttcgaccgttaacgttttacgttaacgttcgtacgtaacgtacgtaaacggttcggaccgtccgtcgggtaccttacgtccgtaccgttaccggaccgtaaagggtccttacgacgtggactacgtaacggaaacgtacgtacggtcgacgtacgccaaccgtntacgttcgtacttaccg

SEQ ID NO: 48719 - DNA, 626 bp, Homo sapiens
  misc_feature: GYAE6OF02HJ8IZ.23.23.C01.1.454.CMB.1.raw
  modified_base (203)..(203): a, c, t, g, unknown or other
  misc_feature (203)..(203): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagactattcttttgacacagtctccagacatcgtgtctgtgtctccgaggggangagccacctctctgcagggccaggtcagagtgttcgccgtacgtccgttggcctggtaaccaaactaaaaaccgtcggaccagccctcccgaggcctcgtcacttcagtcggctacactccaacgacgggccacgtggcactacccgaggaccaggttcagtcggcagtcggctcgtggacagacttcactctacacgtctacacgtcgacgtcgtaccgacccgtggacgttagtttcgacttagtttaacttacgttagtacctaacggctaaacggtcggaccgtacggtcgggcctttagtcccgtaccggttccgggaccgtaaacgggccttacggaacgtgggaactacggtaacggaaaccgtacgtcggtacggccgtcgtaaccctccgtacgttccgtacgttccttacccg

SEQ ID NO: 48720 - DNA, 558 bp, Homo sapiens
  misc_feature: GYAE6OF02H3WGK.23.23.C01.1.454.CMB.1.raw
  modified_base (441)..(441): a, c, t, g, unknown or other
  misc_feature (441)..(441): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctcaggggagagagccaccctctcctgcagggccagtcagagtgttcgccgactccttggcctggtaccaaacaaaaacctggccacgcctcccgaggctcgtctattcatggcacactaccaaacgacgggccacgtggcactcccgaggctacggttcaggtggcagtcggctcgtggacagacttcactctcacgatcagctagtcgtaccgaccgtgacgtatttgcttagtttattactgtctacncacggtgccgccgtggcctactccaccgtttcgaccgaacggtacgaccgacgtaggacgtagtacggaaaccgtaacgtggtaggcctcggacctaccacgttcttcgtaccttac

SEQ ID NO: 48721 - DNA, 657 bp, Homo sapiens
  misc_feature: GYAE6OF02JXMEI.23.23.C01.1.454.CMB.1.raw
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
tcagacgcgagtatcacgaccggtgctcgatttagtacacgtgattagggagttgggggaggaacgtgctcagtttggacccagagggaaccatggaagccccagctcagattctcttcctcctgctcctctggctcccagagcccaccggagatattcttttgacacagtctccagacatcgtgtctgtgtctccagggganagacgccaccccgtntccctagcgagggcccaaggtccaggtacgtgttcgcccgtactccgttggcctggtaccaactaaaaacctggccagcctcccaggactcgtcacttcagtcggacaccatccaacgacggtaccactcggacactcccgaacggctaacgggttcacgtcggacctaggtcggtctacgtaggggacctacggacctttcgacgtcctacgaccgtataccgagtcgtacgttaggcctacccgtcgtacgttacgtttcgaccttagttacttacgtcacgtaggtacctaacgtggtccggaccttcgggacttctccgtacccgttcggccgtaaacgggtaccttcgggaacctcgggttaacgtacgtaccggaaacgtacttacgggttcgacgtcgtacccgaccgttaccgtgtttacgtaccgttacg

SEQ ID NO: 48722 - DNA, 561 bp, Homo sapiens
  misc_feature: GYAE6OF02JI2SK.23.23.C01.1.454.CMB.1.raw
  modified_base (201)..(201): a, c, t, g, unknown or other
  misc_feature (201)..(201): n is a, c, g, or t
  modified_base (372)..(372): a, c, t, g, unknown or other
  misc_feature (372)..(372): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaacctggccagcctccaggctcgtcattcatggcacactccaacgagggccacgtggcatccccgaggcaggttcagtggcagtggctcgtgggacagacttcactcncacgatcagcaaggtcgtacgaccctggacgtatttgactaagttttattactgttcagccaacgtcggcctccgtcggccttatccgtaccgttccggaccgtaaagggtcctacggacgttggagacgtacggaaaccgtaacgtggtcggtacgtcgtaccaccgtaactcgttacgttcttaccg

SEQ ID NO: 48723 - DNA, 548 bp, Homo sapiens
  misc_feature: GYAE6OF02F27UG.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggganagagccaccctctcctgcagggccagtcagagtgttgccgactccttggcctggtaccaacaaaaacctggaccagcctccaggctcgtcattcatggcacatccaacagggccactggcactcccgaggcaggttcaggtcggcagtggctcgtgggacagacttcactctacacgatcagcagtcgtcgacctgacgtatttcgctagtttacttactgtacgacgacgtaacggtcggacgtccgtacgtcctactccgtacgttccgacgtaacggctacggacgtggaagacgtaacgaacgtacgtcggtcgtcgtacgaccacctatcgttcgtctacc

SEQ ID NO: 48724 - DNA, 719 bp, Homo sapiens
  misc_feature: GYAE6OF02IW3Z2.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtcctccgagggagagacgccaccctctcctgcgacggccagtcagagtgtcgacccgtactccgttcggccttacggaaccaaaccgaaaaaccgtcggaccaacgtcccctaccgacggtcctcgtctacttcagtcggaccacagtacccaacggacggaccacgtcgggaccaccgtacccgaggccgtaggttcgaggtcggaccgtaggtcggccgtcggtacgggacctaaggtccttactaccgtcctaccgacgtactacgacgaccgtacggtcgtacccgtaccgtacgtaccgtttaactttcggtaccttaagtttttacttacgttacgtaccgtaacgtacccggtaacggtcgggtcccgtaccggttcgtaccgttacctaccggtacccggttaccgggtacccggaaacgggtcccgtaccggtaacggtcggaagtacggtaaaccgtaaaccggtacgttacgggtgtaccgtcggaccctaacgtacttccggttacgtcctttacccg

SEQ ID NO: 48725 - DNA, 641 bp, Homo sapiens
  misc_feature: GYAE6OF02GIKA4.23.23.C01.1.454.CMB.1.raw
  modified_base (203)..(203): a, c, t, g, unknown or other
  misc_feature (203)..(203): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttagacacagtctccagacatcgtgtctgtgtctccgagggganagagcccaccctctcctgcgacgggccagtcagtaggtgttcgccgactccgttggccgtacggaaccaaacaaaaccgtggaccagccctaccgaggcctcgtcacttcagtcggcacactacccaacgacgggccacgtgcactcccgaggctaggttacaggtcggcagtcggctcgtgggacacggtcttaccgacttcctacgacgatacgagcgtagtcgaccgtaccgtagtacgttagtttcgacttagttttacttacttcgtacacgacgtaacggtcgggtccctccggttacgacccttacgtacccgtacccggttccggaaccgtaacgggtaccgttaccggtacggtaggaacgtaaggtaaccggtaaacgtacgtacgggcgtacgtcggacctaaccgtacgttctacgttccttaccg

SEQ ID NO: 48726 - DNA, 620 bp, Homo sapiens
  misc_feature: GYAE6OF02GJWIQ.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagcccaccctctcctgcagggccagtcagagtgttgccgactccttggcctggtaccaacaaaacctgccagcctccaggctcgtcattcatcggcacactccaacgacgggccacgtggcactcccgaggccgaggttcgaggtcggcaggtggcgtcgtgggacacgtacttcactctacacgtatcgagacaggtcgtccgaccctaggacgttcgtttagctagttttattacgtgtctagacctaacggtcggaccgtccgttacggcccttacgttaccctacccggtttaccgggacccgtaaacggggtacctacgtaccgtgggtaacgtacgtaacggtaaaccggtacgttacgggtaccggtccgtacggaccctaaccgttacgttcgttcgttaccttaccg

SEQ ID NO: 48727 - DNA, 586 bp, Homo sapiens
  misc_feature: GYAE6OF02G264K.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagcccaccctctcctgcagggccagtcagagtgttgccgactccttggcctggtaccaacaaaacctggccagcctcccgaggctcgtcattcatggcacactcccaacgacgggaccacgtcggacactcccgaggctaggttccaggtggcaggtggctcgtggacagtacttcactctcacgtactcagctagtcgtcgaccgtgacgtatttcgactagtttattacgtgtacagtactaacggtggtaccgccgtcggtaccttacgtacctaccgttccggacccgaaacggtacctaccggacgtgggacgtaacggtaccggaaacggtacgtaggtcggtacgtacggacctaccgattcgttcgttcttaccg

SEQ ID NO: 48728 - DNA, 602 bp, Homo sapiens
  misc_feature: GYAE6OF02IX0LD.23.23.C01.1.454.CMB.1.raw
  modified_base (181)..(181): a, c, t, g, unknown or other
  misc_feature (181)..(181): n is a, c, g, or t
  modified_base (199)..(199): a, c, t, g, unknown or other
  misc_feature (199)..(199): n is a, c, g, or t
  modified_base (231)..(231): a, c, t, g, unknown or other
  misc_feature (231)..(231): n is a, c, g, or t
  modified_base (281)..(281): a, c, t, g, unknown or other
  misc_feature (281)..(281): n is a, c, g, or t
  modified_base (352)..(352): a, c, t, g, unknown or other
  misc_feature (352)..(352): n is a, c, g, or t
  modified_base (358)..(358): a, c, t, g, unknown or other
  misc_feature (358)..(358): n is a, c, g, or t
  modified_base (397)..(397): a, c, t, g, unknown or other
  misc_feature (397)..(397): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctccagagaccacggagatattcttttgacacagtctccagacatcgtntctgtgtctcgagggganagagcccacctcgtctgacagggccagtcagngtgttgccgactccttggcctaggtaaccaacaaaaaccgtcggaccacnccctccgacggcctcgtactatcatcggactacatacaacgagggccaacgtgacactccgagcagttcgngtcgancggtgctgtagggacagtactcactctcacgtactacancgtagtcgtcgacctaggactattacgctagtttaattacgtgttacagtccgtaacggtcgccgaccgtcggtacctccgtaccgtaccgttccgacggtaaacggtaccgttacgacgtacgggacgttaacgtaacggtaaaaccgtacgtaggttacggtcctaacggtccaacggtccttaccgttcgtttaccttcccg

SEQ ID NO: 48729 - DNA, 599 bp, Homo sapiens
  misc_feature: GYAE6OF02FVGK4.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagcccaccctctcctgcgagggccagtcagagtgttgccgactcctggcctggtaccaacaaaaacctggccagcctccaggctcgtcattcatggcacatccaacgagggccacgtggcactcccgaggctaggttcaggtggacagtggctcgtgggacaggacttcactctacacgatcagcagtcgtacgaccctgacgttagtttgcttaagtttacttacgtgtacagtacctaacggtcggtcgtccgacggtcctacgtccgtacccgttcggtacccgaaacgggtcctaccggacgtgggaacgtaacgtaacggaaaaccggtacgttcggtacggtacgtacgcccgtaaacccgtcgttaccgttacggtacctttacccgg

SEQ ID NO: 48730 - DNA, 593 bp, Homo sapiens
  misc_feature: GYAE6OF02HQDHF.23.23.C01.1.454.CMB.1.raw
  modified_base (364)..(364): a, c, t, g, unknown or other
  misc_feature (364)..(364): n is a, c, g, or t
  modified_base (504)..(504): a, c, t, g, unknown or other
  misc_feature (504)..(504): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgccccactcccacgaggaattggtgcagtctgggcctgaggtgaagagcctgggcatcagtgaaagtcacctgacaaggcttcaggatacaccttcacctaaattgatatcaactgggtgcgacacggacccctgggaaaaggctacggagtggagtgggcgtgggtgagtccgtaggtgttagagaagtaccgggctattctnagaagttcgaaggtccaggctcgacgctcgaccgtcggaactacttaccgagtaaacgaacgacgacccgtattacggaacgtcgcgccggtcctcgaccctctacggaccgacgaccggtccgtgttagttagttggtncggagagggccggaggccggcggttagttttacgggaatttagttagttaggttacgtggtaccggtcggtacggggacgtaaccgggg

SEQ ID NO: 48731 - DNA, 577 bp, Homo sapiens
  misc_feature: GYAE6OF02HZNXR.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctccagagaccaccggagatattcttttgacacagtctccagacatcgtgtctgtgtctccgagggganagagccaccctctcctgcagggccagtcagagtgttgccgactcctggcctggtaaccaaacaaaacctggccagccctccaggctcgtcattcagtggcacatccaacgacgggccacgtggcactcccgaggcaggttcaggtggcaggtggctgtcgggactagtacttcactctacgacgatcagcagtcgtccgtaccgtgacgtatttcgacttagtttacttacgtgtactacgacgtaacggtcggacgtccgtaggtccctaatccgtaccgttccgggaccgtaaacgggccttacgacgtggaacgacgtaacgaaaccgtagtcggtcgacgtcgaccgtacctagttccgttacgttctaccg

SEQ ID NO: 48732 - DNA, 555 bp, Homo sapiens
  misc_feature: GYAE6OF02H3SXM.23.23.C01.1.454.CMB.1.raw
  modified_base (505)..(505): a, c, t, g, unknown or other
  misc_feature (505)..(505): n is a, c, g, or t
  modified_base (543)..(543): a, c, t, g, unknown or other
  misc_feature (543)..(543): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagccaccctctcctgcagggccagtcagagtgttcgccgactccgttggcctggtaaccaaacaaaacctggccagccctcccgaggctcgtcattcagtcggcacactaccaacgacgggcccacgtggacactcccgaggctaggttcaggtggcaggtgctcgtggacagacttcactctacacgatcgagctagtcgtccgacctgactatttgcttagtttactactgtactagacgtacggtcggtccgcctggtcctagtccctaccgttcgaccgtaacggctcgacgtgganacgtaacgaaacgtagtgtacggctacgacctaccgtntcgtacgtctac

SEQ ID NO: 48733 - DNA, 707 bp, Homo sapiens
  misc_feature: GYAE6OF02G9286.23.23.C01.1.454.CMB.1.raw
tcagacgcgagtatcacgaccggtgctcgatttagtacacgtgattagggattgggggaggaactgctcagtttggacccagagggaaccatggaagcaccagctcagcttctcttcctcctgctcctctggctcccagagaccaccggagatattcttttgacacagtctccagacatcgtgtctgtgtctcgaggggagagagccaccctctcctgcagggccagtcagagtgttgccgactccgtggcctggtaaccaaacaaaaccgtcggaccacgccctcccgaggcctcgtacagttcacgtggccacactacccgaacgacgggccacgtcggaccacgtaccccgaggcgtacggttacaggtcgggcgtaggtcggtaccgttcgggtacggggactaacggtaccctttcgaacccgttcttaccgaacgtacttaccgaacgtcctaacgggtttcgtaccccggtaacccgttagggtaaccgtttacgtttttcggaccttttaaggtttttaacttaccgttcggtaccgtaacgtaccgtaacgggtcggtacccgtacccgttcgggacccttacgtacccgtacccggttaccggacccggtaagggtccctacggtacgtaggaacgtacgtaacggaaacgtaccggttcgacggtcgtacggacctaacgtacttccgtacttccg

SEQ ID NO: 48734 - DNA, 705 bp, Homo sapiens
  misc_feature: GYAE6OF02IG37U.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtagcagtctgggcctgaggtgaagaagcctggggcatcagtgaaagtcacctgacaaggtcttcgaggatacaccttcaacctaaatttgatatctaacgtgggtacgcgacacggccccgtaggaaaacggtcgtacggaggttggagtggggacgtggggtacgacgttaccgtaggttggttagaacgtacgtaccggggtctacgttctacgaaggtaacggttacgaaacgggtccaagggtccttaccgaacggtcccgttacgaacccgttagggaaccctaccgttaccaaacggaaacgtaaccgacgacccgttaagtttacggaaccttcggaccggcggtacctcgaaccctcgtacggaccgaacgaccggtccgttagtactttacgttcggtcgacggtacggtagggacgggacggaccggtacggttaggtttttagggaactttagttaaggttcggttaacgttcgggtaaccggtttcggtacggggtaaccgtaaccggggg

SEQ ID NO: 48735 - DNA, 602 bp, Homo sapiens
  misc_feature: GYAE6OF02I0C9M.23.23.C01.1.454.CMB.1.raw
  modified_base (475)..(475): a, c, t, g, unknown or other
  misc_feature (475)..(475): n is a, c, g, or t
  modified_base (512)..(512): a, c, t, g, unknown or other
  misc_feature (512)..(512): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagcccaccctctcctgcagggccagtcagagtgttgccgactccttggcctaggtaccaaacaaaactcggccacgccctccgaggcctcgtcctacttcatggaccacactaccaacgcgggaccacgtcgcactcccgaggctaggttcaggtcggaccaggtcggtacctcggtcgggaactacggtacctttcacttcctaccacctactacacgcacgtcctaagcgacctagaagttagtttcgacttagtttacttattgtacngtctacgcgtaagctaacgtccgacctacgttccggnggtaacggaccgaggtagaaacgtcgaaacggtacgtacgggacgtacgtacgtaccgacttagtccgttcttacctcttccgttccccg

SEQ ID NO: 48736 - DNA, 567 bp, Homo sapiens
  misc_feature: GYAE6OF02F2390.23.23.C01.1.454.CMB.1.raw
  modified_base (524)..(524): a, c, t, g, unknown or other
  misc_feature (524)..(524): n is a, c, g, or t
  modified_base (554)..(554): a, c, t, g, unknown or other
  misc_feature (554)..(554): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagcccaccctctcctgcagggccagtcagagtgttgccgactccttggcctggtaaccaacaaaacctggaccacgcctcccagctcgtcattcatggcacatccaacagggccacgtggcactccccgaggcctaggttcaggtcggcagtggctcggtaggcaggaccttcactcctcacgatacacgcaggtctaccggaccctggacgtagttttcgacttagttttacttacgttcgtcaacgtcgtaacggtcggccgtccgtcggaccttatcccgtaccgttccggacgaacgggtactacggacctggganacgtaggaaactcgtgcgagtcgaccactntcgttcgtactcg

SEQ ID NO: 48737 - DNA, 682 bp, Homo sapiens
  misc_feature: GYAE6OF02GGIE7.23.23.C01.1.454.CMB.1.raw
  modified_base (277)..(277): a, c, t, g, unknown or other
  misc_feature (277)..(277): n is a, c, g, or t
  modified_base (321)..(321): a, c, t, g, unknown or other
  misc_feature (321)..(321): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctggcctgagtgaagagcctgggcatcagtgaagtcacctgcaaggcttcaggatacaccttcacctaaattcgatatcaactgggtancgacacggcccctaggaaacggctacgagtggatgggctgggtnagtccgtagtcgttgagtaagtaccgggtattcgtacgagtagttacgaacggccagggtctcggaccgtcgtacgtacggtaccgaactaccgttacgaagaaacgtaacaccgtaaccgtttagtaacgtacgtacggccggtaccgtacgtaccgtaccctcggaccgaacccggtaccggtacccggttccggttaagtttaccgtttagggtcgtacggaccgtaggggaccggtacggggaccggtccggttacggttttacgggtttaaggttaacgttaagtttacggttaaggtttacgggtaccgggttaccggttcgggaacggggtacccggtaacgggtaaccccggg

SEQ ID NO: 48738 - DNA, 776 bp, Homo sapiens
  misc_feature: GYAE6OF02F2LSY.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagccgtggggcatcagtagaagtccacctgacaaggtcttacgaggactaccaccttacaacctaaatttgatactacaacgtgggtgaccgacacggccccgtagggaaacggtcgtacggacggtggacgtcggggtcgtaggggtacgtacggtaccgttaggttggttaggaacggtaacggtaccggggtactacgtttaccgacgtaaggtaacgtttacgaacgggtacccgtaggtaccgtacgaccggtcccgtacggtaacccgttacgggaaacccttaaccgttaacccgaaacggtaaaccggaaacctacccggtaacccgttaacgttttacgggaacccgttcggcccggtaccggtacccgtacgtacccgtacggtacggaacccgaccgtaccggtaccgttagtttacgttagttacgtacggacggtacgggaccgggtacgggtaccggtaccggttaggtttaaggttttaacgggaagttttaacgttaggttacggttacggttaccgggtaacggttcgggtaccgggacccggtaacccgggg

SEQ ID NO: 48739 - DNA, 807 bp, Homo sapiens
  misc_feature: GYAE6OF02H7L3T.23.23.C01.1.454.CMB.1.raw
  modified_base (261)..(261): a, c, t, g, unknown or other
  misc_feature (261)..(261): n is a, c, g, or t
  modified_base (338)..(338): a, c, t, g, unknown or other
  misc_feature (338)..(338): n is a, c, g, or t
tcagacgcgagtatcacgaccggtgctcgatttagtacacgtgattagggattgggggagtcaacaaccacatctgtcctcgagaggacaccctgtgaccacagctcctcaccatggactggacctggacgatcctcttcttggtggcagcagccagaagtgcccactcccacgaggaattgggtgcagtctgggcctgaggtgaagaagccgtgggcatcagtgaaagtcacctgacaaggcttcaggatacacctttanaacctaaatttgaatatacgtaactggggtcacgacacgggcccctagggaaaaggtctacgaagtcggaatcgggngtagggtcgtaggtccgtaggtggtttaggagtaaacggtaccggggacttaacgttcgtacgtaaggtaaacggttccgaaacgggccgtacggtaccgttcgaacgggtcccttagggtaacccgttagggtaaactaccgtttaccggaacgaaacggttaaccgaaacgggtaccccttaaggtttacgggaaacctttccggggaaccgtccggtaacccgttacgtaacccgttcgttaaccgggaacccgtacgggaacccgtcccggtttaagtacgttttacgtacgggttaacgacgggtaacgggtacggggacccggtcggggtaccccggtagggtttttaacgggtttttaacgggtaaacgttttaacggttaacggtttcggggtttaaacggttacggggttaaacccgggtttttcggacccgggggggtaacctaaaaccccgggggggg

SEQ ID NO: 48740 - DNA, 583 bp, Homo sapiens
  misc_feature: GYAE6OF02H17ZT.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagagcctggggcatcagtgaaagtcacctgcaaggcttcaggatacaccttcaacctaaattgatatcaactgggtgcgacacggcccctaggaaaacgggctacggaggtggagtgggcgtgggtgacgtcctaggtgttgagaacgtaccgggctagttctcaagtaagttcgaaggccaggtcctcgacgcctagaccgtaggaactacgttaccgaagtaaacgaacaacgaccctaagtttacgaaacgttcggcgcggcctgacctcgtagaccgacgaccgcgttagttattattggtgcgaggaggcggaggccgtggttaggttttggaattagttagttggtagtggtacggtcgtgggaccgtaacggg

SEQ ID NO: 48741 - DNA, 527 bp, Homo sapiens
  misc_feature: GYAE6OF02FSBNY.23.23.C01.1.454.CMB.1.raw
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
  modified_base (475)..(475): a, c, t, g, unknown or other
  misc_feature (475)..(475): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaccaaatttgatatcaactgggtgcgacaggcccctggaaaagggctcgagtggatgggctgggtgagtcctagtgttgagaataccgggnattcncagaagttcaaggccaggctcagcctgacctggaacacttcagaagaacagcccattggaactgcgcggcctgacctctgaccgacgacggccgtgtattattgtgcgagaggcggaggccgngtagttttgggaattagttagtggtagtggtacgtcgtggggcctaacgggg

SEQ ID NO: 48742 - DNA, 549 bp, Homo sapiens
  misc_feature: GYAE6OF02FNEDH.23.23.C01.1.454.CMB.1.raw
tcagacgcgagtatcacgaccggtgctcgatttagtacacgtgattagggattgggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaccaaatttgatatcaactgggtgcgacaggcccctggaaaaggctcgagtggatgggctgggtgagtcttagtgttgagaataccgggcattctcagaagttcaaggccaggctcacgcctgacctggaactacgttccagaaacgaacacgaccctatttaggaacttgcgcggcctgacctcgtgacgaccgacggcccttgtattagttgtgcgagagggcgggagccggcgtagttttgggaattagtttagtggttactgggacgtcggtaggggccgtaacgggg

SEQ ID NO: 48743 - DNA, 609 bp, Homo sapiens
  misc_feature: GYAE6OF02F1H69.23.23.C01.1.454.CMB.1.raw
  modified_base (203)..(203): a, c, t, g, unknown or other
  misc_feature (203)..(203): n is a, c, g, or t
  modified_base (311)..(311): a, c, t, g, unknown or other
  misc_feature (311)..(311): n is a, c, g, or t
  modified_base (407)..(407): a, c, t, g, unknown or other
  misc_feature (407)..(407): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggganagcgccaccctctcctgccgagggccagtcagagtgttgccgtactccttggcctggtaccaaacaaaacctggaccacgccctccaggctcgtcattcatcggcacntaccaacgacgggccacgtcggccactcccgaggcgacggttcaggtcggacaggtcggccgtcgtagggacaggtcttcacgttctactacgacncagcgagtcgtaccgaccgtgtacgttatttcgacttagttttatctgtcgacgcgtacgtcggtccgtcgtcggtcctactccgtaccgttccgggaacctacgggtacctacggtaccgtagggaacgtacgtaacggaaacggttacgtagggtcggtaacgtcggaccctaaccgtacttaccgttcgttccttaccg

SEQ ID NO: 48744 - DNA, 974 bp, Homo sapiens
  misc_feature: GYAE6OF02G9G41.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctccctcgtcgcctaccgagacgacccgaccggagtattacttttcgtttagaccacgtacgtcctaccagactacgttcgtgtcgttggtcgtccgtaccgggaggggagacgaccgccctaccctcctccgtcgacggacgggacctagtcgaggtgttcgtccggaccttccgttccggttcggtccggtaccgtaaacccaaaaaccgaaaccgtccggaccgtaccgtcccccgtaccggacgtcccgtcgtacttacgttaccgtaggtccggaacctaacctacgtaaccccgaaacggggtcccgggtaccctaacgggtaccgggaacccttacccggtaccccgggacgggtaccggtttacgggtaccggtacggcgggtaccgtacgggggtcgtaccgttacggggaacgggtaactaaccggtttaccttaacctacccgtttccgtaacccggtaacgttaactccggacggacgtttacggtaccccggtaaccccgtacccgggttaaggtaccgtttttagtttcccggtaacgttttttaaaggttttaccttaccgggtttacgtacccgggaaaccttaaaccgggtacggggtttcccgggacccttaccgggttacccggtttactttaccccggtttacccccgggttaacccgggtttaccgggggaaacccgttaacgggttacccgtacccgggtaagggttaccgggaacgtttaaccgggttaaaacccgggtaaaggttacccggttggggtacccggtaccgttaaccggacccccgttaacgtttaccggtttccggtttaccttaccccgtttaaccg

SEQ ID NO: 48745 - DNA, 582 bp, Homo sapiens
  misc_feature: GYAE6OF02INHFO.23.23.C01.1.454.CMB.1.raw
  modified_base (355)..(355): a, c, t, g, unknown or other
  misc_feature (355)..(355): n is a, c, g, or t
  modified_base (362)..(362): a, c, t, g, unknown or other
  misc_feature (362)..(362): n is a, c, g, or t
  modified_base (521)..(521): a, c, t, g, unknown or other
  misc_feature (521)..(521): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcatcagccagaagtgcccactcccacgaggaattggtgcagtctgggcctgaggtgaagagcctggggcatcagtgaaagtcacctgcaaggcttcaggatacaccttcaccaaatttgatatcaactgggtgcgacacggccccgtagggaaaagggctcggaggtggagtgggctgggtgagtccgtagtgttgagtaataccgggntattctnaagaagttcaaggccaggctcgacgcctgacctcggaaccacttaccgaagaacgaacgacgaccctaagtttacggaacttcggcgcggcctcgacctcgtgaccgaccgacggtccgtagttacttacgttgtgacgaggacggcgggacggccggngttaggttttaggaattagttagtagggttatcgggtacgtcggtacgggccgtaacgggg

SEQ ID NO: 48746 - DNA, 613 bp, Homo sapiens
  misc_feature: GYAE6OF02GNKDA.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagcccaccctctcctgcagggccagtcagagtgttgccgactcctggcctggtaccaacaaaaacctggaccagcctccgagctcgtcattcatggcacactccaacgacgggccactcggctaactccccgaggccgtaggttcagtcggacaggtggctcgtgggacagtacttccacgtctacgacgtatcagtacaggtcgtccgtacctgtacgttagtttcgaccgttagttttacttaacgtgttacacgtacgaacggtcggaccgtccgttcggtacccttacgtccgttacccggttaccgggaacccgtaacgggtaacctccggacgttggaacggtacgtaacggaaacggtacgtaggtcgacgtcggacctacctagttcccgttgtccttccg

SEQ ID NO: 48747 - DNA, 841 bp, Homo sapiens
  misc_feature: GYAE6OF02IG29X.23.23.C01.1.454.CMB.1.raw
  modified_base (298)..(298): a, c, t, g, unknown or other
  misc_feature (298)..(298): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctggaggtgaagaagccgtggggcatcagtagaaacgtcacctgacaaggcttacgaggactacaccttacaacctaaatttcgattatactaaacgtgggtancgacgacggcccctaagggaaaacggccgttacgaaggtggtaacgtcggggtaccgttggggtacgtaacggttcccgttaagggttcggttaaggaaggtaaaccgtaaccgggggtctaacgtttaccgtacgtaacggtaaaacggttttaccgaaaacgggcccggttaaggaccgttacgacggtaccccgttaggtaacccgtaacggggtaaacctaaccgtttacccgaaagggaaaccgtaaaccgacgtaccccgttaaaggttttacgggaaaccgtttcggaacccgggccgggtacccttacggtacccttacggttaacggaaccggtaacccggaccccggggttaccgttacggttaacgttttaacggttacggtacgtaaccgggtaacgggaccggggttacgggaccggtacccgggtaacggttttaacgggtttttacgggtaaactttaggtttacggttagggtacggttaggggaacccgttttcgggtaccggggtaccggttaaaacccgggggg

SEQ ID NO: 48748 - DNA, 617 bp, Homo sapiens
  misc_feature: GYAE6OF02JLF0G.23.23.C01.1.454.CMB.1.raw
  modified_base (281)..(281): a, c, t, g, unknown or other
  misc_feature (281)..(281): n is a, c, g, or t
  modified_base (315)..(315): a, c, t, g, unknown or other
  misc_feature (315)..(315): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagagcctgggcatcagtgaagtcactgcaggcttcgaggatacaccttcacctaaattgatatcaactgggtgcgacncggccctaggaaaggctacgagtcggagtcgggngtgggtgagtccgtaggtgtgagtaagtacgggctagttctacgagtagttcgaaggcctaggctcgacgcgtacggtacgtaggaactacgtacgagaacgaacgacgtacctagttagaacgtcgccgtcggtacctcgacctcgtcgaacggaccgaccggtcgttacggtatttacgtttcgacgtacggacgtacgggacggggtacggtccggtcggttaagtttttaggggaaacgtttagtttaaggttcggttacgttacgggtacgttcgggtacggggtagtaacccgggg

SEQ ID NO: 48749 - DNA, 716 bp, Homo sapiens
  misc_feature: GYAE6OF02FOXYL.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganatacgccaccctctcctgcgagggccagtcaggagtgttcgccgtactccgttggcctcggtaaccaaaaccgaaaaaccgtcggaccacgcccctacccgacggcctcgtctactttcagtcggaccacactacccaaacgacgggccacgtcggcacgtcccgaggtccgtacgggttcagggtcggacgtagggtcggtccgtcgggtacggggaactacggtactttaccgaccgttacctaccgtaacggtactaccgaacgtaccggtaacgggttccgtacccgtaccccgttaggtaccggtttattttcggacctttagttttactttaacgttggtaccgaacgtaccgtaaccgggtcgggtaccgtccgtcgggtacccttacgttccgtacccggttaccggaaccgtaacgggtccgttacggacggtacggagtaacgtaacggtaaaccgtacggtcggtaggacgtacggtacctacgtacttcggtcttacgttcc

SEQ ID NO: 48750 - DNA, 636 bp, Homo sapiens
  misc_feature: GYAE6OF02HQXCI.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagccaccctctcctgcagggccagtcagagtgtcgccgactccttggcctggtaaccaaacaaaaacctggaccacgccctcccgaggtcctcgtcattcagtcggacacatccaacgcgggaccacgtggccactcccgaggcctagggttccaggttcggacgtaggtcgggcctcgtacgggactacgtacttacactcctacgacgtactacgagcgagttcgtaccgacctggtacgttagttttcgacttaagtttacttacttgtcagacgtaacggtcggccgtaccgttcggtacccttacgtaccgtccggttaccgaccggtaaacggtcctacgggtacgtaggaacgtaacggtaacggaaacgttaggtacggtacgtacgtacgacccgtacgttactaccgttcgttaccttaccg

SEQ ID NO: 48751 - DNA, 519 bp, Homo sapiens
  misc_feature: GYAE6OF02IVQL3.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattctttttgacacagtctccagacatcgtgtctgtgtctccaggggagagagccaccctctcctgcagggccagtcagagtgttgccgactccttggcctggtaccaacaaaaacctggccagcctccaggctcgtcattcatggcacatccaacaggccactggcactccaggcagtcagtgcagtgctcgtggacagacttcactctcacgatcagcagtgtcgacctgacgtatttgctagtttattactgtcagtcacgtggcgtcctggacctatctaccttccggactaaggactcgactggatagtacggaaacgtaactggtacggcttaggcctaaccatcccgttagtccttacc

SEQ ID NO: 48752 - DNA, 595 bp, Homo sapiens
  misc_feature: GYAE6OF02HA1YZ.23.23.C01.1.454.CMB.1.raw
  modified_base (203)..(203): a, c, t, g, unknown or other
  misc_feature (203)..(203): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagacgaccaccggagatattcttttgacacagtcctcagacatcgtgtctgtgtctccgagggganagagccaccctctcctgcgagggccagtcagagtgttcgccgactctggcctggtaaccaaacaaaacgtggaccacgcctaccgaggctaccgtctattcatcggcaacactacccaacgacgggaccctacgtcggaccacgtcccgagggcctacgggttcacggtcggcaggtggctcgtagggacagtaccttcactcacgactatcgagtcaaggttcgtacccgtaccgtggtaaccgttatttcgacttagttttactacgttgtacagtactacggtcgacgtccgtacgtactacgtccgaccgttgaccgaaggtcctacgacgtagacgtacgacggaaactcgtacggtcgtactcgacctactagtcttcgtcttacg

SEQ ID NO: 48753 - DNA, 848 bp, Homo sapiens
  misc_feature: GYAE6OF02I3TZF.23.23.C01.1.454.CMB.1.raw
  modified_base (183)..(183): a, c, t, g, unknown or other
  misc_feature (183)..(183): n is a, c, g, or t
  modified_base (200)..(200): a, c, t, g, unknown or other
  misc_feature (200)..(200): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtntctgtgtctcagggganagacgccacctctcctgcagggccagtcagtagtgttcgccgactccgttggccgtaggtaaccaaactaaaaaccgtcggaccgaacgccctaccgacggcctcggtactacttcacgttcggaccactacgttaccaaacgacgggtacccaaccggtcggacctaaccgtaccccgacggtacggtacggtttaccgaaaggttccggacgtaacgggttcgggaccgttacggtaccgggtaacgtaacggttacgtttaccgtaccgttaccgtaaccgtaccgtaacgtccgtaaggtacctaacgggttaccgttaccccgtaacccggtttacgaaaccggtttaacgttttaacggaccgttttaaacggttttacgttaaccggttaccggttaacgtaccggtaaaccgttaaccgggttccggtacccggtacccggttaccggtaccgtttaaccgttacccgttaacccgggtttaaccgaacccgggtaaacgggttacccgtacgggttaaccgtacggggtaacgtaaccggtaacccggttaaaaccgggtacttaccggggtacggttaaccgttacgtaacccggtaaccgttaaccggttacccggttaaccgtttcgttaaccccg

SEQ ID NO: 48754 - DNA, 575 bp, Homo sapiens
  misc_feature: GYAE6OF02HH9WF.23.23.C01.1.454.CMB.1.raw
  modified_base (202)..(202): a, c, t, g, unknown or other
  misc_feature (202)..(202): n is a, c, g, or t
  modified_base (431)..(431): a, c, t, g, unknown or other
  misc_feature (431)..(431): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggganagagccaccctctcctgcagggccagtcagagtgttcgccgactccttggcctggtaccaaacaaaaacctggccagcctccaggctcgtcattcatggcacataccaaacacgggccaacgtggacacttcccgaggcaggttcaggtgcagtggctcgtgggacagtacttcactctcacatcagcagtgtccgacctgactatttgactagtttacttactcgtanacgactaacggtcggtcgcctcggtcctactccgtaccttccgggaccgtaaacgggactacgaccgtgggaacgtacgttaagaaaccggtaactggtacggtcgttacgaccgtaaccgacgtttccgttagttcccttacg

SEQ ID NO: 48755 - DNA, 578 bp, Homo sapiens
  misc_feature: GYAE6OF02F26K9.23.23.C01.1.454.CMB.1.raw
  modified_base (202)..(202): a, c, t, g, unknown or other
  misc_feature (202)..(202): n is a, c, g, or t
  modified_base (381)..(381): a, c, t, g, unknown or other
  misc_feature (381)..(381): n is a, c, g, or t
  modified_base (531)..(531): a, c, t, g, unknown or other
  misc_feature (531)..(531): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccatagaccaccggagatattcttttgacacagtctccagacatcgtgtctgtgtctccgagggganagagcccacctctcctgcagggccagtcagagtgttgccgactccgttggcctggtaccaacaaaaacctggaccagcctccaggtctcgtcattcatcggcacatccaacacgggccactggcatcccgaggcaggttcagtggcagtcggctcgtggacagtactcgactcgcacgntcagtcagtcgtaccgtacctggtaacgtacgtttcgacgttaagttttcgttaaactcgttaccgaagtacgtaacggtcgggtaccgtccgtcgggtacctaactcccgtacccgttccggaaccgtaacgggactccgaacgtgganacgtagaaacgtactggacgtgtcgactacgtactcgttacgtctac

SEQ ID NO: 48756 - DNA, 599 bp, Homo sapiens
  misc_feature: GYAE6OF02IZDQJ.23.23.C01.1.454.CMB.1.raw
  modified_base (221)..(221): a, c, t, g, unknown or other
  misc_feature (221)..(221): n is a, c, g, or t
  modified_base (427)..(427): a, c, t, g, unknown or other
  misc_feature (427)..(427): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagccaccctctcctgcngggccagtcagagtgttcgccgactccttggcctggtaccaacaaaacctcggccagccctccagctcgtcacttcatggcacactaccaaccgacgggccactggacactacccgaggccaggttcaggtcggtcaggtggctcgtcgggacaggtacttcactctcacgatcagcagtcgtacgacccgtgtacgtatttacgnttaagtttacttacgtcgtacaacgtactaacggtggaccgtccgtggtaccttacgtcccgtaccgttccgggaaccgaacggtaccgtacgaacgtagggaacgtagtaacggtaaccggtaagttcgggtacgacgttacggacctacctacgtcgtacgttccttacg

SEQ ID NO: 48757 - DNA, 568 bp, Homo sapiens
  misc_feature: GYAE6OF02FKN5T.23.23.C01.1.454.CMB.1.raw
  modified_base (314)..(314): a, c, t, g, unknown or other
  misc_feature (314)..(314): n is a, c, g, or t
  modified_base (379)..(379): a, c, t, g, unknown or other
  misc_feature (379)..(379): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagcccaccctctcctgccagggccagtcagagtgttgccgactccgttggcctggtaaccaacaaaacctggccagcctccaggctcgtcattcatggcacatcccaaacncgggaccacgtcggcactcccaggcaggttcagtggcaggtggctcgtgggacagacttcactcncacgatcagcagtcgtcgaccctggtactagtttgacgttaagtttattacgtgtacaggctaacggtggcgtccgtgtaccttacgtcctaaccgttcggacccgtaaacgggtctccgacgtaggaagtacgtaacggaaacgtacggtggtaccggcgtcgaccacctagtccgttagttcctacg

SEQ ID NO: 48758 - DNA, 630 bp, Homo sapiens
  misc_feature: GYAE6OF02IL93E.23.23.C01.1.454.CMB.1.raw
  modified_base (202)..(202): a, c, t, g, unknown or other
  misc_feature (202)..(202): n is a, c, g, or t
  modified_base (337)..(337): a, c, t, g, unknown or other
  misc_feature (337)..(337): n is a, c, g, or t
  modified_base (403)..(403): a, c, t, g, unknown or other
  misc_feature (403)..(403): n is a, c, g, or t
  modified_base (553)..(553): a, c, t, g, unknown or other
  misc_feature (553)..(553): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagattattcttttgacacagtctccagacatcgtgtctgtgtctccagggganagacgcccaccctctcctgcagggccaggtcagacgttgttcgaccgacttccttgggcctaggttaacccaaacaaaaaaccttggaccaggccctcccaggctacgtctaattcatggaccacactccaaacncgggacccacgtcggccaactccccgaggcacggttcaaggtcggacaggtcggctcgtgggaacnggtacttcgactctcaacgatcaagcgtagtcgtccgaaccgttcggacgtacttttcgactagtttacttacgttagtacagtactaacgtggcgtccgtacggtcctacgtacgtaccgttccggaccgtaaaggtccgtacgtacgnggtacgtagtacggtaaaccgtcgttaggtccggtacgtcgtaaccggaccttaacgtcggttcttaccgtttaccg

SEQ ID NO: 48759 - DNA, 622 bp, Homo sapiens
  misc_feature: GYAE6OF02HIWIM.23.23.C01.1.454.CMB.1.raw
  modified_base (203)..(203): a, c, t, g, unknown or other
  misc_feature (203)..(203): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccgggagatattcttttgacacagtctccagacatcgtgtctgtgtctccgagggganagagccaccctctcctgcagggccagtcagagtgtgccgactccttggcctaggtaccaaacaaaacctggaccacgccctacccgaggcctcgtcattcatggcacactaccaacgacgggacctacgtcggaccactcccgaggctaggttcaggtggcgaggtggctcgtgggacagtaccttcactctacacgtatcgagcgtaggtcgtaccgacccgttgtaaccgttattttcggacctttaagttttacttacgtgtacgtaggtaccgtaacggtcggtccgtccgtacggtcccttacgtcccgtaccgttccggaaccgaacgggtcctacggacgtgggaactacgtaacggaaaccgtagtcggtacgaccgtacgacctacgtacgttcgttaggttccttaccg

SEQ ID NO: 48760 - DNA, 569 bp, Homo sapiens
  misc_feature: GYAE6OF02F0S9I.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaaccaacaaaacctggccagcctccaggctcgtcattcatggcacactccaacacgggccacgtggccactcccgaggctaggttcaggtcggcaggtgctcgtgggacaggtacttcactctacacgatcagcaggtcgtccgacctgacgtatttcgacttagtttattacgtgtactagtacgtacggtcggccgtccgtggtccttagtccgtaccgttccggaccgaacgggtcctacggacgtaggacgtagtaacggaaacgtacgtggtacgacgtcgaccgaccgtactcgttcgttcttaccg

SEQ ID NO: 48761 - DNA, 548 bp, Homo sapiens
  misc_feature: GYAE6OF02JA3EB.23.23.C01.1.454.CMB.1.raw
  modified_base (346)..(346): a, c, t, g, unknown or other
  misc_feature (346)..(346): n is a, c, g, or t
  modified_base (351)..(351): a, c, t, g, unknown or other
  misc_feature (351)..(351): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaccaaatttgatatcaactgggtgcgacaggcccctaggaaacggctcgagtggatgggctgggtgagtcctagtgttgagataccgggnattcnagagttcaaggcaggctcagcctgacctggaaccacttccgaagaacgaacacgccatttcggaactgcgcgcctgaccctgcgacgacgacggccgtagtattacgttgtcgcgaggacggcggacggccggtcggttagttttagggaattagtttagtaggttagttcgggacgtcggtagggccgtaacgggg

SEQ ID NO: 48762 - DNA, 632 bp, Homo sapiens
  misc_feature: GYAE6OF02JK3T6.23.23.C01.1.454.CMB.1.raw
  modified_base (356)..(356): a, c, t, g, unknown or other
  misc_feature (356)..(356): n is a, c, g, or t
tcagacgcgagtatcacgaccggtgctcgatttagtacacgtgattagggattggggaggtcaacaaccacatctgtcctcgagaggacaccctgtgaccacagctcctcaccatggactggacctggacgatcctcttcttggtggcaacagccagaagtgcccactcccacgaggaattggtgcagtctgggcctgaggtgaagaagcctgggggcatcagtgaaagtcacctgcaaggcttcaggatacaccttcaccaaatttgatatcaactgggtgcgacaggcccctgggaaaaggctacggagttggagtggggctggggtgaggtcctagtgttgagacgtacgggnagtttctcgagtaagtcaaggccaggctcaggcctagaccgtagaacctactaccgagaaacgaacagaccgtagttacggagtcgcggtcggccgtcgacctccgtaggaccgaccgaccggtccggttagttaagtttacgttcggttcgcggtaagggcggtacgggaggcccggtaggttacggtttttacgggtaagtttacgtttaaggttacgggtaagtttacgggccggtttacgggtccggggtaccggtaaccgggtacccgggg

SEQ ID NO: 48763 - DNA, 609 bp, Homo sapiens
  misc_feature: GYAE6OF02HCVN2.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagccaccctctcctgcagggccagtcagagtgttgccgactccttggcctggtaccaacaaaacctggccagcctccagctcgtcattcatggcacatccaacagggccactggcactcccaggcaggttcagtggcagtggctcgtgggacagacttcactctacacgatcagtcagtcgtccgaccctgaacgtatttcgctagtttattacgtcgtcagtcaacggtcggctccgtcggcctacgtccgtaccgtttccgggaacccgtaaacgggtaccttaccggtacgtacgggtaacgtacggttaacggaaaaaccggttaccggttagggttaccgggtccgttacggtacccgtaacccgttaacgtttcccggttaccggttacctttaacccg

SEQ ID NO: 48764 - DNA, 563 bp, Homo sapiens
  misc_feature: GYAE6OF02IYSRM.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggganagagcccaccctctcctgcagggccagtcagagtgttgccgatccttggcctggtaccaacaaaacctggccagcctccaggctcgtcattcatggcacatccaacagggccactggccactcccaggcaggttcagtgcagtggctcgtggacagtacttcactcacacgatcagcagtgtcgaccctgactatttcgcgtagtttatacgtgtctagcacgtgcgtcgtcggacctatccgtaaccgttcgggaccaaacgggtacctaccggacgttagggacgtaacggtacgtaaaaccggaacgttcggtaggtacgtacggaccgtaaccgtacgtacttacggttacttaccg

SEQ ID NO: 48765 - DNA, 730 bp, Homo sapiens
  misc_feature: GYAE6OF02G9AW8.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagcccaccctctcctgcacgggccagtcagagtgtcgccgactccgttggcctggtaaccaaaccgaaaaacctggaccacgccctcccgaggccttcgtactacttccaagttcggaccaacctactacccgaacgtaccggggcccaacgtcggaccacgtcccgagggctacgggttaccaaggtcggaccgaagggtcgtcgtacggtcggggaacaggttaccgttcaccgttcctaccgacgtactcgaacgtccgtaggttccgtacccggtaccccgttagtaaccgttacgtttcgactttacggttttaacttaccgtacggttccaacggtccgttaacgggttccggtccggtccggtccgtaccttacgtaccccgtaccggttccgaacggttaaccggtaccgtaccgtacggtacgggtaaggtaaccgttaacgggaaaaccggttcgttagggtaccggtaccgtacggaccctaccgttacgttacgtttcggtaccctttaaccgg

SEQ ID NO: 48766 - DNA, 856 bp, Homo sapiens
  misc_feature: GYAE6OF02GFU92.23.23.C01.1.454.CMB.1.raw
  modified_base (815)..(815): a, c, t, g, unknown or other
  misc_feature (815)..(815): n is a, c, g, or t
tcagacgcgagtatcacgaccggtgctcgatttagtacacgtgattagggattgggggaggaactgctcagtttggacccagagggaaccatggaagccccagcctagactctctccttcctcgtctcctcctcgtcgtccctaccgagaaccgaacccggaccggatattactttttcgttacgaaccacgtaccgttccctaccgaacgtacctacgttcggttcgttcggttggttccgttcccgtaaccgggggaaggggtacgacggacccgacccccttacccgttccttaccgcgacgggaccggacgtacgtacgaaggtggttgtaccggaccgttccgttccggtcggtacgtaaccgtaaacccaaaaaacctaaaccggtcggaaccgaccgtacccccgtaccgggccgttccggttaccgtactttaacgttacgagggttacgaaccctaacgtacctaacccggaaacgggtcccggaacctacggtcggacccttacccgacccgggtacggacggttaccggttacgtcgggtccgacggtaggtcgtcctaggggacggaactaagttcctaaccgtctaccgtacggatcgacgaccgagtcgtccgacccgtacgtacgtaacgttttgtaccgtagttttacttacttacgtccgtacggacgtaccggtaccgggtcggtacccttacgggccttaaccttaccacccggtttaccggacccggtaacgggtaaccggtcgtacgtcgggtacggaagttaccgtaaaacgggaaccttcggtagggttccnggtaacccgacttaccgacgttttcgttacttcttaacccg

SEQ ID NO: 48767 - DNA, 678 bp, Homo sapiens
  misc_feature: GYAE6OF02H6DJ7.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctccagagaccacggagatattcttttgacacagtctccagacatcgtgtctgtgtctccgaggggganagagcccaccctctcctgcagggccagtcagagtgtcgccgactccttggcctggtaccaaacaaaacctggaccacgcctccgaggctcgtcattcagtggacacgatccaacgacgggccaacgtcggacacgtcccgaggcgtacggttcaggtggcgaggtcggctcgtagggactagtacttcgacttcgtaccgacgtactacgacgtacgtacggttcggtacccgtaacccgttacggtacgttacgtttacgggtaacctttaggtttttaaccttacgttacgttccgaacgtaccgtaacgggttacggccgtaccggttacggaccctttacgtaccgttacccggttaccgggaacccggtaaacgggttccttaacgaccggttagggaacggtaacggtcggaaaccgtaaggttcggtacgtcgtacgacctaaccgtattaccgttacgttacttacccg

SEQ ID NO: 48768 - DNA, 561 bp, Homo sapiens
  misc_feature: GYAE6OF02HRVSL.23.23.C01.1.454.CMB.1.raw
  modified_base (311)..(311): a, c, t, g, unknown or other
  misc_feature (311)..(311): n is a, c, g, or t
  modified_base (384)..(384): a, c, t, g, unknown or other
  misc_feature (384)..(384): n is a, c, g, or t
  modified_base (408)..(408): a, c, t, g, unknown or other
  misc_feature (408)..(408): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaaacaaaacctggccagcctccaggctcgtcattcatggccacatccaacgngggccacgtggcactcccaggcctaggttcaggtcggcaggtcggctcgtggactagtacttcactctcacgntcagcagtcgtccgacctgacgtntttgcttagtttattcgtgctagcacgtgcgtccgtggcctatccctacgttccggaccgaacggtactcggacgtgggaacgacggtaacgaaaccggtacgtaggtcggaccgttcggacctaaccgtagtttcgttacgttcctttaccg

SEQ ID NO: 48769 - DNA, 989 bp, Homo sapiens
  misc_feature: GYAE6OF02IA86Z.23.23.C01.1.454.CMB.1.raw
  modified_base (199)..(199): a, c, t, g, unknown or other
  misc_feature (199)..(199): n is a, c, g, or t
tcagacgcgagtatcacgaccggtgctcgatttagtacacgtgattagggattgggggagaactgctcagtttggacccagagggaaccatggaagccccagctcagcttctcttcctcctgctcctctggctccagagaccaccggagatattcttttgacacagtctccagacatcgtgtctgtgtctcgagggganagagccaccctctcctgcacgggccaggtcagagttggttcgccgtacttccgttcggccttacggtaccaaaccaaaaaaccgtcggacccaacggccctcccgacggtccgttaccgtactacgttcaagtcggtaccaactactacccgaaacggacggggtaccccaacgttcgggaccctaacgtaccccgaacgggtaccgtaacgggttttaccgtaacgggttacgggacccgtaaggggtttccgggtaccggttaccgggtttaacgggggaaaacccgtaacgggttaccctttacccgaacccttttaccccggtaccctaaccgggttaacctttaccgaacgggtacccggtaaacgggttttcccgggttaaaccccgggtaacccccgggtttaacggttaaaccggggttttaacgtttttaccggtaacccggtttttaaacgggtttttttaaccgtttaaaccggttttaccgggttaaccggttaaccggtaacccgggttaaacccgggggttccgggttacccggtaaccccgggtttcccgggttaccccttttaacccggttaccccggtttaaccccgggtttaccccgggttaaaccccggggtaaacggggtaaccccgtttaaccggggtaccgggttacgggggtaaaccggttaacggttaaccgggtaaaaaccggtacggtttcgggtaacggttacccggttaccgtaccgtaacccgttacgtttccggtttacccgttccgttttaacccccgg

SEQ ID NO: 48770 - DNA, 630 bp, Homo sapiens
  misc_feature: GYAE6OF02IRLMR.23.23.C01.1.454.CMB.1.raw
  modified_base (374)..(374): a, c, t, g, unknown or other
  misc_feature (374)..(374): n is a, c, g, or t
  modified_base (446)..(446): a, c, t, g, unknown or other
  misc_feature (446)..(446): n is a, c, g, or t
  modified_base (468)..(468): a, c, t, g, unknown or other
  misc_feature (468)..(468): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagcccaccctctcctgcagggccagtcagagtgttgccgactccgtggcctggtaaccaacaaaaacctggccaagccctaccaggctcgcattcatggccactactacccaacgacgggaccacgtcgcactcccgaggctacgggttcaggtcggcaggtggtcctcgngggacacgtacttccactccgtcaacgtaatccaggaccgtagtcgtaccgacccgttagacgttagtttcncgttaacgttttattaacgttntcgtacacgtaacggtcggcgtccgtgcccttagtccgttaaccggttccggaccgtaaacgggtaccgtccgacgttacgggtacgagttaacggaaaaccggtacgttaggttaccggacgttggaaccctaccgacgtttaccgtcggttaccttaccg

SEQ ID NO: 48771 - DNA, 887 bp, Homo sapiens
  misc_feature: GYAE6OF02GNSG1.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggcctcccagagaccaccggagatattctttgacacagtctccagacatcgtgtctgtgtctcgaggggagagacgccaccctctcctgcgacgggccagtcagagtgtcgccgtacttccgtggccgtacggtaaccaaaccgtaaaaccgtggaccacgccctacccgaggtcctcgtacacttcagtcggacactactacccgaaacgacggggaccctaacgtcggacctaaccgtccccgaagggtaccgtacgggttaccgaaggggttcgggaccgtaacgggttcgggtaccgttaccggggttacggggaaaccgtaacggttaacccgtttaccgtaaccgtttaccgtaaccgtaaccggtaacgtaccgtacggtaccgtaccgggttacgggtaaccccggtaaccccgttagggttaaacccggtttacgtttttaccggaaccgttttaaacggtttttaacgtttaacccggttcggttaacccggaacggttaacccggttaaaccggggttccgggacccgttacccgggttaccgggtaccccttttaaccgttaccccggttaaccccggtttacccgggaacccggttaaaacggggttccctaaccgggtaacggtttacggggaactaaacggttaaaccggggaaaacccggttaccggttacgggtacgggtaacccgtaccggtaaccccgtaaccgttccggtttaccgttccgttacccgtttaacccg

SEQ ID NO: 48772 - DNA, 601 bp, Homo sapiens
  misc_feature: GYAE6OF02FOMS9.23.23.C01.1.454.CMB.1.raw
  modified_base (286)..(286): a, c, t, g, unknown or other
  misc_feature (286)..(286): n is a, c, g, or t
  modified_base (512)..(512): a, c, t, g, unknown or other
  misc_feature (512)..(512): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactccccacgaggaattggtgcagtctgggcctgaggtgaagaagcctggggcatcagtgaaagtcactgcaaggtcttcaggatacaccttcacaaatttgatatcaactgggtgcgacgnggcccctgggaaaaggctcggagtggagtgggcgtgggtgaggtcctagtgttgagaacgtaccggggctattctgagtaagtcgaacggccaggctacgacgcctagaccgtggaacctcttaccgaaggaacgaaaccgacgaccctagtttacggaaacttggccgcggcctcgacctctcgaacaccgaccggtccgtgtatttgtgtcgacgtagacgggngggacggtccggtacggttagttttacgggaattaggttagttcggttagtcgggtaacggttcgggtacggggtaccggtaaccgggg

SEQ ID NO: 48773 - DNA, 712 bp, Homo sapiens
  misc_feature: GYAE6OF02JKMDK.23.23.C01.1.454.CMB.1.raw
  modified_base (202)..(202): a, c, t, g, unknown or other
  misc_feature (202)..(202): n is a, c, g, or t
  modified_base (205)..(205): a, c, t, g, unknown or other
  misc_feature (205)..(205): n is a, c, g, or t
tcagacgcgagtatcacgaccggtgctcgatttagtacacgtgattagggattgggggagggaactgctcagtttggacccagagggaaccatggaagccccagctcagcttctcttcctcctgctcctctggctcccagagaccaccggagatattcttttgacacagtctccagacatcgtgtctgtgtctccagggganagngccaccctctcctgcacgggccagtcagagtcgttgccgactccgtggcctaggtaaccaacaaaacctggccacgcctccaggctcgtcacttcatcgggcactactaccgaacgagggtacctaccgtggacctacgtccccgaggacgtacgggttcacggtcggacgtaaggtcgggaccttacggtcggggaactacggtaactttacccgaaccgttcctaccggtaaccgtaacgtcctaacgggtactacgggtcggttaccccgtacccgtacggttacgttacgttttcggaaccttacggttttaagttactttcggtaccgagggtaccgtaaccgggtcgaccgttccggtacggttcctaacgttccgtaacccgttacgacccggttaacgtaccggtcgttacgacgggtactaacgggtaacggtaacctacggttagggtccggtacgttacgaccctaccttaaggttcccgttagttacccgttacg

SEQ ID NO: 48774 - DNA, 655 bp, Homo sapiens
  misc_feature: GYAE6OF02I6A45.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagccaccctctcctgcagggccagtcagagtgttcgccgactccttggcctggtaaccaaacaaaacctggaccagccctccgaggcctcgtcattcagtggccacactaccgaacgacgggccacgtcggcctactacccgaggacgtagggttcaggtcggacgagggtcggtccgtcggtacgggaacaacggtaccttaccaccttcgtaccgacggtactcgacgtacgtacggttcggtacccgaacccgttggtaacgttacgttttcggactttagttttaacttaccgttagtacgtacgtaccgtacggtcggccgtaccgtcggtacctacgtccgtaccgttcgggaacccgtacgggtactacgggtactagggaacgtaaggacggaaaacgtcggtggtacggacttacgacctacctgtttcgttacgtccttac

SEQ ID NO: 48775 - DNA, 779 bp, Homo sapiens
  misc_feature: GYAE6OF02IYU8R.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattctttgacacagtctccagacatcgtgtctgtgtctccgagggganagacgccacctctcctgcgagggcctaggtcaggtagtgttcgcctacgtccttggccgtacggtaaccaaacaaaaccgtgaccacgcccgtaccgacggctcgtacacttcagtcgacaccgtactacccgaacggacgggtacccaacgtcggacctacgtaccccgaacgggtcgtacggttacgacggtacggcgtaggttcggacgttccggtacgggactacgtacttaccgacgtctacgaacgtactcgacgtacgtaggttccgtaccgtaccgtcgtaaagtttcgttacgacgttaacggttttacttaaacgtttcgtaaccggttaagtaacccgggtacggtacgggttcccgacccggttaccgggttacccttaaccggttaccccggttaacccggttttccccgggaaaaccgggttaaacccgggtaacccgtttaaccggaaccggtttacgggggtaactaaccgggttaaggaaaaccccggtttaacggtcggtacgggtaaccgttacggacccgtaaaccgtttcggtaacgttttccggttccttaaccgg

SEQ ID NO: 48776 - DNA, 655 bp, Homo sapiens
  misc_feature: GYAE6OF02IWVCW.23.23.C01.1.454.CMB.1.raw
  modified_base (202)..(202): a, c, t, g, unknown or other
  misc_feature (202)..(202): n is a, c, g, or t
  modified_base (214)..(214): a, c, t, g, unknown or other
  misc_feature (214)..(214): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctcgaagggganagagccaccctntcctgcgagggccagtcagagtgttcgccgtacttccgttaggccttaggtaacccaaaccgtaaaaaaccgtggacccacggtccctacccgaggccttcgtcacgtttccattcgggacacatacccaaaccggtacgggccaaccgtgggaccaacttcccgaagggcctagggttacaggttcgcaaggtggccgtgtcgggacagtaccgttcgactctacgacgtacgtccgagaccgtagtccggtaccgtaccgtgtaaccgtacgttttgtaccgttagttttacttaacttgtaccgtagttacgacggttgccgtcgtacggacctagtaccgtaccgttccgaaccggtaaacggtcgtacgacgtaggacgtagttaacggaaacgtaagtcggtacgcgttacgctactagtcgtcgttacgtaccg

SEQ ID NO: 48777 - DNA, 611 bp, Homo sapiens
  misc_feature: GYAE6OF02HWE8T.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagacgccaccctctcctgcagggccagtcagagtgttgccgactccttggcctaggtaccaaacaaaaaccgtggccagcctcccaggctcgtcattcatggcacataccaacgacggccacgtcggacactcccgaggcgtacggttcaggtcggcaggtcggtctcgtcgggacacgtacttcactctcacgactacacgcgagtcgtacgtaccgtgtacgtagttcgtacgtacgtttattacttacgtacgtacgtacgtacgtacggcgtccgtcgtccgtacgtccgtaccgtaccggtaccgtacggtacgtaccgtcgtaaaaaaaaggcgtaacgtacgtaaacgtaacgtacggtcggtacgtacgacctaaccgtacgtacgttacgttccgttaccg

SEQ ID NO: 48778 - DNA, 779 bp, Homo sapiens
  misc_feature: GYAE6OF02F401K.23.23.C01.1.454.CMB.1.raw
  modified_base (243)..(243): a, c, t, g, unknown or other
  misc_feature (243)..(243): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagagcctggggcatcagtgaaagtcacctgcaaggccttnaggatacacttcacctaaatttgatatacaacgtgggtgcgacgacggccccgtagggaaaacgggctacggaggtgggaacgtggggcgtggggtagacggtccgtaggtggttggaaggtaacgtacccggggactagttctacgtaaggtaacgttcgaaacggacccgtagggccttaccgacggtcccgttacggacccgtacgggtaaaccctaccgtttaacccgaaggtaaaacgaaccgaacgaccccgtaacgttttacgggtaaaccttcggaccggtacccgggtcccgtaccggtaaccccttccggttacgggaaccgtaacccggtaccgggacccggttaggttaaccttttagttacgggttacggtaacgggtacgggacgggtaccggggtaacggggtacccggtcgggttaacggttttttacgggggtaaacttttaggtttaaggtttacgggttaacggtttagggtaaccggggttccggggttaccgggggtacccggtaacccgggggg

SEQ ID NO: 48779 - DNA, 503 bp, Homo sapiens
  misc_feature: GYAE6OF02FK073.23.23.C01.1.454.CMB.1.raw
  modified_base (213)..(213): a, c, t, g, unknown or other
  misc_feature (213)..(213): n is a, c, g, or t
  modified_base (375)..(375): a, c, t, g, unknown or other
  misc_feature (375)..(375): n is a, c, g, or t
  modified_base (432)..(432): a, c, t, g, unknown or other
  misc_feature (432)..(432): n is a, c, g, or t
  modified_base (485)..(485): a, c, t, g, unknown or other
  misc_feature (485)..(485): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctntcctgcagggccagtcagagtgttgccgactccttggcctggtaccaacaaaaacctggccagcctcccaggctcgtcattcatggcacatccaacagggccactggcatcccaggcaggttcagtggcagtggctcgtgggacaggacttcactctcacgntcagcagtcgtcgaccctgacgtatttgctagttttatactgtcagcaacgtgggcnccgtggcctatccaccttcggccaaggctcgatggagatacgaacgatgtggntcgcacgatctgtcttac

SEQ ID NO: 48780 - DNA, 679 bp, Homo sapiens
  misc_feature: GYAE6OF02GSNHG.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcgaggatacaccttcaccaaatttgatatcaactgggtgcgacacggccccgtagggaaaagggctccgggaagtggagtgggcgtgggtgagtccgtaggtgttagagtaataccgggctagttctcaagtaacgttcgaagggccaggcctcgaacgcctacggtacccgtacgggtaaccaaccgtttaccgaagtaaacgaaacgacgacccgtacgtttacggaaacgttacgccggtaccggccgtacgaccttccgtacggaaccgaacgtacccgggccgttaggttaactttacgtttcggtacggtacggtaagggacgggtccgggacggggtcccggtacggtttaggtttttacgggaagttaaggtttaggtcggtttaggttacgggtacggtttcgggtacggggtaccgtaaaccggggg

SEQ ID NO: 48781 - DNA, 551 bp, Homo sapiens
  misc_feature: GYAE6OF02ILYVL.23.23.C01.1.454.CMB.1.raw
  modified_base (202)..(202): a, c, t, g, unknown or other
  misc_feature (202)..(202): n is a, c, g, or t
  modified_base (380)..(380): a, c, t, g, unknown or other
  misc_feature (380)..(380): n is a, c, g, or t
  modified_base (408)..(408): a, c, t, g, unknown or other
  misc_feature (408)..(408): n is a, c, g, or t
  modified_base (426)..(426): a, c, t, g, unknown or other
  misc_feature (426)..(426): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagacgcccacccttctcctgcagggccagtcagagtgttgccgactccttggcctggtaccaacaaaaacctggccagcctccaggctcgtcattcatggcacatccaacgacgggccactggacactcccgaggcaggttcaggtcggcagtggctcgtgggacaggacttcactcncacgatcagcagtcgtccacctgacgtntttgcttatttattcgtntcagtccgtaacgtggcgccgtggtacctactccgtaccgttccgaccgaaggtcctggacgttgaagtagtacggaaacgagttcgtaggcgtcggacctaaccgtagtccttagtccttaccg

SEQ ID NO: 48782 - DNA, 542 bp, Homo sapiens
  misc_feature: GYAE6OF02JCZLU.23.23.C01.1.454.CMB.1.raw
  modified_base (201)..(201): a, c, t, g, unknown or other
  misc_feature (201)..(201): n is a, c, g, or t
  modified_base (378)..(378): a, c, t, g, unknown or other
  misc_feature (378)..(378): n is a, c, g, or t
  modified_base (423)..(423): a, c, t, g, unknown or other
  misc_feature (423)..(423): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttcgccgactcctggcctggtaccaacaaaaacctggccagcctccaggctcgtcacttcatggcacatccaagcgggccacgtggcatcccaggctaggttcaggtggcagtcgctgtgggacaggacttcactctcgacgntcagctagtcgtccgaccctggacgttagtttcgcttaagttttnttacgtgtcagctaacggtcgcgcgtcgcctatccgtaccgttcggacctaaacggctcgacgtgggacagtaacgaaacgtacgtggtagctcgacgtacccatccgtcttccttacg

SEQ ID NO: 48783 - DNA, 514 bp, Homo sapiens
  misc_feature: GYAE6OF02FR99H.23.23.C01.1.454.CMB.1.raw
  modified_base (201)..(201): a, c, t, g, unknown or other
  misc_feature (201)..(201): n is a, c, g, or t
  modified_base (349)..(349): a, c, t, g, unknown or other
  misc_feature (349)..(349): n is a, c, g, or t
  modified_base (369)..(369): a, c, t, g, unknown or other
  misc_feature (369)..(369): n is a, c, g, or t
  modified_base (434)..(434): a, c, t, g, unknown or other
  misc_feature (434)..(434): n is a, c, g, or t
  modified_base (505)..(505): a, c, t, g, unknown or other
  misc_feature (505)..(505): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaaacctggccagcctcccaggctcgcattcatggcacatccaacagggccacgtggcatcccaggcaggttcagtgcagtggctntgggacaggacttcacgtcncacgatcagtcagtgtcgaccctgtacgactttgctagtttattactgttctagcaacgtggccnccgtggcctatccaccgttcgccgaaggtacctcgcgtaggagacgtgaaacgtacgtgtaggctgcactntctgtctcg

SEQ ID NO: 48784 - DNA, 572 bp, Homo sapiens
  misc_feature: GYAE6OF02GLBJ2.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggagttggggggaggaactgctcagtttggacccagagggaaccatggaagccccagctcagcttctcttcctcctgctcctctggctcccagagaccaccggagatattcttttgacacagtctccagacatcgtgtctgtgtctcagggganagagccacctctcctgcagggccagtcagagtgttgccgactccgtggcctggtaccaacaaaaacctggaccagcctacccaggctcgtcattcatggcacatccaacacgggccacgtggcatcccaggcaggtcagtgcagtgctcgtggacagctcactctcgacgatcagcagtcgtaccgacctgacgtatttgcttagtttactacgtgtcagacgtaacgtggcgtccgtggccttacgtcctacccgttacggacctaaacgggtcctcggtaaccgtgggaactacggttaacggaaacggtaaccgttggtaccggacgttcgaccgtaaccgttacgtccgttacgttcgtttacccg

SEQ ID NO: 48785 - DNA, 706 bp, Homo sapiens
  misc_feature: GYAE6OF02F571E.23.23.C01.1.454.CMB.1.raw
  modified_base (201)..(201): a, c, t, g, unknown or other
  misc_feature (201)..(201): n is a, c, g, or t
  modified_base (312)..(312): a, c, t, g, unknown or other
  misc_feature (312)..(312): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctcgagggganagacgccaccctctcctgcagggccagtcagagtgttgccgactccgttggcctggtaaccaaacaaaaacctggccacgcctaccgacggtctcgtcacttcatggcacntacccaacgcgggaccacgtcggaccactccccgagggaccgtacggttcaacggttcggactacgggtggccgttacggtcggggaactacggtaaccttcgaaccgttccacgtaacggacttaccgacgtcgaacggttcggtacccgacccggttagacgtttacgtttcgacttaagtttttacttacgtcgttactaacgtcgtaaccggttcggccgtccgttgggtacccttacgttcccgtacccggtttaccggaaccgtaaccggggtaccgtccggtaacgtacgggtaacgtacggtaacggaaaacccggttagtcgggttacggacccgttccggaacccgtaaccgttgtttaaccccggtttcgttccttaaccccg

SEQ ID NO: 48786 - DNA, 746 bp, Homo sapiens
  misc_feature: GYAE6OF02JULEJ.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggcctcccagagaccaccggagactattcttttgactacagtcctccagacatcgtgtctgtcgtctcgaaggggagagacgcccaccctctcctgcgacgggccagtcaggtagtgttcgccgtaccttccgttggcccttaggtaacccaaacaaaaacccgtgggaccacgccctaccccgaggtcctccgtactacttcagtcggacacctactaccgaaacgtacgggacccaccgtcgggacctaccgtaccccgagggtaccgtacgggttaccgtaggttacggccgtaacggtcgggccgttccggtacggggaacctaacggtaccttactaaccgttccgtaccgtaaccggacttaccgacgtcgtaacgttccggtaccccaaacccggttcgaaccgtttaacgttttcgacgtttaagttaactttacgtccgttacgacgtacgtaacggtcgggcctccgtacggtccctacgtaccggtacccgtttaccggaccgtaaacgggtcctaccggtacgtacggagtaaccgtaacggtaaaccgtcgttacggccgtacgttcgaacccgtaacgtacgtacgttcgttacccgttaac

SEQ ID NO: 48787 - DNA, 796 bp, Homo sapiens
  misc_feature: GYAE6OF02H75O7.23.23.C01.1.454.CMB.1.raw
tcagacgcgagtatcacgaccggtgctcgatttagtacacgtgattagggattgggggagaactgctcagtttggacccagagggaaccatggaagccccagctcagcttctcttcctcctgctcctctggcctcccagagaccaccggagatattcttttgacacagtctccagacatcgtgtctgtgtctccgaggggagagacgccaccctctcctgcagggccagtcagagtgtgccgactctggcctggtaccaaacaaaactggaccagcctccaggctcgtcattcatcggacacactacccaaacgacgggcccaacgtcgggactaaccgtccccgaagggcctagggttccgaagggttcggaccgtagggttcgggcctttccgggtacggggtaactaacggttaccctttacgtaaccctttccgttacccgaacggtacttaccgaacgtcgtaacggtttccggttaccccggtaaccccgttagggttaaccgtttacgtttttcggacctttaaggttttttaaccttaaacgtttgttaacccgacggttaaccgtaaacccgggtaaaggtaacgggtttccgggaacccctttaacccgtaaagtttaccgtttacccgttaacccggtttttacccgggaccccgttaaggggtaaacccctaaaagggttcgggtaaacttaaccgtaaaccggtaaacccggtaagttccgggttaccggacctttacggacccgtaacccgttactttccggtttaccggttctttaacccg

SEQ ID NO: 48788 - DNA, 585 bp, Homo sapiens
  misc_feature: GYAE6OF02HH9TP.23.23.C01.1.454.CMB.1.raw
  modified_base (311)..(311): a, c, t, g, unknown or other
  misc_feature (311)..(311): n is a, c, g, or t
  modified_base (358)..(358): a, c, t, g, unknown or other
  misc_feature (358)..(358): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggggagagagccaccctctcctgcagggccagtcagagtgttgccgactccttggcctggtaccaacaaaactggccagcctccaggctcgtcattcatggcacactaccaacgngggccacgtggccatcccaggcaggttcagtgcagtgctgtaggacngtactcactctcacgatcagctagtgtccgacctgacgtagtttgcttagtttattacgtcgtactagaccgtacggtcggccgccgttcgggtacccttagttcccgtacccgtttacgggacccgtaaacgggtaccctcggtaacgtcgggaagtacgtagggaaaaccgtacgtacggtcggaccttacggacctacccgtagtccgttggttccttaacccg

SEQ ID NO: 48789 - DNA, 793 bp, Homo sapiens
  misc_feature: GYAE6OF02HGFG8.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagacgccaccctctcctgcagggccagtcagagtgttcgccgactccttggcctggtaccaacaaaacctggaccagcctccaggctcgtcattcatggcacactaccgaacgacgggcccacgtcggaccacgtaccccgaggtaccgtagggttccaggtcggactaacggggttcgggccgttcggtacggggaaccgtacggtaaccttaccgaccgttcctaccgtaacgtactacgacggtacgtacggttccggtacccggtaaccccgttaggtaacccgtttacggttttaccggaccgtttaaacggtttttaccttaacggttacgttaccgtaaaggtacccgttaaaccgggttcgggcccggttcccggttacgggttaccccgttaacgttcccggttaaccccgtttaccggggaacccggttaaaccggggtacccgttaccgggtaacccgggttaggggaacgttaccggtaaaccgggtaaaaccggttaacccgggttagggttaccgggtaccgttaccgggtaccctaacccgttacgtttcccgttaccggtttacccttaacccgg

SEQ ID NO: 48790 - DNA, 802 bp, Homo sapiens
  misc_feature: GYAE6OF02J1R5R.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagagtgcccactcccacgaggaattggtgcagtctgggcctggaggtgaagaagccgtgggcatcagtagaaagtcacgtgacgaaggtcttcgaggtactacctaccgttcaaccgtaaatttgatatacaacgtgggtgcgacacggaccccgtaggaaaacggtcgtagaggtggacgtgggtacgtggggtagtacggttaccgttaggttggttaggtaacggtaaacggttacccggggtacttaaccgtttcgttaacgtaaacgtaacggtttaccgaaacggggttacccgaaggggtcccttacggacgtacccgtacgtaacccgtagggtaaaccctaaccgtttacccgaaaggtaaaccgaaaccggtaccgtacccgttaagttttacgggaaccttacgggccggtaccgggtccgtacgtacccgttaccgtacgggaacccgtaaccgaccgggtacccgttacgtttaagtttacgtacggttcggaacggtacgggtaacgggaccgggtacgggtacccggttacggtttaacgggtttttaggtaaaccggtttaagttcggtttacgggttaacggttcggggttaacggttccggggtacggggtacccggttaacccgggggg

SEQ ID NO: 48791 - DNA, 611 bp, Homo sapiens
  misc_feature: GYAE6OF02G1CRY.23.23.C01.1.454.CMB.1.raw
  modified_base (375)..(375): a, c, t, g, unknown or other
  misc_feature (375)..(375): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagccaccctctcctgcagggccagtcagagttgttgccgctccttggcctggtaaccaaacaaaaacctggaccagccctcccgaggcctcgtctattcatggccacactacccaacgacgggaccacgtggcactcccaggctacggttcaggtcggcgaggtggctcgnggacagtacttacactctacgacgtatcgagcgtagtcggtcctacccgtgtacgtagtttcgacgttaacgttttagttaacgtcgttacacgaccgtaacggtcggccgtccgtacggtaccttacgtccgtaaccgttccgggaccgaacgggtactccggaacgtggacgtacgtaacggaaaccgtacgtggacggtacgtacgacctaacctacgtcgttacgttctacc

SEQ ID NO: 48792 - DNA, 714 bp, Homo sapiens
  misc_feature: GYAE6OF02GGK8U.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagccaccctctcctgcgagggccagtcagagtgttgccgacttccgttggcctcggtaaccaaacaaaacctggccacgcctaccgaggctcgtctattcagtggcacactaccaacgacgggaccacgtcggaccacgtcccgagggcgtaggtttccgaggttcggacgtagggttcgggccttacgggtacggggaccaacggttaccttccgaccttaccgtaccaacggtactcgaacgtcggtacggttcgtcccggtaacccgttggtaaccgttacgttttcggaaccttaggttttaacttacgttacgttaccgtaacggtaccgtaaacgggtcgggtacccgtaccggtcggtacccttacgttacccgtaccccggtttacgggacccggtaaacgggtaccgtccggtacgttacgggacgtaacggtaacggtaaacgtacgttcgggtacggtacctacggacctaccgtacgttccgtacgttcccgttaccg

SEQ ID NO: 48793 - DNA, 690 bp, Homo sapiens
  misc_feature: GYAE6OF02IPOU3.23.23.C01.1.454.CMB.1.raw
  modified_base (131)..(131): a, c, t, g, unknown or other
  misc_feature (131)..(131): n is a, c, g, or t
  modified_base (142)..(142): a, c, t, g, unknown or other
  misc_feature (142)..(142): n is a, c, g, or t
  modified_base (184)..(184): a, c, t, g, unknown or other
  misc_feature (184)..(184): n is a, c, g, or t
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (228)..(228): a, c, t, g, unknown or other
  misc_feature (228)..(228): n is a, c, g, or t
  modified_base (320)..(320): a, c, t, g, unknown or other
  misc_feature (320)..(320): n is a, c, g, or t
  modified_base (349)..(349): a, c, t, g, unknown or other
  misc_feature (349)..(349): n is a, c, g, or t
  modified_base (635)..(635): a, c, t, g, unknown or other
  misc_feature (635)..(635): n is a, c, g, or t
tcagacgcgagtatcacgaccggtgctcgatttagtacacgtgattagggattgggggaggaactgctcagtttggacccagagggaaccatggaagccccagctcagtcttctcttcctcctgctctccnggcctccaagnaccacggtattatacttcgtttagactacagtctaccagatntcgtgtctcgtggtcncggagggtanacgcgcccaccgtctcgngacgcggactagttcagtcgttcgtccgtaccgccttcgtacgaccttaacgaccaacgtaacgtcgaccacgtccctccgtacgtctacgntacctactactcgactaccgactaccganaccggtaccacgcgtaacctcgtacccggtagacgtagtacgacgttcggacgtacggtcgtaccgttcggaacgtaccacgttaccgtcctacgtacgtacccgagtcctaacgtccgtaccgtaacccgttcgttaacccgacgtttcggacctttaggtttctacgttagttacctaggttccgaacgtcgacgtccgtagtccctacgttccgaccttacgggaccttacgggcttacgggaaactcggtacaacggttacgaattaccggcgttaacggtntacccgttagacgttacccgtaggttccgttaccgccgtttaccggtccctacgg

SEQ ID NO: 48794 - DNA, 708 bp, Homo sapiens
  misc_feature: GYAE6OF02H5S72.23.23.C01.1.454.CMB.1.raw
  modified_base (164)..(164): a, c, t, g, unknown or other
  misc_feature (164)..(164): n is a, c, g, or t
  modified_base (202)..(202): a, c, t, g, unknown or other
  misc_feature (202)..(202): n is a, c, g, or t
  modified_base (235)..(235): a, c, t, g, unknown or other
  misc_feature (235)..(235): n is a, c, g, or t
  modified_base (680)..(680): a, c, t, g, unknown or other
  misc_feature (680)..(680): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctgcctccagagaccaccggagattattctttgacncagtcctccagacatcgtgtctgtgtctccgagggganagacgccaccctctcctgcacgggccagtcagngtgttcgccgactccgttggcctaggaacccaaacaaaaaccgtcgaccacgccctccgaggcctcgtcacttcagtacggcactactaccaaccgacgggtccacgtcggacaccgtacccgaaggcctaacgggttccagggttcggaccgtaggtcgggtccgtaccgttacggggaactaacggtaccgtttaccaaccgtcccgtacgtaaccgtactaccggagtaccgtaggttccggtaaccgtacccgtagtaacggttaagttttacggtaccttttaagggttttaacttaccgtttacgggtaactacggtaccgtaacggtcgggtacccgtcggttaaccgtccgttaacgtcccgtaccgtttaaccgggaccgtaaacggtacctacggtacgtggaacgtacgtaacggaaacgtacggtaggtcggntcgactaccgtactcgttcgtcttaccg

SEQ ID NO: 48795 - DNA, 601 bp, Homo sapiens
  misc_feature: GYAE6OF02IWASM.23.23.C01.1.454.CMB.1.raw
  modified_base (356)..(356): a, c, t, g, unknown or other
  misc_feature (356)..(356): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaccaaatttgatatcaactgggtgcgactaggcccctgggaaaaggctcgagtggatgggctgggtgagttcctagtgttgagaagtaccgggcagttcnagaagttcaaggccaggctcgagcctgaccgtggaactcttaccgagaagtaaacacgtaccctaagtttacggaacttcggacggaccggtacctcgaccctacgtcgaaccgacgaccggtccgtacggttaacttagttgtgccgagacggcggaaggtcccggtaacgtggttttacgggaaacgtttagtacgttaggtacgttagggaccgttacggtagggggtacccgtaacggggg

SEQ ID NO: 48796 - DNA, 894 bp, Homo sapiens
  misc_feature: GYAE6OF02HRVJV.23.23.C01.1.454.CMB.1.raw
  modified_base (358)..(358): a, c, t, g, unknown or other
  misc_feature (358)..(358): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggcctcccagagaccaccggagattattcttttgacacagtctccagacattcgtttctgtgtctcgaggggagagacgcccacccgtctcctgcgagggccacgtcagtagtgttcgccgtacttccgttggcctacggtaaccaaaccgaaaaacccgtggacccacgccctacccgaggcctcgtctagttcagtcggcacactaccaaacgacgggccctacgnggcctacgtcccgaggcgtaggttccgaggttggacgtaggtcggtcgttacggtacggggaacctacggtaaccttccgaacctttacccgtaaccgtaaccggtaactaccgtaacgtacccggttaacgggtttcccggttaccccggtaaaccccggtacgggttaccggttttaacgttttttaccggggtacctttttaaacggttttttaaaccgtttaccgtttaccggttaacggtaaccggttaaccggttaaaccggggttccggggtacccggttaccccggtttaccgggacccgttttacccgttaacccccgtttaacccgggtttccccggggtaaacccggtaaaccgggggttacccgttaacccgggtaaccgggttacgggtaaacgggttaaccggtaacccgggtaaaaaaccggttacccggttagggggttaacccggtaccggttaccgtaaccgaaccccgtttagttacccggttttacccggtttaccgtttacccgtttaacccccg

SEQ ID NO: 48797 - DNA, 700 bp, Homo sapiens
  misc_feature: GYAE6OF02FLSGI.23.23.C01.1.454.CMB.1.raw
  modified_base (206)..(206): a, c, t, g, unknown or other
  misc_feature (206)..(206): n is a, c, g, or t
  modified_base (449)..(449): a, c, t, g, unknown or other
  misc_feature (449)..(449): n is a, c, g, or t
tcagacgcgagtatcacgaccggtgctcgatttagtacacgtgattagggattgggggaggaactgctcagtttggacccagagggaaccatggaagccccagctcagtcttctcttcctcctgcctcctctggcctcccagacgaccaccggagatattctttgacacagtctccagacatcgtgtctgtgtctaccgagggganagacgcccacctctccgtgcgagggccagtcaggagtgttcgccgacttccgttggcctacggtaacccaaaacaaaaaccgtcggacccagcccctcccgacggcctacgtactattcagtcggaccacactacccaaacggacgggacctacgtcgggaccacgtccccggaggccgtacgggttctacggtggacgtagggtcggctcggtagggactacgtacctcactcgtacgactntacgacgctaggtcgtacccgtaccgtaggtaccgttagtttcgacgttaacgtttttacgttactacggttacaggaccgtaacggtcgggtcccgttaccggccgggttaccctttaacgtcccgttaccgttccggggaaccgttaacgggacctacggtaccggtagggaactaacggtaacggaaaccggtacgtcgggttacggcgtacgaccgtaaccgttactccgtttacgtaccgttaccc

SEQ ID NO: 48798 - DNA, 592 bp, Homo sapiens
  misc_feature: GYAE6OF02IKW1Z.23.23.C01.1.454.CMB.1.raw
  modified_base (353)..(353): a, c, t, g, unknown or other
  misc_feature (353)..(353): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaccaaatttgatatacaactgggtgcgacacggcccctgggaaaacgggctcggagtggatgggctgggtgagtccgtagtgttgagaataccgggntacgttctcgaagtaacgttcgaaacggccaggcctcgacgcctgaccgtggaacctacttaccgagaagaacacgccctatttcggaactggccgccggtcctcgaccctcacgaccgacgtaccggtccgtggttacttacgttgtcgacgagacggcggagggcccgtggttaagttttgggaacttagttagttggttagtagggtacggttacggtcggggaccgtaacggggg

SEQ ID NO: 48799 - DNA, 914 bp, Homo sapiens
  misc_feature: GYAE6OF02HB9XP.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctggcctgaggtgaagagcctgggcatcagtgaaagtcactgcaaggcttcgaggataccaccttcacctaatttgatagtactaacgtgggtagacgtaactacgggtaccccctagggaaaaacgggtcctacggtaacggtacggtaacgttcggggaccgttaggggtacggtaacggttcccgttaaggttcgggtttacggaacggttaaaccggtaacccgggggtacctaacggttttaccgtaccggtaaaggttaaaacggttttaccggaaacggggtacccgaaggggtcccttacggaacggtacccgttacgggaaccccgttagggaaaccttaaccgtttacccgaaggtaaacggtaacctaacggaccccgttaagtttacggaaaccgttcgggacccggtaccggtacccgttaacgggtaccccgttaccgtaaccgggtaaacccgggttaacccgtaacccggggttacccgggtttaacggttaaccgtttttaaacggtttcgggtttaaccggacccgggttaaacggggtaccggggttacccggggttaaccgggtccccgggttaacgggttttaaaccggttttttacgggggaaaaccgttttacggtttaacgggtttacggggtttaacgttaccgggggttaacccggtttacggggttacccggggggtaacccggttaaacccggggggg

SEQ ID NO: 48800 - DNA, 797 bp, Homo sapiens
  misc_feature: GYAE6OF02HYGXT.23.23.C01.1.454.CMB.1.raw
  modified_base (202)..(202): a, c, t, g, unknown or other
  misc_feature (202)..(202): n is a, c, g, or t
  modified_base (391)..(391): a, c, t, g, unknown or other
  misc_feature (391)..(391): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggcctccagagaccaccggagattattcttttgacacagtctccagacatcgtgtctgtgtctccgaggggnagagccaccctctcctgcagggccagtcaggagttgtcgccgtactccttggcctaggtaacccaaaaccaaaaacctggaccacggccctacccgaggtcctcgtctatttaccgaagtcgactactaccaacgtaacggaccggacctacgtcgaacctaccacccggtacgtacgttacgtacggnggtacgtaggtaggtcggtcgtacgggtacgacgtaaccgtctacgtacctaccgtacgaacgttacgtaacggtacgtaccgttacggttacccggtaaccccggtacgttaacgggttaacgtttttaccgttacggtaccgtttttaacgttttaaaccttcggtttaaccttacgggtaaaccccgttacggaacccgggttccgggtaacccggttcccggtaccgttaacccgtttcctacccgggttacccggttaaccggtaaccggggtaacccgtaacccggtaccgttacgggaacggtaggtaaaccggtaaccggtaaaccggttgggtaccggtacccgtacgtaccgtacccgtaaccgttccggttaccgtttacgttcccttaaacccg

SEQ ID NO: 48801 - DNA, 572 bp, Homo sapiens
  misc_feature: GYAE6OF02G2JVE.23.23.C01.1.454.CMB.1.raw
  modified_base (199)..(199): a, c, t, g, unknown or other
  misc_feature (199)..(199): n is a, c, g, or t
  modified_base (403)..(403): a, c, t, g, unknown or other
  misc_feature (403)..(403): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctccagagaccaccggagatattcttttgacacagtctccagacatcgtgtctgtgtctcgaggggnagagccacctctcctgcgagggccagtcagagtgttgccgactcctggcctggtaccaaacaaaacctcggaccacgccctcccaggctcgtcattcagtggcacgactacccaacgacgggtccacgtcggcacgtcccgaggccaggttccaggtcggcaggtggctcggtgggacaggtacctcgactcacgacgacgtcncgtctaggtcgtcgacccgtgacgttctttgacttagtttaacttcgtgtactagaccgtagtcggcgcgtcggtcctagtccctacgttcggaccgtacggtactcgacgtggaacgtagtaacgaacgtacgtgtacggcgtagaccgaccgtatccgtgtcttacg

SEQ ID NO: 48802 - DNA, 725 bp, Homo sapiens
  misc_feature: GYAE6OF02HK4XT.23.23.C01.1.454.CMB.1.raw
  modified_base (216)..(216): a, c, t, g, unknown or other
  misc_feature (216)..(216): n is a, c, g, or t
  modified_base (220)..(220): a, c, t, g, unknown or other
  misc_feature (220)..(220): n is a, c, g, or t
  modified_base (232)..(232): a, c, t, g, unknown or other
  misc_feature (232)..(232): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattctttgacacagtctccagacatcgtgtctgtgtctccgaggggagagacgccacctctcngcgngggccagtcagngtgtcgcgtactcgtcggctaggaaccaaacaaaccgtggaccacgcctccgaggctcgtctattacagtgacctacacgtaccgaacgacggtacccacgtcggaccactacccggaggtccgtacggttaccgaggtaccggcgtaggtcggtccgtcggttacgggaacgacgttaccgtacctacgttccgtacgaaccggtacgttacacgtacgacgggtttaccgaccgtacccgtaggtaccgtttagtttaccgacgttagttttaccttagttaccgtagaaccgtacggtacgggtccgggtccgtacccggtagggtcccttaaccgtaccgttaccccggttcgggaacccggtaaacgggaccgttaccgggttacggtacgggttaacgaacgggttaaaccggtaaaaccggttacgtcgggtaccggacctacgggtacccaaccggttaagtttcctaccggtttaccttacccg

SEQ ID NO: 48803 - DNA, 564 bp, Homo sapiens
  misc_feature: GYAE6OF02FH4PN.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagcccaccctctcctgccagggccagtccagagtgttgccgactccgttggcctggtaccaacaaaaacctggccagcctcccaggctcgtcattcatggcacatccaacagggccactggcatccccaggcaggttcaggtcggcagtggctcgtgggacagacttcaactctacacgatcagcagttcgaccgaccctggaccgtagttttcgctaggttttattacgtgtcagtcaacggtggccgcctgggccctagtccaacccgtttccggaccaaacgggtcctaccggacgtcggaagacgtacggaaaccgtactggtacgacgttcgccaaccgatccgtagtccttaccg

SEQ ID NO: 48804 - DNA, 667 bp, Homo sapiens
  misc_feature: GYAE6OF02JFNUO.23.23.C01.1.454.CMB.1.raw
  modified_base (205)..(205): a, c, t, g, unknown or other
  misc_feature (205)..(205): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagacccaccggagattattcttttgacacagtcctccagacatcgtgtctgtgtctccgagggganagacgcccaccctctccgtgcagggccagtcagagtgtcgccgactccgtggccttaggtaccaacgaaaaacctggccagccctccaggcctcgtcattcactggcacatccacgacggcctacgtggaccactcccgagggcctacggttccaggtcggcgacggtcgggtctacgtgggaactacgtacgttctaacctctaccgacgtacttaccgagtaccgtagttaaccggtccgtaacccgtggtaaccggttattttcgacgttagttttaacgtacttgtacgagtcgaacggtcggccgtaccgtcggtaccttacgttcctaccgttacccgggtaacgtaaaccgggtccgttaccggtacgtagggaacgtacggttaaacggtaaaccggtacgttaccggtacggtaccgtcggacctaaccgtacgtacgttccgtactttaccg

SEQ ID NO: 48805 - DNA, 755 bp, Homo sapiens
  misc_feature: GYAE6OF02GCGMI.23.23.C01.1.454.CMB.1.raw
tcagacgcgagtatcacgaccggtgctcgatttagtacacgtgattagggattggggggaggaactgctcagtttggacccagagggaaccatggaagccccagctcagcttctcttcctcctgctcctctggctcccagagaccaccggagatattcttttgacacagtctccagccacctgtctttgtctccgaggggacagacgccaccctctcctgcacgggccagtcagagtataacaactgcgcacgccgtggtacgaccaaaacaaaaaccgtggcccaagggcctaccccgaaggcctccctcattccgttagactcgccctaccgtaacgtaccgggtcccgtcggtaccggtcccgtacggtcccgtaacgggttcaagggttcggacgtacgggttcgggtaccgtaggggaacctacggtaccgttacctacgttaccgtacctacccgtagtacccgaaggtacctacggtcccgtagggacgtaccgtaggtaaacgtttagtttttacgggtttactttacggttacgttacggtacgtaaacggttaacccgttagtaccgtaacgttaggttaaccttacgtttacgggaccggtaacggggtacctaacgggtacgtagggaacgttacgaccggtaagtacggtaacggttcgttacggaccgtaaccggacctacgttaccgtcgtttacctttacctcgttaccccgttcccgtaccgtacctacggttaaccg

SEQ ID NO: 48806 - DNA, 628 bp, Homo sapiens
  misc_feature: GYAE6OF02IXN2A.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgagaattggtgcagtctgggcctgaggtgaagaagccgtgggcatcagtgaaagtcacctgcaaggctcaggatacaccttacaacctaattgaatatacaacgtgggtagcgacgacggaccccgtagggaaacgggctcggaggtggagtggacgtgggtgtagtcgtagtgttagagtaacgtacgggactagttctagtaggtaagttacaacggccaggtctacgacgtcctacggaccgtacggtaacctaccttaccgaagaacgaaccacgtaccctaagttacggaacgttcgccgtaccggcctacgtaccctcgtcgaccgaccgccggtcgttgtacgtttagtgtcgagtgaggcggacggtccggcgtttagttttacgggtaagtttagttaggttaggttacggttacgggtacgttcgggtacgggaccgtaacggggg

SEQ ID NO: 48807 - DNA, 179 bp, Homo sapiens
  misc_feature: GYAE6OF02IXZA3.23.23.C01.1.454.CMB.1.raw
  modified_base (149)..(149): a, c, t, g, unknown or other
  misc_feature (149)..(149): n is a, c, g, or t
  modified_base (167)..(179): a, c, t, g, unknown or other
  misc_feature (167)..(179): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccacganatattctttgacacatcnnnnnnnnnnnnn

SEQ ID NO: 48808 - DNA, 788 bp, Homo sapiens
  misc_feature: GYAE6OF02JQGRV.23.23.C01.1.454.CMB.1.raw
  modified_base (206)..(206): a, c, t, g, unknown or other
  misc_feature (206)..(206): n is a, c, g, or t
tcagacgcgagtatcacgaccggtgctcgatttagtacacgtgattagggagttgggggaggaactgctcagtttcggacccagagggaaccatggaagccccagctcagcttctcttcctcctgctcctctggctcacagagaccaccggagattattcttttgacactagtctccagacatcggtgtctgtgtctcgagggganagcgcccacctctcctgcgacgggcctagtcaggtagttgttcgaccgtactccgttggcctacggtaaccaaaccaaaaccgtcggccaacgtccctccgacggccttcgcctacttaccgagtcggctaactacgtacccgtaacgaccgggtacccacgttacggaccaccgtccccgaggggtacgtacggttacgacggtcggacgtacggtcgtcgtacggtagggaccacgttacctacaccttcgacgtaacgtacttaccggagtaccggtagttacccgaccggttacccgtgggtaacccgtttaagttttccggtacttaaacgggtttttacctacgttacgggttaaccgttaccggtaaccggtaccgggttaacgggtcccctaccggtttaccggtacccttacggttaccccgtttacccgggtaccgggttaaacccgggtaacggggtaccctttaccgggacgttttacgggaagtaaaccggtttacgggtaaaacgtacccgggttaggtccgttaccgttacgacccgtaccgttacgtttaccggttactttacccg

SEQ ID NO: 48809 - DNA, 614 bp, Homo sapiens
  misc_feature: GYAE6OF02I08CI.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagcccaccctctcctgcagggccagtcagagtgttgccgactccgttggcctaggtaaccaaacaaaaacctggaccacgccctccgaggctcgtcattcatggacacactaccaaacgacgggccacgtggacactcccgaggcaggttcagtggcagtggctcgtggacagtacttcactctcacgtatcagctaggtcgtaccgacccgtgacgtattttgacttaagtttacttacgtgtacagactaacggtggccgtccgtggacccttataccgtacccgttccgggaacccgtaaagggtacctaccgtacgtacgggaagtacgtaacggtaaaccggtaaccgttagggtacggtaccgttacgacctaaccgtaacttccgtttaccggtaccttaccg

SEQ ID NO: 48810 - DNA, 613 bp, Homo sapiens
  misc_feature: GYAE6OF02GUDMU.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagcccacctctcctgcagggccagtcagagtgttgccgactccttggcctggtaccaaacaaaacctggccagcctccaggctcgtcattcatggcacactaccaacgacgggccaacgtcggcctacgtccccgagggctacgggttcaggttcggcgtaggtggcttcgtagggactagtacttcacttcacgacgtatcgacgctagtcgtacgaccctagtacgttagtttcgacttagtttacttactgtacacgtacgtaacggtcggctccgtacggtccttagtcccgtaccgttacggaccgtaacggtaacctccggtacgtcgggaagtacgtaacgggaaacgtacgtaggtacgggtactacggacctaccgtagtccgttacgtaccttaacccg

SEQ ID NO: 48811 - DNA, 766 bp, Homo sapiens
  misc_feature: GYAE6OF02J2FCO.23.23.C01.1.454.CMB.1.raw
  modified_base (193)..(193): a, c, t, g, unknown or other
  misc_feature (193)..(193): n is a, c, g, or t
  modified_base (206)..(206): a, c, t, g, unknown or other
  misc_feature (206)..(206): n is a, c, g, or t
tcagacgcgagtatcacgaccggtgctcgatttagtacacgtgattagggagttgggggaggaactgctcagtttggacccagagggaaccatggaaggccccagctcagcttctcttcctctgctcctctggctcccagagaccaccggagatattcttttgactacagtcctccagacatcgtgtctggtntctccgagggganagagtcctaccgtctccgtgcgaggccagtcagacgtgttcgccgtactccgttgggcctggtaaccaaacaaaaccgtcggaccagccctacccaggcctcgtccattccgagtcggaccactacgtccgaacgacgggccctacgtcgggaccacttaccccgaggtaccgtaggttacacgggtcggacgtagggtccgggtcttaccgggtagggaacctaacggtactttacccggaacctttaccgaccgtaacgggtactaccggacggttacccgacgggttaccgtacccggtaaaccccgttggtaaaccggtttacttttcgggaaccttttaacggttttattaaccgttcggtaacgtaccgtaacggtaaaccggggttcgaaccggttcccgttacgggtacccttacgttacccgtaaccgtttcgggaaacccgtacggggttacctacggacggtaacggtacgaacggtaaccggtaacgtaacgttgggaccgtcctacgggtacctaacgttacgttaccgttacgttacccgttaccg

SEQ ID NO: 48812 - DNA, 651 bp, Homo sapiens
  misc_feature: GYAE6OF02G94J1.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagcccacctctcctgcgacgggccagtcagagtgttcgccgactccttgggcctaggtaccaacaaaaacctggaccagcctaccgaggctcgtcattcatggcacactccaacgacgggccacgtcggaccacgtcccgaggtctaacgggttcaggtcggacgtaggtcggtctcggtacgggaccgtaggtaccgttacctacgtaccgttacgacgtacgtacgacgtacgtcgtacgtacccgacgtacgtagtttacgttacgtagtttacgtttacttacgtcgtacgacgtacgtacggtcgtccgtcgtaccgtacgtacgtaccgtccggtaccgaaccggtaccggtaccgtacgtacgtacggacgtaaggtaaccggtaacggttacgtcggtacggtctacgaccgtacgttacttcgttacgttccgtaccg

SEQ ID NO: 48813 - DNA, 682 bp, Homo sapiens
  misc_feature: GYAE6OF02JKP1N.23.23.C01.1.454.CMB.1.raw
  modified_base (203)..(203): a, c, t, g, unknown or other
  misc_feature (203)..(203): n is a, c, g, or t
  modified_base (653)..(653): a, c, t, g, unknown or other
  misc_feature (653)..(653): n is a, c, g, or t
tcagacgcgagtatcacgaccggtgctcgatttagtacacgtgattagggattgggggagggaactgctcagtttggacccagagggaaccatggaagccccagctcagcttctcttcctcctgctcctctggctcccagagaccaccggagatattcttttgacacagtctccagacatcgtgtctgtgtctccaggggganagagccacccgtctcctgcagggccagtcagagtgttgccgactccgttggcctaggtaccaacaaaaacctggaccagcctccgacgcctcgtcacttcagtggacacactccaacgacgggaccacgtcggacactacccgacggactacgggttaccagggttcggccgaaggttcggaccttcggtacgggacgtacggtacttcccgaacttcctaccgacgtacgttacgacgtaccgtaacggttcgttacccggaacccgttggtaacgttacgttttcggacgttaacggttttaccttacggttcgttacgacggtacgttaaaccggtcgggaccttccggtacggttcctaacgttccgaccgtttccggaacccgtaaagggaccttcggaacgtagggacgagttaacggaaacgtacgtggtacgtaccggtacnccgtaccgatttccgttagttaccttacg

SEQ ID NO: 48814 - DNA, 774 bp, Homo sapiens
  misc_feature: GYAE6OF02F3EZE.23.23.C01.1.454.CMB.1.raw
  modified_base (203)..(203): a, c, t, g, unknown or other
  misc_feature (203)..(203): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtcctccagacatcgtgtctgtgtctccgagggganagagccaccctctcctgcagggccagtcaggagtgttgccgactccgttggcctaggtaaccaaacaaaacctggaccagtccctaccgaggtcctcgtcattaccagtcggacacactacccaaacgcgggcctaacgtcgggacctaacgtaccccgaggaccgtacggtttaccaagggttcggaccgtagggtccggtcgttacgtacggggtacaacggtaccgttccaaccgttcctaccgtaaccgtaactacgtaaccggtacgtaacggttccgggtacccggtaacccgttacggtaaaccgttacgtttttacgaaccgtttaaggtttttaaaccgtttacgtacggttacgtaacgtaccgtaaacgggtcgggtacccgttcggttaccggtacccgttaactcccgttaacccggtttaccgggaacccgttaaacgggtaccctaccgggtaccgttagggaaccgtaacggttaaaccggaaaccggtaacgttacgggtaccggtacgttaccggaaccctaacgtaccgttaccggttcttacccgttaccg

SEQ ID NO: 48815 - DNA, 689 bp, Homo sapiens
  misc_feature: GYAE6OF02GY72P.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagcatcgtgtctgtgtctccgagggganagacgcccaccctctccgtgcgagggccagtcagagtgttgccgactccgttggcctacggtaccaaaccaaaaaccgtggacctacgcctaccgaggcctcgtcattcatcggcacactaccgaacgtacggcctacgtcggaccacgtcccgaggcctacggttcgaggtcggcgtaggtcggtaccgttcggacgggtactacggtacttaccgaaccttccgtaccgacgtaactaccggacgtaccgtaacggttccgggtacccgaacccgttacggtaacggttacgtttacgacgtttagtttaacgttcttacggactacgtcgtaacggtcggaccgtccggtacgtaccttacgtaccctaccgtttaccgggaccgtaacgggtaccgtacggtacgtacgggtaacagggttaacggaaaccggtaggtcggtacggacttacgaccgtactacgttcgttaccgttcttacccg

SEQ ID NO: 48816 - DNA, 671 bp, Homo sapiens
  misc_feature: GYAE6OF02FGB83.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaccaaatttgatatcaactgggtgcgacacggcccctaggaaaacggctacggagtggagtgggctgggtgagtcctagtgtgagatacgggcattctcagtagttcaaggccaggctcgagcctgaccgtggaactaccttaccgaagaaacgaacacggacccctaagtttacgggaaccttcggaccggtccgggtacccgttcggtaccccttaccgtaccggtaaccgaccgtacccgggtacccggttaggtttaactttaacgttcggtcggtacggtaacgggtaacgggtccgggacgggtcccggtaacgggttaagttttttaacgggggaaactttacggtttaagttacgggttacggttacgggtaccggttcgggttaccgggggtaccgtaaccggggg

SEQ ID NO: 48817 - DNA, 615 bp, Homo sapiens
  misc_feature: GYAE6OF02I39O5.23.23.C01.1.454.CMB.1.raw
  modified_base (201)..(201): a, c, t, g, unknown or other
  misc_feature (201)..(201): n is a, c, g, or t
  modified_base (319)..(319): a, c, t, g, unknown or other
  misc_feature (319)..(319): n is a, c, g, or t
  modified_base (389)..(389): a, c, t, g, unknown or other
  misc_feature (389)..(389): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccacctctcctgcagggccagtcagagtcgttgccgactccttggcctggtaccaacaaaaacctggaccagcctaccaggctcgtcattcagcgcactcacaacgcgacctgngactcacgagcgtacgtcagtcgactaggtcgcgttcggaggacacgtactacacttccgacgtacgtanacgagtacctagttccgacctaccgtagtacttagttcgactttacgtttacacgttcgtacacgtacgtaagtcggtccgtccggtacgttaccgtaccgtaccgtacccggttcgaccggtaacgtaccgtacgtacgtacggaacgttacgtaacggaaaacgttcggtacggtacggtaccgtacggtacccaacttacggttacgttcggttaccttaccg

SEQ ID NO: 48818 - DNA, 586 bp, Homo sapiens
  misc_feature: GYAE6OF02HOBNI.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagacgccaccctctcctgcagggccagtcagagtgttgccgactctggcctggtaccaaacaaaacgtggaccacgcctccaggctcgcattcagtcgcacactaccaacgacgggccacgtcggaccactcccgaggctaggttcaggtcggacaggtcggctcgaggacagtacctcactctacgacactcagctagtctaccgaccgtgacgttagtttcgattacgtttattaacgttgtacgtagacgtaacgtgccgtcgtacggacctagtccgtaccgttcggaccgtaagggtacctcggtacgtaggacgtacgtaacgtaaaccgacttacgggtacgaccgtgtacccgacttacgtcttacgttacttaccg

SEQ ID NO: 48819 - DNA, 780 bp, Homo sapiens
  misc_feature: GYAE6OF02JDH7Z.23.23.C01.1.454.CMB.1.raw
  modified_base (153)..(153): a, c, t, g, unknown or other
  misc_feature (153)..(153): n is a, c, g, or t
  modified_base (204)..(204): a, c, t, g, unknown or other
  misc_feature (204)..(204): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggcctcccagagaccaccggganatattctttagacacagtctccagacatcgtgtctgtgtctccgagggganacgcgccaccctctcctgcacgggccagtccagtaggttgttcgaccgtactccgtggcctaggtaccaaacgaaaaccgtcggccacgtcccgtcccaagggtcctaccggtactacttccgtacgtcggacctactacgtaccgtaacgacgggacccctacgtacgggacctaccgtaccccggtaggtcccgtaggttaccgtaacggtcggacctaaggggttccggtacccggttaccggtttacggggaacctacgttaccgttttaccgacctttacccggtacgtaaccgtacgtacgaaccggtacggttaccggtcggtaccctacccggtgtaaccggtttaactttcggaccgtttaacgtttttacgttacccgtccggttaagaacccggttaggtaaaccggtccgggtaacccggttacttacccggggtaccctttacgggtacccttacccgggtttccggaaccggtaggtaccctaggtacccgtggtaacgtacgtacggtaaacttcgtacgtacgtaccgagtaccctggtaaccgtcgtcgtaccttaccg

SEQ ID NO: 48820 - DNA, 693 bp, Homo sapiens
  misc_feature: GYAE6OF02G5BKG.23.23.C01.1.454.CMB.1.raw
tcagacgcgagtatcacgaccggtgctcgatttagtacacgtgattagggattgggggaggaactgctcagtttggaccccagagggaacccatggaagccccagctcagcttctcttctcctgctcctctggctcccagagaccaccggagatattcttttgacacagtctccagacatcgtgtctgtgtctccaggggagagagccacctctcctgcgacggcagtcagagtgttgccgtactccgttggcctggtaccaacaaaacctggccagcctcccaggcctcgtcattcatgcactatccaactagggcctacgtggaccatcccgagaccgtaagtttcgaaggttcggccgtaaggtcggtccgttacggttagggacctaaggtacccgtttcgaacccgtcgttacccgaacgtacttccgaagtaccgtagtcggttacccgtcccgttaacggtaacgtttagttttcggaaccgtttaacggtttttacgttaaccttggttacccgtacggaccgtaacgggttcgggccgtccggtaccgggtaccttacctaccggtaccccggtttccggaaccggttaaaccggggccttaccgggaccgtggaacggtacgttaacggaaaccgttagtacggtacggtctacggacaccgttatccggttatccttaaccg

SEQ ID NO: 48821 - DNA, 583 bp, Homo sapiens
  misc_feature: GYAE6OF02HN6PS.23.23.C01.1.454.CMB.1.raw
  modified_base (325)..(325): a, c, t, g, unknown or other
  misc_feature (325)..(325): n is a, c, g, or t
  modified_base (350)..(350): a, c, t, g, unknown or other
  misc_feature (350)..(350): n is a, c, g, or t
  modified_base (497)..(497): a, c, t, g, unknown or other
  misc_feature (497)..(497): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaccaaatttgatatcaactgggtgcgacaggcccctaggaaaacgggctcgagtggagtgggcgtgggngagtcctagtgttgagataccgggnattctcagaagttcgaaggccaggctcagcctagactacggaacacttaccgaacgaaagaaccacggaccctagtttacggaacttggaccgccggcctgaaccgtctagaccgacgacggccgtgtagtttagttgtgacgtagnggcgggtaggccggtcggttacgtttttaggggaatttacgttagtcggttagttgggacgttcggttaggggcccgtaaacgggg

SEQ ID NO: 48822 - DNA, 543 bp, Homo sapiens
  misc_feature: GYAE6OF02GJPH0.23.23.C01.1.454.CMB.1.raw
  modified_base (354)..(354): a, c, t, g, unknown or other
  misc_feature (354)..(354): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaccaaatttgatatcaactgggtgcgacaggcccctggaaaaggctacgagtggatgggctgggtgagtccttagtgttgagaagtaccgggcattcncagaagttcaggcaggctcagcctgacctggaactacttaccgagaacgaacacgccctaatttacggaactggaccgcggcctcgacctcgcgacgacacggccgtgtattagttgtcgcgagaggcggaggccgcgtagttttgggaattattagttagtagttggacgtcgtgggccgtaacgggg

SEQ ID NO: 48823 - DNA, 848 bp, Homo sapiens
  misc_feature: GYAE6OF02ITS3L.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagccaccctctcctgcacgggccagtcaggtagtgttgcccgtactccgtggcctggtaaccaacaaaaacctggaccacgccctccaggcctcgtacattcgatggcacgatcccgaacgacgggccacgtggtaccacgtaccccgagggtccaacgggttttcaacggttcgggaccgtacggttcgggccgttacggtacggggtaacctaaggtaacccttttaccgaacccgtttaccgtaaccgtaaccgggtaactttacccggtaacggtacccgtaaacgggttccgttacccccggtaaccccgtttacggggttaaaccgttaacggttttttaccgggaaacccgttttaaccgggtttttttaaccgtttaaacggttcgggtttaaccgtaaccgggttaacccgtaaaccgggttcggggtacccgtacccggtttaccgggtacccttaaccggtacccgtttacccgggtttacccggggaacccggttaaacggggtaccctttaaccgggggaccgtttaaggggaaccgttaacggtaacgggtaaaaaccggttacggtccggtacgggtcctaaccggtccgtaaccctacggtttaccggttccgttaccgtttacccgg

SEQ ID NO: 48824 - DNA, 767 bp, Homo sapiens
  misc_feature: GYAE6OF02GFSGS.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtcgcccactcccacgaggaattggtgcagtcgtggcctggaggtgaagaagccgtggggcatcgagtagaaagttcaacctgacgaaggtcttgaggactaactaccttaccgaacctaaatttgattactacgaaacgtgggtgacggacgacggacccgtagggaaacggctacgagtaggacgtgggtcgtagggtgtacgtccgtaggttgtaggaggtaaacgtaccgggcgtacttccgtagtaacgtaacgttacgaacggtacccgaggtccgtactacgtaccgttacggtaccgtaacggtaaccgaccgttaaccgaacggtaacggaaacctaccgtacccgttaacgtttaacggaaccgttacggaccgtacccggtccgttaacgcccgttaccgtaccggaacgtacccggtacccggtacgtttaggttaaccgtttaagttcggttacggaccggtacggggtacggtaccgggtacggggacccggttcggttaaaggttttttcggggaaagtttaaccggttttagtacggttacggttaccggttaccgggttccgggttaccgggggtaacccgtaacccggggg

SEQ ID NO: 48825 - DNA, 726 bp, Homo sapiens
  misc_feature: GYAE6OF02HT2VT.23.23.C01.1.454.CMB.1.raw
  modified_base (151)..(151): a, c, t, g, unknown or other
  misc_feature (151)..(151): n is a, c, g, or t
  modified_base (205)..(205): a, c, t, g, unknown or other
  misc_feature (205)..(205): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccgganatatttcttttgacacagtctccagacatcgtgtctgtagtctccgaggggganagacgtcccgaccctctcctgccagggccaagtacagagtagttcgccgacttccgttaggcctaggaaccaaaacaaaaaccgtcggccacgtcctaccgaggcctacgtccagttcaagtcggaccaacctacgtaccgaaaccgacgggcccaacgtcgggacccaacgtccccggaaggaccgtacgggttacgaagggttacggtacgtaaggttccgggtctcggtaacggggtaacaaccggttaaccttccaaccttcgtaccaacggtactccgaacggtactacggtacgtaccgacccgtagtaacgtaacttttgaccttaagtttaactacttcgacgtaagtaccgtaacggcgggtacgttcccggacgttaccctacgttaccgtacccgttaccggaaccggtaaagggcccttagggtaaccgtagggtacgaacgtaacgggtaaaaccgacgttgggtctaccgttagacccgtacttacggttcttcggtaccttacccg

SEQ ID NO: 48826 - DNA, 679 bp, Homo sapiens
  misc_feature: GYAE6OF02G9SCW.23.23.C01.1.454.CMB.1.raw
  modified_base (606)..(606): a, c, t, g, unknown or other
  misc_feature (606)..(606): n is a, c, g, or t
  modified_base (664)..(664): a, c, t, g, unknown or other
  misc_feature (664)..(664): n is a, c, g, or t
tcagacgcgagtatcacgaccggtgctcgatttagtacacgtgattagggattgggggaggaactgctcagtttggacccagagggaaccatggaagccccagctcagcttctcttcctcctgtcctcctcgtcggcctcccagacgaccgacggagattatttctttgacacagtctaccagactatcgtgtctgtcgtctcggaggggagagacgcccaccctctccgtcgacgacgggccagtacgagtagttcgtcgcccgtacttccgttacggccttacggtaaccaaaaccaaaaccgtcggaccacgcccctaccgaggtcctcgtactattcacgtcggaccacgtactacccgaacggaccggaccacggtcggactacccgtacccggacggcgtaacggttcgacgggtcggacgtagggtcggtccgttacgggtagggactacggtacttacctaccgttcaccgacgtctacgacgtacgtacggtcggtacccgaccgttgtacgtttagttcgtaacttagtttacttgttacgagtacgtcgtaacgggcgtccgtcgtaccgtcttactaccgtccgttacccgggngtaacggcgtacgagaggacacggaacgaaccgagtcggtagacgtacgactaccgtnttactcgtaccttcg

SEQ ID NO: 48827 - DNA, 750 bp, Homo sapiens
  misc_feature: GYAE6OF02JX62F.23.23.C01.1.454.CMB.1.raw
  modified_base (152)..(152): a, c, t, g, unknown or other
  misc_feature (152)..(152): n is a, c, g, or t
  modified_base (170)..(170): a, c, t, g, unknown or other
  misc_feature (170)..(170): n is a, c, g, or t
  modified_base (181)..(181): a, c, t, g, unknown or other
  misc_feature (181)..(181): n is a, c, g, or t
  modified_base (309)..(309): a, c, t, g, unknown or other
  misc_feature (309)..(309): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggcctccagacgaccaccgganattatttctttagacacncgtctccagangtcgtgtctgtgtcacggaggggagagacgcccctacctcctcgtgaacggtcggcctagtacaaggtgttcgtccgcctccgttcgtccgacgtaaccgtaaaccaaaaccgtaaacgccgaccgcncccgtaccgcgtccgttcgactacgtctaggtcgcccaactaccggaacctttacggcgggggttaaccctacgggccgtaccgtaccgaacggtcgtacggtacgtaccggttacggacggtaccgtaacggcccggttcgaacgtacccgttacgtaacctacgtaccgtaccgtcgaccgtacggtaccgaccggttacggtaccgaaacccctttccccgggggttattacgtacgtttagtacttaggttactacgtaccctaacggtcgtaccgcgttaccgaccgttccgtcctaaccgtacctccggtaaccgttccggaacgtaaccgaacggtacgtaggaacggtacgtcgaaacgttaaccgtaaccttcggtacggtaccttacgtccgtttacctccgttaccttaccgtcctacgttaccctaccg

SEQ ID NO: 48828 - DNA, 825 bp, Homo sapiens
  misc_feature: GYAE6OF02JOAU1.23.23.C01.1.454.CMB.1.raw
  modified_base (191)..(191): a, c, t, g, unknown or other
  misc_feature (191)..(191): n is a, c, g, or t
  modified_base (203)..(203): a, c, t, g, unknown or other
  misc_feature (203)..(203): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctccagagaccaccggagatattctttgacacacgtctaccagacattcgtgtctcgtntctcgagggganagacgccaccctcgtccgtcgacgtacgggcctaggtccaggtagtgttacgccgtacgtccgttcggacctacggtaaccaaaccgtaaaaccgttcggacccacggccctacccgacggtacgtaccgttacgtacttaccgagtcggtacacctaacttaccgaaccgtacggaccctacggttacggacctaccgtacccgacggaccgtaacggttaccgtacggtcgggaccgtacggtcgtcgtccggtttacgggaaccgtacgtacgtaccgtaccgttacgtacccgtaacgacttaccgaacggtaccgtacggtacggtaccccggtcgttaaccggtaacggtttacgtttacgtaacgttttacgttaagttaacgttacgtacgttaacgacccgttaacgggttaccgtaccgttaccggtacgttaccccgttaaccgttccggttaacccggttcggaacccggttaaagggtaccccgttacgtaaaccggggtcgtaaggtaacggttaacccggaaaccgggttacgggtaccggtaacgtacccggttcggtaacccgttaaaccggttctttaacggtttcccgttaaccgtttacccg

SEQ ID NO: 48829 - DNA, 640 bp, Homo sapiens
  misc_feature: GYAE6OF02IEA4T.23.23.C01.1.454.CMB.1.raw
  modified_base (204)..(204): a, c, t, g, unknown or other
  misc_feature (204)..(204): n is a, c, g, or t
  modified_base (453)..(453): a, c, t, g, unknown or other
  misc_feature (453)..(453): n is a, c, g, or t
tcagacgcgagtatcacgaccggtgctcgatttagtacacgtgattagggattgggggaggaactgctcagtttgtacccagagggaaccatggaagccccagctcagcttctcttcctcctgctcctctggctcccagagaccaccggagatattcttttgacacagtctccagacatcgtgtctgttgtctccgaggggganagagcccacccgtctcctgcagggccagtcaggagtgtcgccactctcggctgtaccaaacaaaacgtgaccacgcctccaggcctcgtctattcagtgaccacactaccaacgcggccagtcgctaacgtcccgaggctacggttcgaacggtggacgaggttcggacgttcgtacgggacaggtaccttcaccgtctacacgtctacgcgacgtacgtcgtaccgaccgtgtacggttatttacggngtttaacgttttacgttacgttagtaccgtaagtaccgtacggtccggtccggtaacccgttcggaacccttcgttacccgtacccggttccggaaccgttaagggcctacggtacgtacgggatacggtaacgtaaacggtcgtacggttccgactacgaccgaacttcgtacgtccttacgtacc

SEQ ID NO: 48830 - DNA, 753 bp, Homo sapiens
  misc_feature: GYAE6OF02GE6YV.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggagagagcccacccgtctcctgcacgggccagtcgagagtgttcgccgacttccgttggccttaggtaaccaaacaaaaaccgtggaccacgccctaccacggctcgtcattcatggcacactaccaacgacgggaccacgtcggacctacgacccgacgggactacggtttaccgaaggtcggacgtacggtcggtcgttacggtacgggtacgaacggtaccgtttacaaccggtttccttaccggaacggtaacttaccgaaacgtccgtaaggttccgtacccggtaacccgtaggtaaccgtttaacgttttcggaacgtttaacgttttacttaaccgttgttaccgtaacgtccgtaacggtcgggtaccggtaccggttacggtaccctacgtaaccccgttaccggtttccgggaaaccggtaaccggtaccggtaccgggtaaccgttaggggaaccgttaaggtaaccggtaaaaccgtacggttgggtaccgtacgttacggacccgttaaccgttagtacccgttagtacctttaacccgg

SEQ ID NO: 48831 - DNA, 567 bp, Homo sapiens
  misc_feature: GYAE6OF02G8ZP3.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccacctctcctgcagggccagtcagagtgtgccgactccttggcctggtaccaacaaaacctggccagcctccaggctcgtcacttcatggcacataccaacagggccactggcatccagcagttcagtcgcagtgctcgtggacagtactcactctcacgatcagctagtgtcgaccgtgacgtatttgactagtttatctgtcacgtcaacggtcggcgtccgtacggtcctacgtccgtaccgtttcgggacccgtaaagggtacctaccggacgttacgggacgtaacgtaacggaaaccgtaacgttcgggtcggaccgttcggacctaccgttattccggttacgttcttaacccg

SEQ ID NO: 48832 - DNA, 553 bp, Homo sapiens
  misc_feature: GYAE6OF02ILB7W.23.23.C01.1.454.CMB.1.raw
  modified_base (201)..(201): a, c, t, g, unknown or other
  misc_feature (201)..(201): n is a, c, g, or t
  modified_base (310)..(310): a, c, t, g, unknown or other
  misc_feature (310)..(310): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccaggtcagagtgttgccgactctggcctggtaccaacaaaaacctggaccagcctccaggcctcgtcattcatggcacatccaacngggccactggcatcccaggcaggttcagtggcagtggctcgtgggacagacttcactctcacgatcagcagtcgtacgacctgaccgtatttcgactagttttattacttgtcagtctaacggtggtcgccgtggtacctatccaaccgttcggaccgaaaggcctacgacgtaggaagtagtaacggaaaccgacgttcggtaggacttacggacctaaccgtataccgttgttacttaccg

SEQ ID NO: 48833 - DNA, 602 bp, Homo sapiens
  misc_feature: GYAE6OF02IZ35G.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagcccaccctctcctgcagggccagtcagagtgttgccgactccttggcctggtaccaacaaaacctcggccacgcctccgaggctcgtcattcatcggcacataccaacgacgggacccacgtcgggactacgtccccgaggcacggttcacggttggcgaggtggactcgtagggacagtacttcactctacacgtatacgacgactaggtcgtccgtacccgtgtacgtagtttcgacttagttttacttacgttgtacgacgtcgtaacgtcggccgtccgtgtaccctatcccaccgtttccgaccgtaacgggtctaccgaacgtggaacgtacgtaaggtaaaccgagttcggtacgacgtacggactaaccgtatcgttacgttcttaccg

SEQ ID NO: 48834 - DNA, 843 bp, Homo sapiens
  misc_feature: GYAE6OF02J1X5P.23.23.C01.1.454.CMB.1.raw
tcagacgcgagtatcacgaccggtgctcgatttagtacacgtgattagggattgggggaggaactgctcagtttggacccagagggaaccatggaacgccccagctcagcttctcttctcctgctcctctggctcccagacgaccacggagattattcttttagacacagtcctccagacattcgtgtctgtcgtctaccgaggggacagacgtcccaccctctccgtgcgagggcctagtcgagtacgtgttccgacccgtacttccgttcggccgttacggtaacctaaaaccgaaaaaccgttcggacccaacgtcccctaccgacggtcctaccgttacctagtttaccacgttcggactacgtaactacccgaaacggcgggtaccacgttggacctaacgtccccgaggttaccgtacgggttacgacgggtcgtaccgtgggtccgaccgttcgggtaacgggtactaaccgtacctttaccgaaccgttccgtacgaccggttaactaccgggactcggtaacggttcgtacccgtaaccgttacggtaacttttacggtttacgtactttaaaccggttttacgttaccggttttaacggccgttaaccgtacgggttaaaccggtccgggttaacccgtccgggtttaaccggacctttaacccgggttaacctaccccggggtttaacggaaacccggttacggttaaacccgtccgggttaacggttacggaacggtaaccggttaaaccgggtaaaccgtcgttacgggttaacccgtcggtaccgttaacccgaaccgttcgtttaccggttacgttacccctttacgg

SEQ ID NO: 48835 - DNA, 683 bp, Homo sapiens
  misc_feature: GYAE6OF02HZL6J.23.23.C01.1.454.CMB.1.raw
  modified_base (486)..(486): a, c, t, g, unknown or other
  misc_feature (486)..(486): n is a, c, g, or t
tcagacgcgagtatcacgaccggtgctcgatttagtacacgtgattagggattgggggagtcaacaaccacatctgtcctcgagaggacaccctgtgaccacagctcctcaccatggactggacctggacgatcctcttcttggtggcagcagccagaagtcgcccactcccgacgaggaatttgggtgcagtcgtgggcctggaggtgaagacgccgtgggcagtcagtgaaacgtcaccgtgcaagggtcttacgaggtactacctaccgttaccaaccttaaatttgaacttatacgtaacgttggtacgccgacacggtccccgtaagggaaaacgggtctacggaggtggagtgggcgtgggtgacgttctaggtgttagagtaacgtaccggatacttacacgaagtacgttacgaacggctacggacgtacaccggtcctacgtaccgtacggtacctaccgttacgaagaacgaaccncgtaaccttaggttccgaacgttcggccggtaccgcccgttacgaccccgttcggacgacccggtaccggtccggtacgttagttacgttgttcgtcgggacgaggacgggcggtacggtccgttaggttaggtttcgggtaagttcgtttaggtcggttagtaccgggttcgtacgggtacggggtccgaacgggg

SEQ ID NO: 48836 - DNA, 751 bp, Homo sapiens
  misc_feature: GYAE6OF02H5GID.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctggaggtgaagaagccgtggggcatcagtagaaagtccaccgtgcaaggcttacaggaactacaccttcaacctaaatttgaactatacaacgtgggtgcgtaacacggccccgtagggaaacgggcctacggaggtaggtagtcggggtcgtgggtaggacgttccgtaaggttggtagacggaacgttaccggggacttagttacctcgtaaggttaacgttacgaacgggtaccgtaacgggtacctacgtacggtacccgttacgtaaccgtacgggtaacctacccgtttaccgaaaggaaaccgtaaaccgtaccgtacccgttaaggttttaaccggaacgttcgggtacccggtaccggtcccgttacgtaacccgtcggtaaccggacccggaaccggtacccggtacccgttaacgttagtttacgttaggtcggtacggtacgggacggcgggaccggccgggttaacggtttacggtttacgggaaatttgttaggttgggtagttacgggttaccggtacggtccggggtacgtaaccggggg

SEQ ID NO: 48837 - DNA, 727 bp, Homo sapiens
  misc_feature: GYAE6OF02H8OQN.23.23.C01.1.454.CMB.1.raw
  modified_base (205)..(205): a, c, t, g, unknown or other
  misc_feature (205)..(205): n is a, c, g, or t
tcagacgcgagtatcacgaccggtgctcgatttagtacacgtgattagggattggggggagaactgctcagtttggacccagagggaaccatggaagccccagctcagcttctctttcctcctgctcctctggctcccagacgaccaccggagattattcttttgacacagtctccagacatcgtgtctgtgtctccgagggganagacgccaccctctcctgcgagggccagtcagagttgttcgccgtacttccgttcggcctacggtaccaaaacaaaaccgtcggaccacgcctccgaggtctcgtctattcagtcggaccactactaccaacgacgggtcctaacgtcggacactccgaggtctagggtcaggtcggctaggtcggacttcggacgggaactacgtacttactacgtcctacgacgtaattccgagtcgtacggttcgtacccgtaaccgtcggttacttagtttcgaacgtttaagttttaacgtcgtttcggttacgtaggttaccgtaacggtccgggtccgttaccggttacgggcccttaaccgttacccgttacccggttacccgggaaccggtaaacggtaccgttaccggtaaggtaccgggtaaggttacggtaacggtaaaaccggttcggttaaccggtccggtaccgtaaccgtaccggtaccggttaacttcccggtttaacccgtttctttaacccgg

SEQ ID NO: 48838 - DNA, 679 bp, Homo sapiens
  misc_feature: GYAE6OF02JAPET.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagacgccaccctctcctgcagggccagtcaggagtgttgccgactccgttggcctggtaacccaaactaaaaacctggccaagccctcccgaggctcgtctattcagtggcacactaccaacgacgggccacgtcgggaccactccccgaggccgtacggttcgaggtcggctagggtcggcttcgtgggacaggtaccttcactctacacgatcagctaggtcgtccgacccgtgacgttagtttcgacttagtttacttacgtcgtactacggtaccgtaacggttcggaccgtccttacgggtacccttacgttacccgtacccggtttaccgggaacccgtaaacggggtacccttaccggtaacggttaggggaaccgttaacgggtaacggtaaaaccggttaacggttcgggttacgggaccgtttacgggaacctaacccgtacgttcccgttacggttaccctttaccg

SEQ ID NO: 48839 - DNA, 812 bp, Homo sapiens
  misc_feature: GYAE6OF02GX2CL.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttccctcctgcctcctctggctcccagacgaccaccggagattattcttttgacacagtcctaccagacatcgtgtctgtgtcctcgaggggagagacgccaccctcctcctgcgacgggccagtcgagtagttgttcggccgacttcgttggcctacgtaaccaaacgaaaccgtggaccacgccctaccgacggtccgtccgtacgtactttacgagtcggaccaccgtaactaccccgaaacggacgggtaccaaccggtcggacctaaccggttacccgacggtaccgtaccgggttacgacggggttcggaccggtggttaccgggtccgttacgggtacgggtaacgtacggtaaccttccgtaaccgttaccgttccgaaaccggtacgtaccgaacggtaccgttaggttaccggtaacccgtaacccgttacggtaacggttacgtttacgaacggtttacgtttaacgtttaccgttacgtaccgtacgtacgtaaccggtcggtacccgtaccgttacggtaccttacgtcccgtacggttacccgggtacccgtaacgggtacccttaccggggtacggtaccgggtaagttaacggtaaaccggtaaacggttaccggttacgggtaaccggtcgttaaccggaccgaacccgttacggtacccgtttcggttacccgttacccg

SEQ ID NO: 48840 - DNA, 674 bp, Homo sapiens
  misc_feature: GYAE6OF02IDJ5W.23.23.C01.1.454.CMB.1.raw
  modified_base (370)..(370): a, c, t, g, unknown or other
  misc_feature (370)..(370): n is a, c, g, or t
tcagacgcgagtatcacgaccggtgctcgatttagtacacgtgattagggattggggagtcaacaaccgacatctgtcctcgagaggacaccctgtgaccacagctcctcaccatggactggacctggacgatcctcttcttggtggcagcagccagaacgtgcccactcccacgaggaacttggtgcagtctgggcctgacggtgaagaacgccgtagggcagtcagtgaaagtcactgcaaggcttcaggatacaccttcaccaaatttgatatcaactggtgacgacaggccccgtaggaaaacgggctacgagtggagtgggcgtgggtgacgttccgttaggtcgtttgaagtaacgtaccgggntaacttcgtcaagtaacgttcgaacggtccacggctcgacgtcccgtacgtacctacggaaactccgttaccgaaagtaaacgaaccgacgtaaccctagtttacggaacttcgccggtaccggtcctacgaccctacggcgtaaccggaacgtaccggtccgttacgttagttacgttcgacggtacgaacggtacgggccgggtacggcccgttacggtttacggttttacgggaaatttacgttaacggttgggttaacgtacggggttaccgttacgggtccggggtacgtaaccggggg

SEQ ID NO: 48841 - DNA, 600 bp, Homo sapiens
  misc_feature: GYAE6OF02F12G2.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagcccaccctctcctgcgagggccagtcagagtgttgccgactccgtggcctggtaccaaacaaaacctggaccagccctcccaggctcgtcacttcagtggccacactaccgaaacgcgggacctacgtcggcactccccgaggcgtacggttcaggtcgacgaggtcggctcgtagggacacgtactcactcctcacgatcgagctagtcgtcgacctgacgttagtttgacttagttttactacgtgtaccagtacgtaacggtcgggccgtaccgtcggtacctactccgtaccgttccggaaccgtaaaggtcctacggacgtggaagtaagtaacggaaacgtaccggttggtcggtacgtacgaccgtacctagttcttcttccgttac

SEQ ID NO: 48842 - DNA, 785 bp, Homo sapiens
  misc_feature: GYAE6OF02FTBYU.23.23.C01.1.454.CMB.1.raw
  modified_base (151)..(151): a, c, t, g, unknown or other
  misc_feature (151)..(151): n is a, c, g, or t
  modified_base (203)..(203): a, c, t, g, unknown or other
  misc_feature (203)..(203): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccgganatatttcttttgacacagtctccagacatcgtgtctgtgtctccgagggganagacgcccaccctctcctgcagggccagtcagagtgttcgccgtacttccgttggcctaggtaacccaaaccgaaaaacccgtcggaccacgcccctacccgaggccttccgtctacttcgagttacgggaccacacttaccccgaaacgaccgggacccacgttcgggacctaccgttaccccgagggtaccgttacgggttacgacggttcgggaccgtacgggttcgggaccttaccgggtacggggacctaacggtacctttaccgtaaccttacccgttaccgtaaccgtacgttacgaacggtacgtacggttcgacccgtacccgttaggttaaccgttacgttttcggaccttaggtttttaacttacgtcgtttaccgacggtaacgtaccgggtttcggccgttaccggtcggtaccttacgttcccgtacccgttaccgggaaccgtaaccgggttcctacggggtacgtacgggtaacgaacggttaaccgggtaaaacggtacggtttcgggtaccggtacgttacggacccgttaaccttacggtttccgttacgttacccttaccgg

SEQ ID NO: 48843 - DNA, 795 bp, Homo sapiens
  misc_feature: GYAE6OF02I05X3.23.23.C01.1.454.CMB.1.raw
  modified_base (207)..(207): a, c, t, g, unknown or other
  misc_feature (207)..(207): n is a, c, g, or t
tcagacgcgagtatcacgaccggtgctcgatttagtacacgtgattagggagttgggggaggaactgctcagtttggacccagagggaaccatggaagccccagctcagcttctcttcctcctgctcctctggcctccagacgaccaccggagaatatttcgttttgacacagtcctccagacatcgtgtctgtgtctccgaggganacgacgccaccctctctcgcacggccagtcaggagtcgttcgccgtactccgtcggacctacggtaaccaaaccgaaaaccgcggccacgaccctccacggtcctcgtctacttctagtcgacacacgtaccgaacgacgggaccctaccgtggacctaccgtacccgacgggtacgtacggttacgacggtacggtacgtacggggtcggtaccttcgggtacggggtaacctacggtacccttaccgaaccgttaccgtaacccaccggttaacaccgaacggtacgtaacgggtttacccgtaccccggttaaaccggttcggttaacggtttaacgtttttaccggaaccgttttaacggtttttaacgttaccgttacgggttacctaaccggtaacccgtaccgggttcgggaccccgttaccggttaccggttaaccctacggttaaccccgttaaccgggtaccggtaacccggtaacgggtaaccctacgggtaccgtaggaaccggtagttaaccggaaccgttagtaccggtacgcgtttacggaccttaccggtacgttcccttagttcccgttac

SEQ ID NO: 48844 - DNA, 630 bp, Homo sapiens
  misc_feature: GYAE6OF02HK09W.23.23.C01.1.454.CMB.1.raw
  modified_base (329)..(329): a, c, t, g, unknown or other
  misc_feature (329)..(329): n is a, c, g, or t
  modified_base (343)..(343): a, c, t, g, unknown or other
  misc_feature (343)..(343): n is a, c, g, or t
  modified_base (416)..(416): a, c, t, g, unknown or other
  misc_feature (416)..(416): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctcaggggaagagccaccctctctgcagggccagtcagtagtgttcgccgacttccgttggcctaggtaaccaaacctaaaaaccgtcggaccacgccctacccgaggctcgtcacttcatcggcacactaccaaacgnggcctactggcacnccgaggctaggttcaggtcggcaggtcggctcggcgggactagtacgttcactcacgaacgtactacgagacncggttcgtacccgtaccgtgacgtttacgtttgaccgttagtttaacttacgttagtaccgtaggtaccgtaagggtccggtacgtccgttagggtacccttacgtcccgtaccgtttaccgggaccggtaaacgggtcctaccggagtcggaagtacgtaacggaaacgtacgttaggacgtcgtacgacctaccgtatcttcgttacttacg

SEQ ID NO: 48845 - DNA, 703 bp, Homo sapiens
  misc_feature: GYAE6OF02GW364.23.23.C01.1.454.CMB.1.raw
  modified_base (315)..(315): a, c, t, g, unknown or other
  misc_feature (315)..(315): n is a, c, g, or t
  modified_base (488)..(488): a, c, t, g, unknown or other
  misc_feature (488)..(488): n is a, c, g, or t
tcagacgcgagtatcacgaccggtgctcgatttagtacacgtgattagggagttggggagtcaacaaccacatctgtcctcgagaggacaccctgtgaccacagcgtcctcaccatggactggacctggacgatccgtcttcttggtggcagcagccagaagtgcccgactcccacgagaacttggtgcagtcgtgggcctggaggtgaacggagaccgtggggcatccgaaggtgaaaagtcaaccgtgacctaaggcttacgaggactaacgaccttacaaccgtaaatttggaacttagtcaattgggtcgngtaacgacggccccgtagggaaaacggctacggaggttacggagtgggaccgtggtacgagtcccgtagtacgttggacgtaagtaccggggactattcgcaacgtaagttcgaacgaccgagcctcgaacgtcccgagtaaccgacgaacgaccgttacaagtaaacgtaanacgtacctaggttacgaccggtgtaccggtacgtccccacgtacctaccggttcgaaacccgtacgacccgggtacgtttacgttaacttcgggttacgttacggacggtaggtaccgggccgggtaagggcccgtaacggttacggttttaaggacgttaacgtttagttacgggtacgtacggttccgtagggtaccggtcggtaaacccggg

SEQ ID NO: 48846 - DNA, 635 bp, Homo sapiens
  misc_feature: GYAE6OF02H5P2F.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctccagagaccaccggagattattcttttgacacagtctcagacatcgtgtctgtgtctccgaggggagagacgccaccctctcctgcgagggccagtcagagtgttcgccgacttccgttggcctaggtaaccaaactaaaaaccgtcggaccacgccctccgacggctcgtctacttacagtcggacactactaccaaacgacgggccacgtcggacctacgtcccgaggaccgtaggttcgacggtcggactagggtcggcttcggtacgggaactacggtacttaccacttaccgtacgacgtactccgagtacctaggttcgtaccgaccgtaggtaacgttacgtttcgacgttaagttttaacttcgttagacgtacgtacgtacggtcggccgtcgtcgtccttatccgtaccgttccggacgtaacggtacctcgagtggaacgagtaacgaaccgtagtcgtacgcgtcgacctactacgtcgtcttcgtacc

SEQ ID NO: 48847 - DNA, 605 bp, Homo sapiens
  misc_feature: GYAE6OF02FR00W.23.23.C01.1.454.CMB.1.raw
  modified_base (203)..(203): a, c, t, g, unknown or other
  misc_feature (203)..(203): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggganagagccaccctctcctgcagggccagtcagagtgtgccgactccgttggcctggaccaacaaaacctggccagcctccaggcctcgtcattcagtggcacactaccaacgacgggccacgtggcactcccgaggctacggttcaggtcggactaggtcggctcgtcgggacagtacttcactctacgacgatcgacgctaggtcgtaccgacccgttggacgttacgtttcgacgttaagttttacttacgtgttacgtacgtacctaacggtcggccgtccgtacggtcctacgttcctacccggttcggaccgaacgggtacctcggacgtgggaacgtacgtaacggaaaccgtacgtggtacggtcgtcgtacctaccgtacgtcgttcgtccttacg

SEQ ID NO: 48848 - DNA, 613 bp, Homo sapiens
  misc_feature: GYAE6OF02FZR14.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagacgccaccctctcctgcgagggccagtcagagtgttcgaccgtactccttggcctaggtaaccaaacaaaaaccgtggaccagccctccgaggctcgtctattcagtcggacactactaccgaacgacgggaccacgtcggaccacgtcccgaggctaggttcaggtcggcaggtcggtcgtcgtgggactagtacttcacctctacacgatcagtacagtcgcgaccgtgtacgttatttcgacgttagtttacttactgtcacgtcgtaacggtcggaccgtccgtcggtaccttacgtccgtaccgttcggaccgtaacggacctggaccgtagggacgtacggtaacggtaaacgtacgtaggtacgtccgtacgaccgtaacctcgtacgttaccgtcttaccg

SEQ ID NO: 48849 - DNA, 815 bp, Homo sapiens
  misc_feature: GYAE6OF02FW30B.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctctgctctctggctccagagaccaccggagatattctttgacacagtctcagacatcgtgtctgtgtctccgagggagacgacgccaccctctcctgcgacggcacgtacagagtgttcgaccgtacttcccgttcgggccctacgggtaaccccaaaaccgaaaacccgttcggaccaaccggtcccctaccccgagggcccttccgtaccgtattaccggaaccgtcgggtaccctaacaccgttaccccggaaccgtaacggggcccctaacggtccggacctaaccgtccccgaacgggtaccgtaccgggttaccgtaacggggtcgggtacgtacgggttcggtcccgttacggggttacgggaaccttacggtaacccgtttccgaccgttacccgtacccggtaaggtaaccgtaccgaagggttacccgtagggtcccggttacccggtacccggttacggttaacgtttacgtttcgggtaactttaacggttttaattaaccggtgttaccgtaacgtaccggtaacggtccggccccgtcggttaccggtacctacgttccccgtaacgttcccgggaaacacggggtcccgtacgtacggtcgggtaataaccgggtactaaaccgggtccgtcggttacggccgtaggtaccctaccggttatacccgtattccgttaacccg

SEQ ID NO: 48850 - DNA, 676 bp, Homo sapiens
  misc_feature: GYAE6OF02F3FYN.23.23.C01.1.454.CMB.1.raw
  modified_base (204)..(204): a, c, t, g, unknown or other
  misc_feature (204)..(204): n is a, c, g, or t
  modified_base (207)..(207): a, c, t, g, unknown or other
  misc_feature (207)..(207): n is a, c, g, or t
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatagttcttttgacacagtctccagacatcgtgtctgtgtctaccgagggganagngccacctctccngcgngggccagtcagagtgtcgccgactcgtgcctaggtaaccaacgaaaacctggacctacgcccgtccaggcctcgtctacttcacgtggacactactaccgaacggacgggaccacgtcggctacgtacccgaggtcgtacggttcgaggtcggacaggtcggctcggaggacacgtactacactcgacacgtatacgagtacgtagtccgtacgtacccgtagtacgttagtttacgacgtttaacggttttaactttacgttcgtaacgtaccgttaaacggtcggtacccggtacttccggaccgttagttacccgtaccggtttccgggaaccgtaacggggtacccttaccgggacgtacggtacgtaacggtaacggtaaaccggtacggtcgggtaacgacggttaccaacgttaccgtacgttcgtaccggtttcctacgtacccg

SEQ ID NO: 48851 - DNA, 717 bp, Homo sapiens
  misc_feature: GYAE6OF02H7WD2.23.23.C01.1.454.CMB.1.raw
tcagacgcgagtatcacgaccggtgctcgatttagtacacgtgattagggattgggggaggaactgctcagtttggacccagagggaacatggaagccccagctcagcttctcttcctcctgctcctctggctccagagaccaccggagatattcttttgacacagtctccagacatcgtgtctgtgtctccgagggggagagacgcccaccctctcctgcgagggccagtcagtagtgttcgccgtactccgttcggcctacggtaccaaaccaaaactcggaccacgccctccgaggtcctcgtctacttcgatcggacactactaccaacgcggaccacgtcggacactcccgaggtcgtacggtacgacggtcggacgtaggtcggaccgttcgggcgggtaactaacggtaccgtttaccaacgttcctaaccgacgtacgtacgaacgtcgtaccgggttaccggtacccgtaacccgttaggtaacgttacgttttacgatttaacggtttacttacgttagttacgaggtacgtaacgggtcggtcccggtaccgtacggtccttacgtacccgttacccgttaccgggaaccgtaaacgggtactaccggtacgtacgggtaacggtaactaacgggaaaccgttacggccgggttacgaccggttacgacctaacccgttgtttccgttcggtttaccgtttacccg

SEQ ID NO: 48852 - DNA, 756 bp, Homo sapiens
  misc_feature: GYAE6OF02HTV5T.23.23.C01.1.454.CMB.1.raw
  modified_base (241)..(241): a, c, t, g, unknown or other
  misc_feature (241)..(241): n is a, c, g, or t
  modified_base (685)..(685): a, c, t, g, unknown or other
  misc_feature (685)..(685): n is a, c, g, or t
  modified_base (739)..(739): a, c, t, g, unknown or other
  misc_feature (739)..(739): n is a, c, g, or t
  modified_base (747)..(747): a, c, t, g, unknown or other
  misc_feature (747)..(747): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggcctccagagaccaccggagatattcttttgacacagtctccagacatcgtgtctgtgtctccgaggggagacgacgcccacccctctcctggcacgggcctagtcaggngttcgttcggccactccgttacggcctaggtaaccaaaacctaaaaaccgtcggacccaacgcccctccccgacggtcctcggtcactttacgagttcggccaaccgtactacccgaaaccggaccgggtaccccgaaccgtcgggaccaaccgttaccccgacgggtaaccgtaacgggtttcgaaggggtccggacggttacgggtggtaccgttcggtacggggtaacgtaaacggtcctttacccgtacccgttcctaccgaaccggtacttaccgacggtaccgtacgttaccggtacccggtaccccgttaggttaaccgtttacgtttacggttaccgttatttaccgtttacgttcgtacgtacgtacgtacggtccgggtaccgttccgtccggttacctcgttacctaccggttccgaccggtacgcgttacgnggtagtaacgagtaacggaaccgtacgtacggcgaccgtcgtaccgaccgttanccggtttnttcgttacc

SEQ ID NO: 48853 - DNA, 595 bp, Homo sapiens
  misc_feature: GYAE6OF02GLZKR.23.23.C01.1.454.CMB.1.raw
  modified_base (203)..(203): a, c, t, g, unknown or other
  misc_feature (203)..(203): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagacgaccaccggagatattcttttgacacagtctccagacatcgtgtctgtgtctccgagggganagacgccaccctctcctgcgagggccacgtcaggagtgttgccgacgtccttggcctggtaccaaacaaaaccgtcggccacgcctcccgacggcctcgtcattcagtcggacacactaccaacgacgggccacgtcggcacgcccgaggcgtacggtcagtggccgtacggtcggtcgtcggtacggacgacgtacttacacctcgtacgaccgatcgagctagtcgtccgacctgaccgttagtttcgacttagtttacgttacgtgtactagactacggtcggcgtccgcggtcctacgcgtaacccggttcgacgtaaggacctcgacgagtagtacgtaacgaacggtactcgggtagtctacgcctaccgacttcgtcgttactcg

SEQ ID NO: 48854 - DNA, 636 bp, Homo sapiens
  misc_feature: GYAE6OF02IHPI5.23.23.C01.1.454.CMB.1.raw
  modified_base (184)..(184): a, c, t, g, unknown or other
  misc_feature (184)..(184): n is a, c, g, or t
  modified_base (363)..(363): a, c, t, g, unknown or other
  misc_feature (363)..(363): n is a, c, g, or t
  modified_base (439)..(439): a, c, t, g, unknown or other
  misc_feature (439)..(439): n is a, c, g, or t
  modified_base (608)..(608): a, c, t, g, unknown or other
  misc_feature (608)..(608): n is a, c, g, or t
  modified_base (628)..(628): a, c, t, g, unknown or other
  misc_feature (628)..(628): n is a, c, g, or t
tcagacgcgagtatcacgaccggtgctcgatttagtacacgtgattagggattgggggaggaactgctcagtttggaccagagggaaccatggaagccccagctcagcttctcttcctcctgctcctctggcctccagacgaccgaccggatattatttcttttagacacagtcctaccagacngttcgtgtctgtgtcacggagggagagacgcctacctctcgtgcgagggccagtcagtgtgtcgacctcgtccgttcggccgtacgtaaccaaaaccgtaaaaccgcgaccacgtcctaccgacggtctcggtactactcgtacgtcgactacactcaacgacggccacgtcggctacnccgacgtacgtaggtacacggtggacctaggtcgcgtcggtagggactacggtaccttgtactacgtacgaacgtntaccgagtcgtaggttccgtaccgtaccgtagtcctttagttcgtacgttcgtttaagttaacgttcggactaaccgttaagtccgtacggccgttacgtccggtaactccgtactaccgttcggaaccgtagcgttaccgagtcggaatcgtaagacgtacgtcggancgtacgcgacgttatcggtntcgttacc

SEQ ID NO: 48855 - DNA, 681 bp, Homo sapiens
  misc_feature: GYAE6OF02F3FCW.23.23.C01.1.454.CMB.1.raw
  modified_base (200)..(200): a, c, t, g, unknown or other
  misc_feature (200)..(200): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctcgaggganagacgccacctctcctgcgagggccagtcagagtgttgccgactccgttggcctaggtaaccaacaaaaacctggaccagccctccgaggtcctcgtctattcagtcggctacactaccgaacgacgggccacgtcggctaactcccgaggcgtaggttcgaggtcggacaggttcggcttcggacgggtacagtacctcgtacctactaccgaaccgtgaccgtacgacgtacggtcggtaccccgtacccgtagtacgttacgtttacgactttagttttacttacgtcgttacgtaacgtaccgtaaccggttcggccttaccggttacggaccttttaccgaccttacccgggtcccggtaaccgtaacgggtcccttacggacggttacggaagttaacgggtaaacgtaaaccgtacgggttcgtaacggccgttacgtaccgtaaccgtacttcggttaccgtttacctaccgg

SEQ ID NO: 48856 - DNA, 802 bp, Homo sapiens
  misc_feature: GYAE6OF02JEAYH.23.23.C01.1.454.CMB.1.raw
  modified_base (296)..(296): a, c, t, g, unknown or other
  misc_feature (296)..(296): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccaacgaggaattggtgcagtcgtgggcctagaggtgaagaagccgtggggcatcaggtagaaacgtcaccgtgacaaggtcttcgaggatacgaccttacacctaaattgatatactaacgtgggtnacgtacgacggcccctaagggaaaacggccgtacgtaggtacggtaggtcgggacgttgggggtactacggttccgttaggtggtttagaacggtaagttacccgggagttaacgttccgtacggtaagtaaacggtttaccggaacgggtacccgtacgggtaccttacccggtaaccgtaccggttacccggtaaaccgttacgggtaaaaccctacccgggtttaaaccaaacgggtaaaaccggaacgtaacccggtacccgtaaggttttaccggaaaccgttcgggaccgcccgggtacccgtacgtacccggtctacgggacccgtaacccgtaccgggtacgttaccggtaatttacgttcggtacgtcggaaggtccgggacgggacggtcccggggtttaaggttacggtttttaacgggaaacggtttacgttaaggttacgggtacggttacgggtaccgggtttccggtaccgggggtccgtaaacccggggg

SEQ ID NO: 48857 - DNA, 627 bp, Homo sapiens
  misc_feature: GYAE6OF02I26D9.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgtgccgtactccgttggcctggtaaccaaactaaaaaccgtcggaccacgccctaccacggcctcgtcattcagtcggcacactccaacgacgggccacgtcggcactccgaggctaggttcaggtgacgaggtggactcgtaggacagacttcgactcgtacacgtactcagcgtagtcgtccgaccgttgacgttagtttcgacgttacgttttacgttacttcgtactagtacgtaacggtcggtcgaccgtacggtacctacgtttaccaccggtttaccggaaccgtaaacgggtacctacgggtacgtaggggtaactaacggtaacgtaaacggtaacggtggttacggactcggacctaacccgtataccgttcgttacttaccg

SEQ ID NO: 48858 - DNA, 710 bp, Homo sapiens
  misc_feature: GYAE6OF02GL0WB.23.23.C01.1.454.CMB.1.raw
  modified_base (203)..(203): a, c, t, g, unknown or other
  misc_feature (203)..(203): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggcctcccagagaccaccggagatattcttttgacacagtctccagacatcgtgtctgtgtctccgagggganagacgccaccctctcctgcgagggccagtcagtagtgttcgccgtacttccgttgggccctagggtaacccaaaactaaaaacccgtcggaccgacgacccgtacccgacggtccgtccgtctacttctacgtgaccgacactaccgaacgacgggacccacgtcggaccgtactacccgacggtacgtacgttaccggacgttacggcgtacggtacggtccgtacggttacgggaaccgtacggtaccgttacctacggttacctaccgtaacgacgttaccacggtactacggtccgtaccgtaccgtacgtaacgttagtttacgtacgttacgtttacgttacgttcgttacgtaccgtacggaccgtttacggccgtaccgttcggtcctaacgtccgtaccggttaccgaccgtaaggccgtgtaccgtaggtaacgaggtaaccgtaaggtaacgtggtacgtccgtacaccgttacgacttcggtttctaccgttacg

SEQ ID NO: 48859 - DNA, 735 bp, Homo sapiens
  misc_feature: GYAE6OF02JMKZI.23.23.C01.1.454.CMB.1.raw
tcagacgcgagtatcacgaccggtgctcgatttagtacacgtgattagggagttggggagtcaacaaccacatctgtcctcgagaggacaccctgtgaccacagctcctcaccatggactggacctggacgatcctcttcttggtggcagcagccagaagtgcccactcccacgaggaattggtgcagtcgtgggcctggaggtgaagaagccgtggggcagtcagtagaaagtcacctgcaaggcttcaggatacaccgttcacctaaatttgatatcgaacgtgggtcgcgacgacggccccgtaggaaacggcgtagaggtggagtacgggtagtgggtagacggtaccgtaggttgttaggacgtaacgtaccgggtactagttcctagtaagtaacgttcgaacggtccgtacgtacctacgacggtacctacgtacccgtaaggaaccttacgtaccgaaagtaacggaactacggaaccctagttacggaaacgttcggacccgacgggtcccgttacgtacccgttacgtacggaacccgaaccgttaccgggtaccgttaaggtttaacgtttacgttcgggtacggaccggtaagggtaccggggacgggtaccggacccggttaaccggtttaggtttttaacggggaaaccgtttaggtttacggttaaccggtagggttaccggaccgggttacgggttacggggaacccgttaaccggggg

SEQ ID NO: 48860 - DNA, 644 bp, Homo sapiens
  misc_feature: GYAE6OF02INZTZ.23.23.C01.1.454.CMB.1.raw
  modified_base (152)..(152): a, c, t, g, unknown or other
  misc_feature (152)..(152): n is a, c, g, or t
  modified_base (203)..(203): a, c, t, g, unknown or other
  misc_feature (203)..(203): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggcctcccagagaccaccgganatattcttttgacacagtctccagacatcgtgtctgtgtctccgagggganagacgcccacctctcctgacgagggccagtcaagagttcgttcgccgacttccgtcggcctggtaaccaaaacaaaaaccgtcggaccacgaccctcccgacggcctcgtactacttcgactggacacactaccaacgacgggaccactcggacacgtccgaggctacggttcagtcggacaggtcgccgtcggtacggtacacgtacttcaccttctacgacgtacacgagcgacgtacgtccctaccgtgtacgtatttacgactttaagtttacttacgttcgtacgacgacgtaaccggtggtccgtccggtcgacctttacgtccgtaccgttccggaaccggtaacgggtacttaccggaagttacggaacgtacgtaacggaaacgtaacgtcgtacgtccgtacgacctaccgtactcgttaccgtcttaccg

SEQ ID NO: 48861 - DNA, 816 bp, Homo sapiens
  misc_feature: GYAE6OF02FHZP8.23.23.C01.1.454.CMB.1.raw
  modified_base (167)..(167): a, c, t, g, unknown or other
  misc_feature (167)..(167): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagacccaccggagatatttcttttgacncagtcctccagacatcgtgtctgtgtctccgaggggagagacgcccaccctctcctgcacgggccagtccagagtgttcgccgactccgtggcctcggtaaccaaaccaaaaccgtggaccacgccctccgacggctcgtcattcagtacggcacactacccgaacgccgggaccacgtcgaccgtacgtcccgaggtacctaggttccaaggtcggactaggtcggtaccgttacgggacggtaaccgtaacgtaccgtttccgtacccttaccgtaaccgtaacggacgtaccgtaacgtaccgtaacggtcggtaccccgttaaaccccgttacggtaaccggttttacgttttacggaaccgtttaacgtttttaaccgtttacccgttacgggttaccgtaaccggtaacggttaaccgggttccgggtaccggttccccgttaacggggttaccctttaacggttacccggttaaccccgttaaccgggtacccgtaaacgggttaccccgtaccggtaaccggttacgggtaaacgtaaccggttaaacgggaaaacccggttaggttccgggtaaacggttccggtaaccggtaccccgtaaacttacccggtttccgtttaccggttacctttaacccgg

SEQ ID NO: 48862 - DNA, 609 bp, Homo sapiens
  misc_feature: GYAE6OF02HAZKP.23.23.C01.1.454.CMB.1.raw
  modified_base (202)..(202): a, c, t, g, unknown or other
  misc_feature (202)..(202): n is a, c, g, or t
  modified_base (596)..(596): a, c, t, g, unknown or other
  misc_feature (596)..(596): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagacgcccaccctctcctgcagggccagtcagtagtgttgccgtactctggcctggtaaccaaacaaaaaccgtggaccagccctccgaggtcctcgtcagttcagttcggcacactcccaaacgacgggacctacgtcggccaactcccgaggctacggttcacggtgcgaggtcggctacggtggactacgtactcgactcgtacgacgactcgaacgtctaggtcgaccgtaccgtagtacgttagtttcgacgtttagtttacttacgtgtaccgtagtacgtacggtcgccgtccgtcggtaccttacgtccgtaccgttcggacgtaacggtctcggtagtcggaatacgtaacggaacgtacgtggtacgtctaccgacaccgttancgttcgtcttacg

SEQ ID NO: 48863 - DNA, 809 bp, Homo sapiens
  misc_feature: GYAE6OF02FIIUR.23.23.C01.1.454.CMB.1.raw
  modified_base (626)..(626): a, c, t, g, unknown or other
  misc_feature (626)..(626): n is a, c, g, or t
  modified_base (793)..(793): a, c, t, g, unknown or other
  misc_feature (793)..(793): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggcctcccagagaccaccggagattattcttttgacacagtctcagacatcgtgtctgtgtctccgaggggagagacgcccaccctctcctgcgacgggccaggtcaggagtgttcgcccgtacttccgttggaccgttcggtaaacccaaacgtaaaaacccgtggacccacggcccctacccgacgggccttaccggtacctacgtttaccagttcggacctaccaacgttacccgaaacgaccggggaccctaacgtcggaccctaacgtaccccgacgggtacggttacggtttacgacgggtcggaccgtacggttcgggtaccgttcgggtacggtaaccgtacggtaaccctttccgtaccttacccttaaccggtaaccgtaacgttctaacggtaccgtacgggttaccgtaccccgggtacccgttaacggttacgttacggttttcggaaccgtttaagtttttaccttacgttaccggttaacncggtaaccgtaaaccgggttcgggacccgttccggtacggttccttaacgttcccgttacccgggttacgaacccggtaacgggttaccctaccgggtacgtacggggaacttaacgggtaacggaaaccggttaacggtcgggtaacggtcctaggaccctacgtntcgttacgtccttacg

SEQ ID NO: 48864 - DNA, 662 bp, Homo sapiens
  misc_feature: GYAE6OF02GC697.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagacgccaccctctcctgcgagggccagtcagagtgttcgccgtactccgttggcctaggtaaccaaacaaaaacctggaccacgccctacccaggcctacgtctacttcagtggcacgactacccgaacgacgggccacgtggaccacgtcccgaggccgtaggttccaggtcggccgaggttcgggtccttcggtacggggactacggtaccgtttaccgaaccttcccgtacgaaccgtaacgtaccgaacggtaccgtacgggttcggtacccgtaacccgttcggtaaccgttacgttttacgacctttaagttttacgttaccgttcgttacgacgtacgtaacggtcggccgtccgtcggtacctactccgtaccgttccggacgtaacggctacgcgtagacagtaaggaactcgtgtacggcgtacgacctacgactcttcgtaccttacg

SEQ ID NO: 48865 - DNA, 687 bp, Homo sapiens
  misc_feature: GYAE6OF02H66ZN.23.23.C01.1.454.CMB.1.raw
  modified_base (285)..(285): a, c, t, g, unknown or other
  misc_feature (285)..(285): n is a, c, g, or t
  modified_base (392)..(392): a, c, t, g, unknown or other
  misc_feature (392)..(392): n is a, c, g, or t
tcagacgcgagtatcacgaccggtgctcgatttagtacacgtgattagggattgggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagagcctggggcatcagtagaagtcacctgacaaggtcttcaggtatacaccttcactaaattgatatactaagtgggtancgtacgacggccccgtaagggaaacggtctacggaggttggagtcggggacgttggggtagtacggttccgttaggttggttaggaaggtaaacggtacccggggtntagttaccgtacgaaggtaacgttacgacggtacctaggtcctcgacgtcccgtagtaccgtacggaacctaaccgttaccgaagaaacgaaacaaccgtaccctaagtttacggaacgtacggcggaccggtaccttacgacctccgtacgaccgaccgtaccggtaccgttagttacgtttagttcggtacgacggtaggacgggtacggacgggtaccggtcggttagttttacgggaagtttaagttagtcggtagtacgggtacggttcggtacgggtacgtaaccgggg

SEQ ID NO: 48866 - DNA, 593 bp, Homo sapiens
  misc_feature: GYAE6OF02H1Z6Z.23.23.C01.1.454.CMB.1.raw
  modified_base (203)..(203): a, c, t, g, unknown or other
  misc_feature (203)..(203): n is a, c, g, or t
  modified_base (407)..(407): a, c, t, g, unknown or other
  misc_feature (407)..(407): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagattattcttttgacacagtctccagacatcgtgtctgtgtctccgagggganagacgccacctctcctgcgagggccagtcagtagtgtcgccgactctggctggtaaccaaaccaaaacgtcggaccacgcctccgaggctcgtctattacagtcgacacactccaacgtcggccagtcgcactccgaggcgtaggtcgaggtcgacgtaggtcggtcgtacgtacggactagtacctcaaccgtctacgacgtntacgcgtagagttcgtccgaccgtgtacgttagtttacactttagtttacgtcgttagactagtacgtacggtcgccgtcgtcggtacctacgtctacccggttacgacgaacggtctacggtacgtagacgtaacgaacgtaagtcgtgtacggtcgacgaccctatacgttcgtacgtcttacc

SEQ ID NO: 48867 - DNA, 670 bp, Homo sapiens
  misc_feature: GYAE6OF02G6YVX.23.23.C01.1.454.CMB.1.raw
  modified_base (152)..(152): a, c, t, g, unknown or other
  misc_feature (152)..(152): n is a, c, g, or t
  modified_base (203)..(203): a, c, t, g, unknown or other
  misc_feature (203)..(203): n is a, c, g, or t
  modified_base (216)..(216): a, c, t, g, unknown or other
  misc_feature (216)..(216): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggcctcccagagaccaccgganatattcttttgacacagtctccagacatcgtgtctgtgtctccgagggganagacgccaccctntcctgcgaggccaggtcagagtgtcgccgtactccgttggcctaggtaaccaaacgtaaaaaccgtggacccacgccctaccgaggcctacgtctacttcagtcgaccactactaccaacggccgggaccacggtcgacgacctacccgaggccgtaggttcgaggtacgcgaggtcgcgtcggtacgggacacggtactcgaccgtcctacgacgtactacgacgtctacggtaccgttcccgaccgtacgaacgttgttacgtacgttagtttacttacgtgttacgacgtacgtaacggtcggtcccgtcggtaccggtcctacgtaccgtaccggtttcccggaaccgtacgggtacctacgtacggtacggaacgtacggtaaacggaaccgttacggtacggtacgtcgtaaccgtaccgaaccttacgttcgttacttacgttaccc

SEQ ID NO: 48868 - DNA, 717 bp, Homo sapiens
  misc_feature: GYAE6OF02F8M2Z.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttctcctgctcctctgctccagagaccaccggagatattcttttgacacagtctccagtacatcgtgtctgtgtctccaggggagtagagcccaccctcgtcctgacgagggccagtcgagaggtacgttgccgactccgttggccttggtaccaacaaaactggaccagcctccgaggctcgtcagttcaagtcggcacactccaaacgacggggaccacgtcgggcctacgtccccgaggactacgggttcaacggttcggactaggtcggactcgttagggaccgagtaccgtttcgaaccttccgtccgaaacgagttccaacggtccgtaaggttccggtacccgaaccccgttggaaccgtttacgttttagggacctttaggtttttactttccgttagttcaacggttaccgtaaccgggttccggtcccggtacccgttcgggttacccttaacgttcccgtaccgttttaccgggacccgtaaacggggtcccttacggaccgttaggaacgtagttaaccgggaaacgttaacggtcggtacggttccggacgtcccgtaaccgttacgttcccgttaggtccctttaaccg

SEQ ID NO: 48869 - DNA, 815 bp, Homo sapiens
  misc_feature: GYAE6OF02FIGHY.23.23.C01.1.454.CMB.1.raw
  modified_base (297)..(297): a, c, t, g, unknown or other
  misc_feature (297)..(297): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccgacgaggtaattggtgcagtcgtcgggcctgaggtgaagagccgtgggcatcagtgaaacgtcactgacgaaggcttacgaggataccacttcaacctaaatttgatactcaacgtgggtgacgacncggtaccccgtagggaaaacgggtcctacggaggtagggagtcggggtacgtggggtagtacgtccgttagttggttacggagtaacgtccgggatacgttcgtacgtagtaacgttacggaacggaccgtagggtccctaaccggtacgtacccgtacggtacccggtacggaacccgttaaccttacccggaaaggtaaaaccgtaaaccggaccgtacccggttaagttttaccgggaaaccggttacgggtcccgggtacccggttcccgtaaccgggtaccccgttacggtacggtaaacccggaacccggttaccgggttacccggtttagtttaccgtttagttgggtacgtacggggaccgggtaacggggtacggggaacgggtccccggttaagggttttaccggttttaagggggtaatttacggttttaaggtttaacgggtttaacgggttaccggggtaccggggttttacggggtacgggggtacccggttaaaccggggggg

SEQ ID NO: 48870 - DNA, 677 bp, Homo sapiens
  misc_feature: GYAE6OF02G0JXA.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctcgagggganagagccacctctcctgcagggccagtcagagtgttgccgactcctggcctaggtaaccaaacaaaaaccgtggaccagcctaccgaggctcgtcattcagtggcacactaccaacgacggcctacgtcggacactccgaggcgaggttcgaggtcggactaagtcggctcgtaggacacgtacttcactctcacgtactcgagctagtcgtaccgacctagacgttatttcgacttagtttaacttacgtagtaccgaagtacgtaaccggtcggtaccgtccgttacggtacccttaacgtacccgttacccggtttaccgggtaaccgtaaaccggggtaccttaacggggtaccggttagggtaacggttaacgttaacggggtaaaacccgttaacggttcgggtaccgggttacccgtacgggtaaccgaacccgtttacggttacctttacgggtttaccctttacccgg

SEQ ID NO: 48871 - DNA, 673 bp, Homo sapiens
  misc_feature: GYAE6OF02HMQFP.23.23.C01.1.454.CMB.1.raw
  modified_base (151)..(151): a, c, t, g, unknown or other
  misc_feature (151)..(151): n is a, c, g, or t
  modified_base (221)..(221): a, c, t, g, unknown or other
  misc_feature (221)..(221): n is a, c, g, or t
  modified_base (513)..(513): a, c, t, g, unknown or other
  misc_feature (513)..(513): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctgcctccagacgaccaccgganacttatttcttttggacacagtcctccagacatcgtgtctgtcgtctcgagggagacgacgccaccttcnccgtgcgaggccagtcagagtcgtcgaccgtacttctcggcctaggtaaccaaaacgaaaacgtcggaaccacgccgttaccgaggtctacggtctagtacagtgaccactactaccgaacgcggacccaggtacgccacgtaaccgagtaccgaggttccaaggtcggtaccaggtttccggacttcggaacgggtactacggtacctcgtaacctcgaccgaagtacctgaagcgttaagccgtaaccgaccgtagtacgttttagtaccgtataacgtttactaccgtnacgtacgaacgtacgtcggtacccgtccgtacgtacctacttaccgtaccggttccggaacgtacggaaacctgtacggtaggacgtaaacggtaacaaccggtgtttaacggcccgagtttcaaaccgtcgttacgttaacggttcctttaaggtaccc

SEQ ID NO: 48872 - DNA, 680 bp, Homo sapiens
  misc_feature: GYAE6OF02IV6WN.23.23.C01.1.454.CMB.1.raw
  modified_base (201)..(201): a, c, t, g, unknown or other
  misc_feature (201)..(201): n is a, c, g, or t
  modified_base (245)..(245): a, c, t, g, unknown or other
  misc_feature (245)..(245): n is a, c, g, or t
  modified_base (449)..(449): a, c, t, g, unknown or other
  misc_feature (449)..(449): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgaggggngagagccaccctctcctagcagggtccagtccaggagtggttcnccgtactccgttggccttggtaccaacaaaactcggacacgtcctcccgaggctcgtacattcacgtcggcctaacacaccaaacgcgggtcccacgtacgggacctacgtcccgaggtaccgtacggtttacaaggtccggactagggtcgacgtcgttagggaacctaggtaccttacgtacctctaacgcgtaactcgacnccgtaagtccggttaccgacccgtgtaacgtacttttacggactttaacggtttaattacgttagttccgagtaccgaacggtttggacctcccggttagtcccgtacgtactacccgttcgtaccggaaacggtatacgtctacgggtaatacgtaaacgtaacggtaacgttacggttgggtacccgtagacccgtaacgtaaccgtttcgtccggtttacctaaccgg

SEQ ID NO: 48873 - DNA, 582 bp, Homo sapiens
  misc_feature: GYAE6OF02JV1SW.23.23.C01.1.454.CMB.1.raw
  modified_base (191)..(191): a, c, t, g, unknown or other
  misc_feature (191)..(191): n is a, c, g, or t
  modified_base (200)..(200): a, c, t, g, unknown or other
  misc_feature (200)..(200): n is a, c, g, or t
  modified_base (213)..(213): a, c, t, g, unknown or other
  misc_feature (213)..(213): n is a, c, g, or t
  modified_base (490)..(490): a, c, t, g, unknown or other
  misc_feature (490)..(490): n is a, c, g, or t
  modified_base (528)..(528): a, c, t, g, unknown or other
  misc_feature (528)..(528): n is a, c, g, or t
  modified_base (535)..(535): a, c, t, g, unknown or other
  misc_feature (535)..(535): n is a, c, g, or t
  modified_base (547)..(547): a, c, t, g, unknown or other
  misc_feature (547)..(547): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctccagagaccaccggagatattcttttgacacagtctccagacatcgtgtctgtgtcnccagggganagacgccaccctntccgtagcgaggccagtcagagtgtcgccgacttcgtaggcctcggtaaccaacaaaacctcggaccacggtcccctccgacggtctcgttccactttccgatcggacactctacctaacgcgggacctacgtacgccacgtcccgaggtcgaacggttccaggtcgctaggtcgaccgttcgtacgggcaacgtcttctacctacgtccacgtactacgacgcgtacgtacgtcccgacctggtaacgtcttcgatttcgtattcgtagacagtanacggtgctccggatcgtactcgtctcggtcagccgtangtacggnagtaacgacgtnacggttcgacgtcgtaccagactcgtacgtctccg

SEQ ID NO: 48874 - DNA, 726 bp, Homo sapiens
  misc_feature: GYAE6OF02HRGKF.23.23.C01.1.454.CMB.1.raw
  modified_base (187)..(187): a, c, t, g, unknown or other
  misc_feature (187)..(187): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggcctcccagacgaccaccggagattatttctttgacacagtcctccagacatcgtnttctgtcgtcctcgaggggagagacgccaccctctcctgcacgggccagtcgaggtagtcttcggccgaccttcgttccggactacggtaaccaaaaccgtaaaaaccgtcggccgaccgccctacccgtaggccgttacgtcctagttacacgtcgcactacctaccgaacggacgaccctagtccggtacaaccgtacccgacggtacgtacggttacgtacggtcggactacggggtcggccggttacggtacgggtaacgaaccggtttaacctccgttaacttccgtacgaccgggtactaccggacgtacgtacggttcgtacccgtacccgtaggtacgttaacgtttcgtaccgtttagtttacctaggttacgtcgtacgacgtacggtacggcccgttacgccggttactaaccgtccgtaccgtacggacccgtagtccgtacgaccgtagggaataccgtaaaggtaaccgtagttacgggacggttacaccggaccaccctagtttccggtccgttacgtttaccg

SEQ ID NO: 48875 - DNA, 760 bp, Homo sapiens
  misc_feature: GYAE6OF02JUM6D.23.23.C01.1.454.CMB.1.raw
  modified_base (213)..(213): a, c, t, g, unknown or other
  misc_feature (213)..(213): n is a, c, g, or t
  modified_base (306)..(306): a, c, t, g, unknown or other
  misc_feature (306)..(306): n is a, c, g, or t
  modified_base (341)..(341): a, c, t, g, unknown or other
  misc_feature (341)..(341): n is a, c, g, or t
  modified_base (432)..(432): a, c, t, g, unknown or other
  misc_feature (432)..(432): n is a, c, g, or t
  modified_base (463)..(463): a, c, t, g, unknown or other
  misc_feature (463)..(463): n is a, c, g, or t
  modified_base (470)..(470): a, c, t, g, unknown or other
  misc_feature (470)..(470): n is a, c, g, or t
  modified_base (510)..(510): a, c, t, g, unknown or other
  misc_feature (510)..(510): n is a, c, g, or t
tcagacgcgagtatcacgaccggtgctcgatttagtacacgtgattagggattgggggggagggaacgtgtcgtcgtagtttgggttaccgacgaagggaaccggaactagggaaggacccctaccggctcgtacgccgttccttcgtttcccttccctcgtccgtcccttcgtcggtcctaccgaccgagggtaacccacccgggtaacgtnttaactttccgttttggtaaccacgtacggtcgtccctaacggacacgttcggtcggttcgttcggtcgtcctaccggaggggaggcgtaacncctaccccgtctccgtcggagacgggcctacggtnaacggtagtgttccgaccgacttccgttagccggtacgaaccaacgaaaaccgtcggcaccgccgtacccgaggtcctacgttctaccgtntacgcggcctaacgctaccgacgagtccgancgctacncgacgcgtagtgcgtgcgactcgacgtcggagacgcgtanacgttactcacctcgaatcgtacagacgttcgtaccggaccgtagtacgttacgtttaccgagttaaccgttttattaaccggtccttacggtaccgtacggttccgtacggttccggtccgtaccgggaccttcgtacccgtacggttacccgacggtaacggaacggttccagggttacacggtaacgaacgtaccgttacgcggtaccgtcgtccgacgtaaccgttaacgcgtttactccggtacc

SEQ ID NO: 48876 - DNA, 662 bp, Homo sapiens
  misc_feature: GYAE6OF02F5YZR.23.23.C01.1.454.CMB.1.raw
  modified_base (527)..(527): a, c, t, g, unknown or other
  misc_feature (527)..(527): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggcctccagacgaccaccggagatattcttttgacacagtctccagacatcgtcgtctgtcgtctccgaggggagacgcgcccaccctctcctgcgacgggccagtcgagtagtcgtcgccgtacttccgtggcctacgtaaccaaacaaaacccgtcggccacgtaccctaccgacggtcctcgtactacttcacgtcgacacctactacccgaaacggacgggaccctagtcggacctacgtcccgaaggtcgtacggttacgacggtcggacgtacgggtcgtaccgtggtacggactacgtaccttacgcctaccgtacacgtactacgacgtacgtacggtactaccccggtacgtacggtacttcgtttctaacgttacgtttattacgtntcggacgtacgtacggtcggacctcgtaccgtactacgtacctaccggttacgacggacgtcgactacggagtacgaacgtaacgaacgtgtcgtaccggtactacgtacctcgtacttccgttactcgttaccc

SEQ ID NO: 48877 - DNA, 686 bp, Homo sapiens
  misc_feature: GYAE6OF02G6DJE.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctccagagaccaccggagatattcttttgacacagtctccagacatcgtgtctgtgtctccaggtgagagacgcccaccctctcctgcagggccagtcagagtgttcgccgactccgtggcctacggtaaccaaacgaaaaccgtggaccacgcctccgaggctcgtcattcagtcgcacactaccaacgacggccacgtgaccacgtcccgaaggctaggttccgaggtcggacgaggtcggcctcggacgggactacgtaccttacgaccttcgaccgacgtataccaggactacggtccgtacccgtacccgtagtaccgtttacgttttcggaccgtttaagttttacgttaacttcggttaccgacggtaccgtaacgggttcggccggtcccgttacggtaccccttaacgttcccgttaaccgtttacccgggaaccgtaaacgggtacctaccgggtacgtacgggtaacgtaacgaaccggtaaaaccggtacggttccggtacggaccgttacgtacccgtaccgtacgtttcgtcgttacccg

SEQ ID NO: 48878 - DNA, 621 bp, Homo sapiens
  misc_feature: GYAE6OF02FLWI2.23.23.C01.1.454.CMB.1.raw
  modified_base (194)..(194): a, c, t, g, unknown or other
  misc_feature (194)..(194): n is a, c, g, or t
  modified_base (207)..(207): a, c, t, g, unknown or other
  misc_feature (207)..(207): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagacccaccgggagattattctttttgacacagtcctccagacatcgtgtctgtntctccgagggganagagccaccctctcctgcagggccagtccagagtgttgccgactccgtggccttaggtaccaaacaaaaacctggccagccctccgaggtctcgtcacttcatggcacatccaacagggccactgcatccaggcagttcagtgcagtggctcgtggacagacttacactcctacaccgtatacgacgtctaacggtcgtacccggacccttacggacgttacgttttcggaccgttaaggttttacttacgtagttaccctaagtaccgtaacggttcggcccgtccgtacggtacccttacgtaccgtaacccgttaccgggccgttaaacgggacttaccggtcgttaggacgtagtaacggtaaacgtacgtggtcggtacgtcgactaccgtatccgttggtacttaccg

SEQ ID NO: 48879 - DNA, 950 bp, Homo sapiens
  misc_feature: GYAE6OF02JBXBQ.23.23.C01.1.454.CMB.1.raw
  modified_base (203)..(203): a, c, t, g, unknown or other
  misc_feature (203)..(203): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggcctcccagagaccaccggagatattcttttgacacagtctccagacatcgtgtctgtgtctccgagggganagacgccaccctctcctgcacgggccagttcaggtagtgttgccgtacgttccttggccttcggtaacccaaactaaaaacctcgggacccacgtcccctaccccgacggtccgttaccggttacctaacgtttccgaacgttcggggacctaaccgtaacgttaccccgaaaacccggaccggggggtacccctaaacggttccggggaaccctaacccggttacccccgtaaaccggggttccgggttaaaacgggtttcccggtaacgggttaccgggaccggtaaggggttcgggtacccgttcgggttacggggaaccgtacggtaccgtttaccaaaccgttcccggttaccgaacccgggtattacgtaccgggaacccgtacgggtttaccggtaccccggtaaccccggtttacggtaacggttttaacgttttacggaccgttttacgtttttaaacgttaccgttacgttaccgtaaacggttcccggtaaaccggtttcgggtacccggttccgggttaccgggtacccgtttaaccgtcccgtttaacccgggtttcccgggtaaacccggtaaacggggtaccccgttaacggttaccccggttacggggtaaccggtaaccgggttaaacccggtaaaaccgggtttaccggtacgggtttaccgggtaccggtaacccggtaccgttaacccgtaccgttttaccggttaccgtttacccgtttaccccgg

SEQ ID NO: 48880 - DNA, 650 bp, Homo sapiens
  misc_feature: GYAE6OF02JS7Y0.23.23.C01.1.454.CMB.1.raw
  modified_base (205)..(205): a, c, t, g, unknown or other
  misc_feature (205)..(205): n is a, c, g, or t
tcagacgcgagtatcacgaccggtgctcgatttagtacacgtgattagggattggggggaggaactgctcagtttggacccagagggaaccatggaagccccagctcagcttctcttcctcctgctcctctggctcccagagaccaccggagattattcttttgacacagtctccagacatccgtgtctgtgtctccgagggganagacgcccaccctctcctgcagggccagtcagagtgtcgccgactcttggcctaggtaccaacaaaacctcgaccacgcctccgaggctcgtcattcatcggcacactaccaacgcgggaccacgtcggaccacgtcccgaggcgtacggtcaggtcggcaggtcgcgtcgtacgggactacgtactcaccttcgtacgtaacgtctacgacgcgtacgtcgtaccgtacccgtggtacttcgtttacgacgtttagttacttacgttcgtacgtacgtacgtacggtcggaccgtccgttacggtcctacttaccgtacccgtacgggaccgtacgggtacccttacgggaccgtcggtaacgtacgtaacggtaaccgtacggtacgggttacgaccttacggtaccgtacccgttacggttccttaccggttaccttaccgg

SEQ ID NO: 48881 - DNA, 740 bp, Homo sapiens
  misc_feature: GYAE6OF02JL1VI.23.23.C01.1.454.CMB.1.raw
  modified_base (183)..(183): a, c, t, g, unknown or other
  misc_feature (183)..(183): n is a, c, g, or t
  modified_base (724)..(724): a, c, t, g, unknown or other
  misc_feature (724)..(724): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggngcagtctgggcctgaggtgaagaacgccgtggggacatcagtagaaagtcaccgtgacgaaggtcttacgaggtactacctaccgttacaacctaaatttgacgttactaccgtaacgtgggtacgaccgaccgaccggtccccgtaagggaaacggcgtacggaggtacggagtcgggtcggtgggtgacgtccgtaggtcgttagacgaacggtaccgggactacgttcgtacgtaacggtaaggttaccgaacgggtcccgacggtactaccggtacgtcccgtacggtacccgtacgggtaaacttaccgttaccgaacggaaacgtaaccgaccgttaccctaaggtttaggaaaccgttcggtaccggacccggtaccgttacgtaacccgtgtacggaaccgaccgtaccgggtaccgttagttacgtttaagtcggagtccggtaagggcgtacgggaccggtccggtaaccggtttagggtttaacggaatttacggttaggttacggtaaggttccggaaggtttccgggngggaaccgtacggggg

SEQ ID NO: 48882 - DNA, 700 bp, Homo sapiens
  misc_feature: GYAE6OF02H4ZTH.23.23.C01.1.454.CMB.1.raw
  modified_base (203)..(203): a, c, t, g, unknown or other
  misc_feature (203)..(203): n is a, c, g, or t
tcagacgcgagtatcacgaccggtgctcgatttagtacacgtgattagggattggggggaggaactgctcagtttggacccagagggaaccatggaagccccagctcagcttctcttcctcctgctcctctggctcccagagaccaccggagatattcttttgacacagtctccagacatcgtgtctgtgtctcgaagggganagacgccacccgtctcctgcgacgggccagtcaggagtgttgccgtacttccgttcggccgttacggtaaccaaaaccaaaaaccgtcggaccacgccctaccgacggtcctaccgtactacttacagtcggacacaactaccgaacgtacgggaccacgtcggtaccaacgtcccgaggaccgtaggtactaggtcggccgtaggtcggctacggtacgggaactacgtaccgttacaccgttcctacgaacgtactacgacgtacgtacgtcggtaccgtacccgtagtacttagtttacgatttaacgttacttacttacggtacacgttacgaacggtcggtaccgtccgttacggcccttaacgtcccttaccggttacggacccggtaaagggtcccttacgggacgttacgggaacgtaacgtacggtaaaacgtacgtcggttaacgccgtcgaacctaaccgttacggtacgttacgtaccgttaccg

SEQ ID NO: 48883 - DNA, 668 bp, Homo sapiens
  misc_feature: GYAE6OF02IQFLM.23.23.C01.1.454.CMB.1.raw
  modified_base (126)..(126): a, c, t, g, unknown or other
  misc_feature (126)..(126): n is a, c, g, or t
  modified_base (165)..(165): a, c, t, g, unknown or other
  misc_feature (165)..(165): n is a, c, g, or t
  modified_base (175)..(175): a, c, t, g, unknown or other
  misc_feature (175)..(175): n is a, c, g, or t
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
  modified_base (228)..(228): a, c, t, g, unknown or other
  misc_feature (228)..(228): n is a, c, g, or t
  modified_base (304)..(304): a, c, t, g, unknown or other
  misc_feature (304)..(304): n is a, c, g, or t
  modified_base (315)..(315): a, c, t, g, unknown or other
  misc_feature (315)..(315): n is a, c, g, or t
  modified_base (323)..(323): a, c, t, g, unknown or other
  misc_feature (323)..(323): n is a, c, g, or t
  modified_base (331)..(331): a, c, t, g, unknown or other
  misc_feature (331)..(331): n is a, c, g, or t
  modified_base (352)..(352): a, c, t, g, unknown or other
  misc_feature (352)..(352): n is a, c, g, or t
  modified_base (373)..(373): a, c, t, g, unknown or other
  misc_feature (373)..(373): n is a, c, g, or t
  modified_base (386)..(386): a, c, t, g, unknown or other
  misc_feature (386)..(386): n is a, c, g, or t
  modified_base (426)..(426): a, c, t, g, unknown or other
  misc_feature (426)..(426): n is a, c, g, or t
  modified_base (480)..(480): a, c, t, g, unknown or other
  misc_feature (480)..(480): n is a, c, g, or t
  modified_base (535)..(535): a, c, t, g, unknown or other
  misc_feature (535)..(535): n is a, c, g, or t
  modified_base (658)..(658): a, c, t, g, unknown or other
  misc_feature (658)..(658): n is a, c, g, or t
tcagacgcgagtatcacgaccggtgctcgatttagtacacgtgattagggattggggggaggaactgctcaggtttggaccagagggaaccatggaagccccagctcagcttcctcttcctccgtnccttcctctggcctccagacgaccgaccggtagaacttnttcgttttanacctactagttcaccgtaagacctgttcgtgtntcggtntcgtacgagggganacggtcgcctaccgtctcgcgaacgcggctacgcgtagtcgtctcgacttcgcgtcacgtcgaactaaaccggtanccgacgtaccnccggtacnggtaaccnctaagtccgtatcaccggtanccttacaaccgaccgggaccngttaaaccccggngtaaccgtaccggtaccggtacgtaacgtagtacgtacgnggtacgttcggctaagtcggacgccgtaactcgtaccttactaaacggccgtanacgtctcgtacggacgtccgtacgtacgtagtccgttatacggttacgtacgttntgtacgttacgacgtacgtcgtcgtacgtcgtaacgaacctcgtactccgtacggtacgtacggtcgtacgtaacgactaacggaacgtgtaacgcggtcgtacgacctcgtcgtcgtacgtntacgtctacg

SEQ ID NO: 48884 - DNA, 862 bp, Homo sapiens
  misc_feature: GYAE6OF02FSCOI.23.23.C01.1.454.CMB.1.raw
tcagacgcgagtatcacgaccggtgctcgatttagtacacgtgattagggattgggggaggaactgctcagtttggacccagagggaaccatggaagccctagctcagcttctcttcctcctgctcctctggctccagacgaccacggagatacttcttttgacacgagtctaccagacagtcgtgtctgtgtctcgaggggacagcgccacctctccgtgcgacgggccagtcaggagtgttcgccgtactccgttggccttcggtaaaccaaaaccgtaaaaccgtcggaccctacggtacccctacccggagtccttaccggtcactttccgagtccgggacctacgtactacccgtaaacggtaccgggacctaacggtcggacctaccgtacccgacgggtaccgtacgggttacgaaggggttcggaccgtaggggttaccggtaccttcgggtaacggggtaacctaacgggttaccttaacccgaacctttcccggtacgtaaaccggtacttacccggtaggtacggttaccggtacgggttaccccgtaaacccggtacgggtttaaaccgtttacggttttacgtaaaccggttttacgttttttaaacggttaccgttacggttacccgtaacggttacccgggttaaacggttcccgggtcccgtttaacccggttcgggttaaccctttacgttaacccggtacccgggtttaccggggtaacccgtaaaccggggttaactttcccgggaaacgggtttgaaacgggtaaccgtaaaggttaaacccggcggttgtaccgggtacttacggacccttaaccggtacttcggttacgtacccgtttac

SEQ ID NO: 48885 - DNA, 726 bp, Homo sapiens
  misc_feature: GYAE6OF02FSQNC.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagcccaccctctcctgcgagggccagtcagagtgttcgccgactccgttggcctggtaaccaaacaaaacctggccacgcctccaggctcgtcattcagtggcacactccaacgacgggccacgtcggcactcccgaggcctacgggttcaggtcggacgaggtcggctcgtgggacacggtacttctaacctctacgacgtactcacggtctaacggttcgtaccgacccgttaggtaccgttagtttcgaccgttagtttttacgttaaccgttgttaccgtaggtaccgtaacgggtccgggaccgtacccggttacgggtaccccttacgttacccggtaaccccggtttaccggggaacccgttaaacgggggtacccttaccggggtaaccggttacggggaaacggtaccgttaaacgggtaaaaccgggttaaccgttcggggttacggtacccgtttacggaaccccgtaaccggttacggtttacccggtttacgtttacccgtttaacccg

SEQ ID NO: 48886 - DNA, 775 bp, Homo sapiens
  misc_feature: GYAE6OF02G6NQI.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctggaggtgaagaagccgtgggcagtcagtgaaagtcactgacaaggtctcgaggtatacaccgttacaacctaaatttgaattactactaacgtgggtagacgtacgacggcccgtaagggaaaacggtctacggtagtacggagtcggggcgttagggagtacggtccttaagggttgttaggaagtaaccggtaccggtactacgttcgtacgtaaggtaacggttacgaacgggtccctaaagggtcctacgtaaccgtcgttacggaacccggttaagtaacccgttaaccgttacccgaaacggaaacgtaaccgaaacgtaccccgttaaggtttacggaaaccgttcggcccgggtaaccggtaccgttaccggtaacccttcgtacgggtaaccgaccggtaaccggtccgttaggttaactttggttaccggtaggtaaccggtagggaccgggtacggggtaccggtaccggtacgggtttaacggttttaagggaaccgttaaggttttacgggttacgggttaagttcggtaaccgggtttgggtaccggggtaccgttaaccggggg

SEQ ID NO: 48887 - DNA, 734 bp, Homo sapiens
  misc_feature: GYAE6OF02J0VMT.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagagccgtggggcatcagtgaagtcacctgcaaggctcgaggatacaccttcaacctaaatttgatactactaacgtgggtagacgtacgacggccccgtagggaaacggctcggagttggagtgggtcgtgggtgacgtccgtaggttgttaggaacgaacgtaccggcgtattcgtacgtagtaacgttcgaacggtccgtacggtcgtacgtacgtccgtcggtaaccgtcgggaaaccctaaccgtttaccggaaggtaaacgaaaccgtaccgtacccgttaaggttttacgggaaccgttacgggaccggacgggttaccctacggtaccgtaccggtacgtaacccggacggtaacccgggtccgttaggtttagtttaacgttcggtcgggaaccgtagggaggggtaccggacggggtacccggttacggtttaacggtttttacgggaaagttttacgttaaggttcgggttaacggttacgggtaccggtttcgggaccggggtacgggtaaaccggggg

SEQ ID NO: 48888 - DNA, 740 bp, Homo sapiens
  misc_feature: GYAE6OF02GJ6OQ.23.23.C01.1.454.CMB.1.raw
tcagacgcgagtatcacgaccggtgctcgatttagtacacgtgattagggattgggggagtcaacaaccacatctgtcctcgagaggacaccctgtgaccacagctcctcaccatggactggacctggacgatcctcttctggtggcagcagccagaagtcgcccactcccgagaggaacttggtcgacagtcgtgggcctggaggtgaagacgccgtgggacgatcgaagtagaaacgtccacgtgcgtaaggcttacgagtatacctaccgtacaaccgttaatttcgatactacgaacgtcgggtgccgtacgtacggtaccccgtaaggggaaacggtccgtaggtacggtacgggtaacgtgggtacgtcgggtacggacggttcgttaaggtccgttttgggaaacggtaacgttacccggggtactttacgttactaccggtaaggtaaaaccgttccggaacggggtcccaacgggtaacttcggaaccgtaccgtacgtaccgtaacggtaccaccgttcggaaacgtaacgacctacgaccttaggtaccgtacgtcgccgacgtccgaacgtcgtacgacgaccgaacgccggttaccgtgttaactttgttagcggtaacgggtacgagggacggccggtacggttccggttagtttaacgggttactaagtttagggttacgttacgggttacggtacggttacgggtaccggacggttaaccgggg

SEQ ID NO: 48889 - DNA, 644 bp, Homo sapiens
  misc_feature: GYAE6OF02IYXUO.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagccgtggggcatcagtgaaagtcacctgcaggctcaggatacaccttcaccaaatttgatatcaactgggtgcgacacggcccctagggaaaacgggctacggagtgggagtggggctgggtgacgttccgtaggtgtttgacggaagtccgggatacttctcgagtaagttcaacggtccaaggtcctgacgtccgtgaaccgtggaactaccttaccgaagtaacgaaacgacgtacctagtttacggaaccgttgaccggtcgccgtacgaccctctacggacgtaacccgcgggtaccggtagtactttacgttggtacggaccggaagtccggggacggtacggcccgggtacgttacgggtttttagggaaagtttacgttagttagggttactagggtaccggtcggtacgggggtaccgtaaccggggg

SEQ ID NO: 48890 - DNA, 649 bp, Homo sapiens
  misc_feature: GYAE6OF02G1B1G.23.23.C01.1.454.CMB.1.raw
  modified_base (202)..(202): a, c, t, g, unknown or other
  misc_feature (202)..(202): n is a, c, g, or t
  modified_base (233)..(233): a, c, t, g, unknown or other
  misc_feature (233)..(233): n is a, c, g, or t
  modified_base (539)..(539): a, c, t, g, unknown or other
  misc_feature (539)..(539): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgactacagtctccagacatcgtgtctgtgtctcgagggganagagccaccctctcctgcagggccagtcagngtgttcgccgacttccgtggcctaggtaaccaaacaaaacctcggaccacgcccctaccgaggtccttccgtactacttacacgtcggaccaacactacccgaacgacgggccaacgtcggacacgtccgaggtactacggttacgaggtacggacgacgggttcggccttacgggtacggggaactacggttaacctttccgaaccttccgtacgtaccggtaacttcgaacgtcgtaacggttcgtaacccgtacccgtaggtaacgttagtttacggacttacggttttaactacgtcgtacncgtactacggtcgacgtcggtcacgtactccgacgtccgacggtacgactcgactggaactacgtaacgtaacgtacgtgtcgatcgacgtctactcgttacgtcttacg

SEQ ID NO: 48891 - DNA, 643 bp, Homo sapiens
  misc_feature: GYAE6OF02HH55E.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggagttgggggaggaactgctcagtttggacccagagggaaccatggaagccccagctcagcttctcttcctcctgctctctggctcccagagaccaccggagatattcttttgacacagtctccagacatcgtgtctgtgtctccagggganagacgccaccctctcctgcagggccagtcagagtgttgccgtactcttggcctggtaaccaaaccaaaaaccgtggaccacgcctaccgaggctcgtcattcagtgcacgactaccaacgacggccaacgtggaccacgtcccgaggcgtacggttcgacgtacggctaggtacggtcgtcgtacgggaactaggtacctttcacgttacgtaccgtaacgtactacgacgcgtaacgttcggtaacccgtacccgtaggtaaccgttagtttacgaccgttaagttttacgttaacgtggttaccagtaacggtacggttcggcccttacgtccgggtacctacgtccgtaaccgttccggaacgtaaacggcgttcgaacgtggactacggaagtaaccgtacgtggtacgtcgcgtacacctagtcttcggtcttaacg

SEQ ID NO: 48892 - DNA, 758 bp, Homo sapiens
  misc_feature: GYAE6OF02IJ41O.23.23.C01.1.454.CMB.1.raw
tcagacgcgagtatcacgaccggtgctcgatttagtacacgtgattagggattggggggaggaactgctcagtttggacccagagggaaccatggaagccccagctcaggcttctcttcctcctgctcctctggcctcccagacgaccaccgggagatattcttttgacacagtctccagacatcgtgtctgtcgtctccgaggggagacgacgcccacctcctcctcggcacggggcctaggtcaggtaggttcggtacgcccggtactccgttcgggtccgttacggtaacccaaacctaaaaaccggtcggaccgtaccgtcccgtaccccgaggcccgtacgtctacttaccaagtcggacaccgtactaccgaacgtaccgggaccacgtcgacctaactcccgagggacctagggtcgtaggcggtacgaggttcgaccgtcgggtacgggtctaacgtacgttaccgtcctacgtaccgtaccgacctagacggtacgtaacggtccggtacccggtaccgttagtaccggtttagtttacggtacgtttaacgtttgttaaccgtcgttacgtacgaccggtaacggtcgggttacccgcggttccggtcttaccgtccgttacccggtccgtaaccggtaacggtcccgtacgtacgtaccgggaaggtaacgtaacgggaaaccgtgggttaccggtaggttaccgccggtaactaccgttccttaccgtttaccgtccttaacccgg

SEQ ID NO: 48893 - DNA, 791 bp, Homo sapiens
  misc_feature: GYAE6OF02F87OZ.23.23.C01.1.454.CMB.1.raw
  modified_base (262)..(262): a, c, t, g, unknown or other
  misc_feature (262)..(262): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcgttcttggtggcagcagccagaagtgcccactcccacgaggaattggtgcagtctgggcctgaggtgaagagcctgggcagtcagtgaagtcacctgcaaggtctcagatacacctacactaattnatatacagtggtcgacgacgaccggtacccgtaagggaacggtcgtacggaggtaggaggtcgggtacgttgggtacgtaccgttacgtaggttagttagaacggtaacgtaccgggtacttaacgttccgtaactaacggttaaacgttaccgaaacgggtaccgtaacgggtacctaccgtaccggtacccgtaacggtacccgtaacggtaaccctacccgttaaccgtaaacggtaaaccgaaccgtaaccggtaacccgttaaacgggttaccggtaaccgttaccgggaccggtacccgggtacccgttaccggtacccgttaccggtaccggacccgtaccggtacccgggtaccgttagttacgtttacggttacgtacgggtacggtacgggtacgggtaccgggtaccgggtaccggttacgggtttaacggttttaacgggtaacgtttacgtttagggtaggtttacggttaccgggttacgggttacgggttaccggggtaacccggtaaccgggg

SEQ ID NO: 48894 - DNA, 657 bp, Homo sapiens
  misc_feature: GYAE6OF02FS3NV.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgactccttggcctggtaccaacaaaacctggccagccctccaggctcgtcacttcatggcacactaccaacgacgggaccacgtcggaccacgtcccgaggcctacggttcgaggtcggacaggtcggcgtcgtacgggacacgtacttccactcctacgaccgtactcgacgacgtacggtcgtaccgtacccgtagtaccgttacttttcgacttagttttacttacgtcgtacagtaccgtacggtcggaccgccgttcgggtacccttactacccgtacccgttaccgggacccgtaaacgggtaccctaccggtacgttagggaacgtaacgtaacgggtaaaccggtacgttagggttacgggtaccttacggacccgtaacctacgtttcccgttagttaccgtttaccc

SEQ ID NO: 48895 - DNA, 677 bp, Homo sapiens
  misc_feature: GYAE6OF02HNLT6.23.23.C01.1.454.CMB.1.raw
  modified_base (202)..(202): a, c, t, g, unknown or other
  misc_feature (202)..(202): n is a, c, g, or t
  modified_base (475)..(475): a, c, t, g, unknown or other
  misc_feature (475)..(475): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagattattcttttgacacagtctccagacatcgtgtctgtgtctcgagggganagagcccaccctctcctgcgagggccagtcgagagtgttgccgactccttggcctaggtaaccaaacaaaacctggaccacgccctcccgaggctcgtctattccagtcggcacactaccgaaacgacgggacccaacgtcggacctacgtacccgaagggtaccacgggtttacaagggtcggcgtaagggtcgggtacgtacggtagggaactagtaccttcgaccgtctacaacgtctcgagctaggtccgtaccgacccttgaacgttntttggactttaagtttacgttacgttcgacgtgtacgtaacggcgtacggtaccgttggaccctacttacccggtacccgtttacgggaacccgtaaagggtccgttacggacgttacgggaagttaacggtaaccggaaaccgttagtacggggtacgacctagaccccgtaacgttagttcgtttacgttccgttacccg

SEQ ID NO: 48896 - DNA, 878 bp, Homo sapiens
  misc_feature: GYAE6OF02HOTU6.23.23.C01.1.454.CMB.1.raw
  modified_base (290)..(290): a, c, t, g, unknown or other
  misc_feature (290)..(290): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtcgcccacctcccacgaggtaattggtgcgagtcgtcgggcctggaggtagaagaagccggtgggactatcgagtagaaggtccaccgtgacgaaggtctacgaggactacctaccttacaactaagtttnaatattactacgttgggcgacgacgaccggacccgtaagggaaacggtcgacgtaggtcggacggttcgggtaccggttgggtaggtaccggtttaccggttaggtttagggttaacggaaggtaacccggttaccgggtactttacgttaccgtaacggttaacgtaacggttaccggaacgggttaccacgggtaccttaccgaccggtaccgtaccggtaccgttaaccggtaaacccgttaccgttaaaccggaaacgaaaccggtaaacccgtaccggttaacccgttaagggttttaaccggaaccggttaccgggtcccgttaccggtacccggttaaccgttacccgttaccgtacgggaacccggaacccggtacccgggttccggttaagtttacgttttaacggtacgggttacggaacgggtacggtacccggggtcggggtaaccgggttacccgggttaccgggtttttaagggtttaaccgggtaagttttaaccggtttaggttaacgggtttaccggtacggggtttacccgggttaacggggtcccgggggttaaacggtaacccggggg

SEQ ID NO: 48897 - DNA, 719 bp, Homo sapiens
  misc_feature: GYAE6OF02IXGS2.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtagaaagtcacctgacaaggtcttcgaaggactaccaccttccaacctaatttcgatactacacgtggtgacgacgacggaccccgtagggaaacggcgtacggaggtacggaggtcgggcggtagggtagtacgttccgtaggttggtaggacgtaacggtaccgggactacgttctacgaacggtaacgttacgaaacggtccgacggtcctacgtacggtccgtacggtacccgtaggtaaaccctaccgttaacgaaacgaaacgaaccgaaccggtacccttaacggttacggaaccgttcgaccggtccggccgtacgtaccgtacggtacgaaccggtaccgaccggtacgttagttagtttacgttcggtacgtacggaggtacgggtacggaccgggtccggtaacggtttagggttttacgggaagtttacgtttaggttaggttacggttacggtccgggtacgggttcgggggaccgtaacggggg

SEQ ID NO: 48898 - DNA, 663 bp, Homo sapiens
  misc_feature: GYAE6OF02G7AAB.23.23.C01.1.454.CMB.1.raw
  modified_base (202)..(202): a, c, t, g, unknown or other
  misc_feature (202)..(202): n is a, c, g, or t
  modified_base (436)..(436): a, c, t, g, unknown or other
  misc_feature (436)..(436): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganaggacgccaccctctcctgcgagggccagtcagagtgttcgccgactccttggcctacggtaaccaaaacaaaaaccgtcggaccacgtccctaccgaggcctcgtcattcatcggactacactaccaacgacggaccacgtgacacctccgaggacgtaggttacgaggtcggactagggtcggccttcgggtacgggactaaggtaccttacgtacctctaccgtacgtacncgacgtacgaggtcgtaccgtaccgtagtacgtagtttacgacgttagtttacttacggtcttacaacgtactaacgggtcggcgtaccgtacgtacccttacgtccgtaaccgttcgggtaaccgtacgggtaccgtaccgtacggtacgggtaataacggtaacggaaaccgttacggtcggtacggtcgtacgtacctacgtacttccgttacgtaccttaccg

SEQ ID NO: 48899 - DNA, 848 bp, Homo sapiens
  misc_feature: GYAE6OF02ID1NC.23.23.C01.1.454.CMB.1.raw
  modified_base (730)..(730): a, c, t, g, unknown or other
  misc_feature (730)..(730): n is a, c, g, or t
tcagacgcgagtatcacgaccggtgctcgatttagtacacgtgattagggattgggggagtcaacaacccacatctgtcctcgagaggacaccctgtgaccacagctcctcaccagtggactggaccgtggacgatcctcttcttggtggcagcagccagaagtcgcccacctcccgacggagtaagttggtgctagtcgtgggcctggaggtagaagaacgcgtggggacagtacgtaggtagtaaacgtcaccgtacgacgtaacggtcttacgaaggtaacttaacctacccctttacaaaccttaaacgtttagtaacttacttaaccgtaacgggttggggttaccggaccggtacccggtacccggggtacccccggtaaggggtaaaaccggggtccgtaacggtagggtagggtgggtacggggtcgggttaggggttacggtaggttacgttacggttaggttacggtaaacgggtaacccggtaccgggtacttacgttacgtacgtaaggtaacggtaacggtacggaacgtacggtaccgtaccgtaccgtcccgtaccgtaaccggtaccgtaacccgtacgtaacccgaaaggaaccgtaacgaacccgtaccgttaacgggtacgtaccggtcggaccggtcccggtaccgtccgtccgtaccgacggaacccggtaccgtccggtacggttacgtttagttacgtcggtacggnggaacgggtcggaccgggtacgggtcccggttaagggttttaaggtttaaggtacgtttaaggtgggttaacggttggtacggggttaccgggtacgggtccgggtacggtacggggg

SEQ ID NO: 48900 - DNA, 850 bp, Homo sapiens
  misc_feature: GYAE6OF02F961L.23.23.C01.1.454.CMB.1.raw
  modified_base (285)..(285): a, c, t, g, unknown or other
  misc_feature (285)..(285): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgagaattggtgcagtctgggcctgaggtgaagaagccgtggggcatcagtagaaagtcacctgacaaggcttacaggatacaccttcaacctaattgatatcaacgtgggtcncgacgacggaccccgtagggaaacgggtcgtaccggaggtacgggtagtacggggcgttaggggtgtacgtccgtaggttcgtaggaacggtaacgtaccggggtacctaagttccgtacgtaacggtaacgtttaccgaaacgggtcccgaacggtcccttacgaccgtacccgttacggtaccccgttaacgggaaaccctaccgtttaccgaaacggaaacgtaaaccgtaacccggtaacccctaacggttttacgggaaccgttaccgggacccggtcccgggtacccggttaccggaacccctttcggtacccgggtaaaccccggtaaccggtaaccccggggttcccggtttaacggtttaaccgttttaacgtttaggttaccggtaaccggggtaacgggaaccggggtacccggggtaaccggggtccccgggtttaaccgggttacgggttttttaacggggtaacttttaacgggttttaaggttacgggtttaacgggttagggttaccgggtttaccggggttaccgggggaccggttaaacccgggggg

SEQ ID NO: 48901 - DNA, 765 bp, Homo sapiens
  misc_feature: GYAE6OF02H50PQ.23.23.C01.1.454.CMB.1.raw
  modified_base (197)..(197): a, c, t, g, unknown or other
  misc_feature (197)..(197): n is a, c, g, or t
  modified_base (210)..(210): a, c, t, g, unknown or other
  misc_feature (210)..(210): n is a, c, g, or t
tcagacgcgagtatcacgaccggtgctcgatttagtacacgtgattagggattgggggaggaactgctcagtttggaccagagggaaccatggaacgccccagctcagcttctcttcctcctgctcctctcggcctcccagacgaccaccggagtattactttcttttagacacagtctccagacatcgtgtctgtntctccgagggganagacgcccaccctcctccgtcgcgacgggccacgtcaggtaggttcgttcgccgtacttccgttcggccttacggtaaccaaaactaaaaaccgtcggaccacggtcccctacccgaacggtcctcgttacacttacacgtcggacactactaccaacgcgggacctacgtcggacaccgtcccgaggtccgtagtactaggtcggacgtaggtcggccttcgagggacacgtaccttcaccgttcacgacgtatacgagtcagttccgtaccgtacccgtaggtaacttacgtttacgaccgtttacgttttaacgttacgtttcggtacgtaacggacccgttaaacgggtccggggtacccacccggttacggtacccttaccgttaccccgtttaaccccggggttcccggaaccgtaaaccggggttacccttacggtaaccggttacgggtaacgtaaacgggttaaacgaaaacccggttacggttggggttaccggaccgtacgaacccgtaaccgtacggtaccgtttcggttaccctttaacccg

SEQ ID NO: 48902 - DNA, 710 bp, Homo sapiens
  misc_feature: GYAE6OF02GXOTH.23.23.C01.1.454.CMB.1.raw
  modified_base (205)..(205): a, c, t, g, unknown or other
  misc_feature (205)..(205): n is a, c, g, or t
  modified_base (243)..(243): a, c, t, g, unknown or other
  misc_feature (243)..(243): n is a, c, g, or t
tcagacgcgagtatcacgaccggtgctcgatttagtacacgtgattagggattgggggaggaactgctcagtttggacccagagggaaccatggaagccccagctcagcttctcttcctcctgcctcctctggcctcccagagacccaccggagatatttcttttgacacagtctccagacatcgtgtctgtgtctccgaggggngaggacgcccaccctctcctgcgacgggccagtcaggngtgttcgccgactccgttggcctggtaacccaaacaaaaccgtggaccacgccctcccgagtcctcgtcacttcatcggcacgactccgaaccgacgggacccacgtcgggcctacgtcccgtacggtaccgtaacggtttcgaaggttcggactacggtcggcgtccgtagggaactacggtaccttactaccgttccctacggaacccgtagtacccgagtacctaacgggttcgtacccggtaccctacggtaccgttacgtttcggtaccttaagtttttaactacgtttacgtacgtaacgggtaacttacgggtccggtccgtcccggtccgtaccttaccgttacccgtacccggttacccgggaacgacgggtcctacggacgtaggaacgtacgaacggtaaccgttacgtggtaccggcgtaccggacgaccgtactttcggttaccgttcttaccg

SEQ ID NO: 48903 - DNA, 629 bp, Homo sapiens
  misc_feature: GYAE6OF02FZZCJ.23.23.C01.1.454.CMB.1.raw
  modified_base (394)..(394): a, c, t, g, unknown or other
  misc_feature (394)..(394): n is a, c, g, or t
  modified_base (420)..(420): a, c, t, g, unknown or other
  misc_feature (420)..(420): n is a, c, g, or t
  modified_base (472)..(472): a, c, t, g, unknown or other
  misc_feature (472)..(472): n is a, c, g, or t
  modified_base (491)..(491): a, c, t, g, unknown or other
  misc_feature (491)..(491): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggcctcccagagaccaccggagatattcttttgacacagtctccagacatcgtgtctgtgtctccgaggggagagcgccgtaccctctcctgccgagggccagtcagagtggttgccactccgttggcctaggtaaccaaaccaaaaccgtcggccacgcctcccgaggtcttcgtctacgttcacgtggaccacacgtacccaacgacgggccacgtggaccactcccgagcgtaggttcaggtcggacaggtacggcttcgnggacacggtactcactcgtacgacancacgcacgtcgtccgacctcgacgttattcgcttagtttcgttaatctacgngtaactacggtccggtacnccggtacggtcccttatacccgtccgtttaccggacctaagggccacggtaccgttggacggttacgtaacggaaaccgtcgttcggtaggtaccctacggtaccacccggtttatcccgtttaggtacctttacccg

SEQ ID NO: 48904 - DNA, 770 bp, Homo sapiens
  misc_feature: GYAE6OF02H6WDP.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctccagagaccaccggagatattcttttgacacagtctccagcatcgtgtctgtgtcgtccgaggggagacgagcccaccctctccgtgcgacgggcccagtccgagtaggttggttcgacccgtactcccgttgggacctcgggtaacccaaaccgtaaaaacccgttcggaccctaacggtcccctacccgacggcctccggtactacttctaacgtcgggtaccacctactacccgaaacgacgggcccgtaaccgtcgggacacgtaccccgaggaccgtacgggtttcgacggtcggacgagggtcggccgttacggtacggggactaacggttacgttaccacgtcttaccgacgtactccgtaagcccgtaaggttccggttaaccgtacccgttacgggttaacgttgtttaccggacgtttaaggttttacgtttaaccgttcgtacgtacgttaccgtaaccgggttcggtacccggtccgttaccgggtacccgtttaactcccgttacccggttacggacccgtaacgggtccgtaccgtacggcggtaacgtacgaacggttaaaccggacgttacggcggtaaccgtcgtaaccgtaccgtagttcccgttacggtccttaccg

SEQ ID NO: 48905 - DNA, 870 bp, Homo sapiens
  misc_feature: GYAE6OF02HDFM6.23.23.C01.1.454.CMB.1.raw
tcagacgcgagtatcacgaccggtgctcgatttagtacacgtgattagggattggggagtcaacaaccacatctgtcctcgagaggacaccctgtgaccacagcctcctcaccagtggactggacctggacgatcctcttctggtcggcagcagccagaagtcgaccccacgtcccaacggaggtaacttggtgccgtaaggtcgttcggggcccttggagggtaggaaaggaacggtccggttggggaccacgttcgtaaggttaacggaaacgtaccgacccgttggaaccgtaacgggtccttacgaaggaacttaacctaccgttacaaacttaaagtttacgaattaactacgaacggttgggagaccggtaacgtccggacccggttaagggaaaacggttccgtaacggtggtaacgggtgtacggggtacggttgggtacgtacggttacgtaggttacggtaagtacgaacggtacgggtacttattccgtaacggtaaggtacgttacggaacgtacgacggtacctacggacgtcaacgtaccgtaacggtaacccgtacgttaaccgaaggaaacctaacgaccgtaacctttaaggaacgttaccggaacgtcccgggtacgtacccggtacctaccgtccgtaacggaaccggtacccgtaccggggtttactacggtttaacgtttacggttaacggtccggtaacggttaacgggaccgggggtcccgggaaccgggttaccggtttacgggttttaacgggttacggttttaaccgtttaggtttaacgggtttcggtacgggtttaccgggacgggttttacccggggtacgggaacggttaaccccggggg

SEQ ID NO: 48906 - DNA, 812 bp, Homo sapiens
  misc_feature: GYAE6OF02H1QPW.23.23.C01.1.454.CMB.1.raw
tcagacgcgagtatcacgaccggtgctcgatttagtacacgtgattagggattggggagtcaacaaccacatctgtcctcgagaggacaccctgtgaccacagcctcctcaccatggactggacctggacgatcctcttcttggtggcagcagccagaagtcgcccactcccacgaggtaattggtgcagtcgtggcctgaggtgaagacgccgtagggcatcgaggtagaacgtcaccgtgacgaaggcttgaggtactacctaccttcaacctaaatttgaattactactaacgttcgggtacgaccgaaccgaccggtaccccgtaaggggtaaacggtccgttacggaaggttcggtaaggtcgggtcggttaggggtcggtaacggttccggtaggtttaggttacggaaggtaaccggtacccgggtattacggttacgtaaccggtaaggttacggtttaccggaacgggtaccgtaacggttaccgtaccgacgggtacccgttaaccggtaccggtaaccgggtaaacccttaccggtttaaccgaaacggaaaaccgtacccgaaacggttcccttaaggttttaaccgggaaccgtttcgggtacccggtacccggtaccgttccgaacggttcccgtaacggtacccggaacccggttaccgggtacccgtttagttaaccgttttaggttcggacgacggtacggtcgggacgggtccgtacggtaggtttaccggtttaaggacgtttagttagttggtaacgttcggggacgtttcggccggggtaactaccggggg

SEQ ID NO: 48907 - DNA, 640 bp, Homo sapiens
  misc_feature: GYAE6OF02IUP3K.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagccaccctctcctgcagggccagtcagagtgttgccgtactccttggcctggtaccaacaaaaccgtgaccagcctccaggctcgtctattcagtggcacgtactaccaacgcgggacctacgcggcacgtccccgaggccgtaggttccaggtcggacaggtcggcgtcgtagggacaggtacttcgacttccgtacacgtactcaagctaacggtcgtaccgacccgtagtaccgtttattttaggacctttagttttaacgttacgttacgtcgtaacgtacgtaacggtcggtacccgccgttacgtccgttaactcccggtacccgtttcggaacccggtaaggtaccgtacgtacggtaccgaggtaacgtaacggaaaccgtacggtggtaccgtcgtacgccgaacctacgttcttacgtcttacccg

SEQ ID NO: 48908 - DNA, 960 bp, Homo sapiens
  misc_feature: GYAE6OF02IGUZ5.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactccacgaggaattggtgcagtctgggcctggaggtgaagaagccgtggggcatcagtgaaagtcacctgcaaggctcaggatacaccttacaacctaaatttgatatacaagtgggtagacgacgtaacggtccccgtaggaaaacggggcgtacggtaggtcgggtaagtcgggacgttcggggtgaacggttaccgttaacggttggttacggaaaggaaacggttacccgggggactaacgtttccgtacgtaaacggtaaaggtttaaccggaaacgggtacccgtaagggtaccgttacccgtaacgggcccgtttaaccgggtaacccggttaaccggggtaaaacctaaccccgttttaacccggaaaaggttaaaaccgggaaaaaccgtaaacccggttaaccccggttaacgttttaaaccggggaaaccggtttaaccgggtacccgggtaccgggtaccccctttacgggtaacccccgttaaccgggtaaccgggtaaacccggtaaaccggtaacccggggtacccgggtttaaacggtttaaccgttttaacgttttcggggtaaccggtaaccgggtaacgggggttaaccggggtacccgggggtaaacgggttaccccgggggttaaccgggtttttaaacggggttttttttaaccggggtaaaaacgtttaacggtttttaaacggtttcgggggtttaaacggtttaaccggggttaacccgggggtttaccgggttacgggggggttaacccccggttaaaacccggggggg

SEQ ID NO: 48909 - DNA, 590 bp, Homo sapiens
  misc_feature: GYAE6OF02FZQOL.23.23.C01.1.454.CMB.1.raw
  modified_base (202)..(202): a, c, t, g, unknown or other
  misc_feature (202)..(202): n is a, c, g, or t
  modified_base (584)..(584): a, c, t, g, unknown or other
  misc_feature (584)..(584): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagccaccctctcctgcagggccagtcagagtgttgccgactccgttggcctggtaccaacaaaaacctggaccagcctccaggctcgtcattcatcggcacatccaacgcgggccactgggcactcccaggcaggttcagtggacagtggctcgtgggactagacttcacgtctacacgactacacgctacggtcgtaccgacccgttggacgtagttttggtaactttagttacgttgtactaggtacctaacggtcggtaccgtccgttcggaccttatccgtaccgtttccggaccgtaaacgggtctaccgggacgtcgggagtagtacggaaacgtactgggtcgcgtacggactaccgacttcgtcgttccttntacccg

SEQ ID NO: 48910 - DNA, 901 bp, Homo sapiens
  misc_feature: GYAE6OF02GGHRA.23.23.C01.1.454.CMB.1.raw
  modified_base (142)..(142): a, c, t, g, unknown or other
  misc_feature (142)..(142): n is a, c, g, or t
  modified_base (221)..(221): a, c, t, g, unknown or other
  misc_feature (221)..(221): n is a, c, g, or t
  modified_base (873)..(873): a, c, t, g, unknown or other
  misc_feature (873)..(873): n is a, c, g, or t
tcagacgcgagtatcacgaccggtgctcgatttagtacacgtgatttagggattgggggaggaactgctcagtttggacccagagggaaccatggaagccccagctcagcttctcttcctcctgcttcctctggctcccagngaccaccggatatatttacttttgaccacgtagttcctccagacctagttccgtgtctgttcgtcctccggaggggganacgacgccctacccttccgtacccgtggccggacgggtcccaggtaccacgggtagttcggttacgcccgtacttccccggttggcccgtaacggtaacccaaacgtaaaacccgtcggacccgacgtccccgtccgaccggtcccttcggtacctacgttactaacgtcggacctaaccacgtaaccccgaacgtaccggggtacccaaccggtaccgggtacctacgttaccccgggaacgggtccgttaacggtttccggaaggttaccgggtacgacgggttcggaccggttacggttacggggaacctaggttaaccgtttaccgacccttccgtaccgtaccggtaacgtccgtaagtccggtacctagggtccccgtaaccgtttaggtaaaccgtttacgtttcggtaactttacgttttaacttccgttaacgtttaccgtacgtaaccgggttacgtcggggtacccgtaccgttaccggttccgtttaaccggttaccgttaacccggggtttaccgggaaacccggttaaccggggtaacccgtaccggttaaccggttacggtaacgggttaacgggtaacccgtaaaccggttaccgggttaacggtcggtttacccgacgttacccgttaaccggtntttaacccgttcggtttaccgttacccg

SEQ ID NO: 48911 - DNA, 799 bp, Homo sapiens
  misc_feature: GYAE6OF02J1EKR.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccgaccggagatatttctttagacacagtcctccagacatcgtgttctggtgtcctccggaaggggtacaggacgtccctaccctcgttacctgacgtaacgggccagtcgagtacggttgttacggccgtactccgttggaccctaggtacccaaaccgtaaaccgtggtaccaccggtacctccgacgtccgttaacgtctaacgttctacggtcgaccgacctaactaccgaaacggtcgaccgtacgttacgacctacgtccccggagtcgaacgttcgaaggtcgtacgaggtcgcgtagtacggactcgacgttcaccgtcgtaaccgtagtacctcgtactaccggacgttcgggtaacctacccggtaggttacccgtaagtttaccggtacttaaccgttttaaacgttccggttcaaccgggttaccggtaccgttacggaccgggtaaccgttccgggtttaccgttaacccgttcggtacccgttacgggtacccgggtaaaccggaacgggtttaaccacccgggtaggttaccggtaagtaacggttaaacccgggtaaccggtaacgttcggttaaccggtaacccgttacgggtaccctaaacccggttttcggaacgttttcccggtagttttaaccccg

SEQ ID NO: 48912 - DNA, 878 bp, Homo sapiens
  misc_feature: GYAE6OF02JP3ZF.23.23.C01.1.454.CMB.1.raw
  modified_base (157)..(157): a, c, t, g, unknown or other
  misc_feature (157)..(157): n is a, c, g, or t
  modified_base (221)..(221): a, c, t, g, unknown or other
  misc_feature (221)..(221): n is a, c, g, or t
tcagacgcgagtatcacgaccggtgctcgatttagtacacgtgattagggattgggggaggaactgctcagtttggacccagagggaaccatggaacgccccagctcagcttctcttcctcctgcctcctctcggcctcccagacgacccaccgganacttagtttcttttagaccacgtagttccaccagactactcgtcgtctgtgtcctcgagggganacgtacgccaccctctccgtagccgacggtccagtcagtacgttggtccgtacctcgttcgtggtcctacggtaccaaacgtaaaccgtcgaccgtaccgcctaccgacgtctccgtactattaccagtcgctacactaccgagacgcctactcggacctctaccgacggttaccgttaggtaaccgtcgggtacggtaccgtcgggtttaccggcgtacgggttaacgggtaacccgtacggtttaaccctacccggttaaccccgtaccgtacccgtaaccgggtttaaccgaccggtaaccgttaacccgggtacgggttaccccggttaccccgttacccgggttaaaccgttaccgggttttaaactttcccggggtaaacctttttaaggttttaacccgtttaccggtaaccggttaccggtaaccggttaccgggttaaccgggtcccggttaaaccggttccccggttaccgttaacccgttccgtttacccgttaacccgggttacgggtaaccgttaacggtacccgttacgtacccgggttacggtaacgggtactaaacccggggtaacttaaccgggttccgtaccggtacgtttaccgggaccttaaccggttaggtttcccgtttaccggttagtttcccg

SEQ ID NO: 48913 - DNA, 782 bp, Homo sapiens
  misc_feature: GYAE6OF02GEKP9.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatatttcttttgacacagtctccagacatcgtgtctgtgtctccgaggggagagacgccaccctctcctgcgacggccagtcaggagtgtcgccgtactccgttcggccgtcggtaacccaaacgaaaaacccgtcggaccacgacccctacccgacggtcctcgtactacttacagttcggcaccactaccgtaacgacgggcctacgtcggcacctaccgaggaccgtaggttacgaggtcggctagggtcgggtccgttcggtacgggaacgtacgtaaccgtttaccaccgttcccgtaccgtaaccgtacttaccgaacggaccgtacggtacccgggttacccgaaccccggtttacggaaccgtttacggttttaccgtaacggtttacgtttttaacgtttaccgttacggttaccgacggttaaccgtaacgggtcggacccggttaccgtccggtaccttaccgtaccttaccccgggttacgggaacccggtaaaccgggttaccgtaccgggtacgttacgggaacgttacggtaaaaccggtaaccggttaacggtcggttacggtaccgtaccggaaccgttacccgacgtttccggtttacgttacccttaaccgg

SEQ ID NO: 48914 - DNA, 673 bp, Homo sapiens
  misc_feature: GYAE6OF02IN8D3.23.23.C01.1.454.CMB.1.raw
  modified_base (202)..(202): a, c, t, g, unknown or other
  misc_feature (202)..(202): n is a, c, g, or t
  modified_base (234)..(234): a, c, t, g, unknown or other
  misc_feature (234)..(234): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccgagggganagagccaccctctcctagcagggccagtcagngtgttcgccgtactcttggcctaggtaaccaaaccgaaaaaacctcggaccagccctcccgaaggctccggtacacttcactgggctacactaccaacgtagggcctaacgtcggcacgttcccgacggctaggttcaaggtcggacaggttggaccttcgtagggacacggtacttacgaacttcctacgacgactactaacggcgtaagttcgtaccgtaccctaggtaacgtacgtttcgaccgttaagttttaacttaccgtagtccgaacgtacaacgggtccggcgtacccgtggtcctaagttccgaaccgttcgggaaccgaacgggtacctcgggaacttaggggaacgtagtaacgggtaaaaccagttagggtccggtaacctttggaccgtaacccgttaacttaccgtttacgtacggtttaaccc

SEQ ID NO: 48915 - DNA, 686 bp, Homo sapiens
  misc_feature: GYAE6OF02FKU0V.23.23.C01.1.454.CMB.1.raw
  modified_base (204)..(204): a, c, t, g, unknown or other
  misc_feature (204)..(204): n is a, c, g, or t
tcagacgcgagtatcacgaccggtgctcgatttagtacacgtgattagggattgggggaggaactgctcagtttggaccccagagggaaccatggaagccccagctccagcttctcttcctcctgctcctctggctcccagagaccaccggagatattcttttgacacagtctccagccatccgtgtctgtgtctccgaggganagagcccacctctcctgcacgggccagtcaagtgtagttcgccgactcccgttggcccttggtaacccaaactaaaaccgtggaccacgcccttcccgaggcctcgtccattccattggcctacgataccgaacgtacggacctacgtggaccacgttaccccaggcctaggttccaggtggtaccgtaggtcggtccgttacggtacgggtacctacgtacttccgaccgttctacgtacggacttccgacgacgtagtccggtacacccgtacggtacgttagtttacggacgtttaacggttttactacgttgttcgaacgcgtacgtcggcgtccgtacggtacttaccgtccgttaccgttccggaaacctacggtaccttacggacgtacgggacgtaagttaccggaaacgggttacttcggtaaccgtcgtaccgaccctaacggacctttacgttaccggttacttaaccccg

SEQ ID NO: 48916 - DNA, 807 bp, Homo sapiens
  misc_feature: GYAE6OF02FUQKZ.23.23.C01.1.454.CMB.1.raw
  modified_base (294)..(294): a, c, t, g, unknown or other
  misc_feature (294)..(294): n is a, c, g, or t
  modified_base (516)..(516): a, c, t, g, unknown or other
  misc_feature (516)..(516): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgagaattggtgcagtctggcctgagtgaagagccgtgggcatcagtagaaacgtcaccgtgcaaggtcttacgaggatacctaccttaccaacctaatttagattactacaacgtgggtacncgtaacgtacgggtccccgtaagggaaacggtccgtacgaggtcggagtacgggtcgtgggtagtacggttcctaggttcgttaggacggtaacggtacgggtctacgtttccgtacgaagttaacggtacgaacggtaccgagggttcccaacgtacgtaccggtacgtaacccgtaacgggttaaacctaccgttaccgaaacggtaaacggtaaacccnccggtaacccgttaaccgtttaccgggaaaccgttcggaacccggttccgtaccgttacccgtaacccgtccgttaaccgggtaccggaaaccgttaccccggggtccgtttaacgttacggtttacgtttacggtcggtaacggtacggggtaccggtacggggtaccggtaacccggggtaggttttaacggtttaacggggtaaagtttttacggttaaggtttaccggtacggtttaacccgggtcggtttaacccgggtacccggggtacgggttaaccccggggg

SEQ ID NO: 48917 - DNA, 536 bp, Homo sapiens
  misc_feature: GYAE6OF02FT815.23.23.C01.1.454.CMB.1.raw
  modified_base (202)..(202): a, c, t, g, unknown or other
  misc_feature (202)..(202): n is a, c, g, or t
  modified_base (522)..(522): a, c, t, g, unknown or other
  misc_feature (522)..(522): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggganagagccaccctctcctgcagggccagtcagagtgttgccgactccttggcctggtaccaacaaaacctggccagcctccaggctcgtcattcatggcacatccaacgagggccactggcactcccaggcaggttcagtggcaggtcggctcgtgggactagacttcacttctcacgatcagtcagtcgccgtacctggacgtactttgactagtttacttactgtacagctacggtggcgctggcctagtctaccgttcgccgtaaggctcgactggacgtagtacggaaacgtacgtcggtacgtctcggaccaccgtntcgtcgttcttacg

SEQ ID NO: 48918 - DNA, 690 bp, Homo sapiens
  misc_feature: GYAE6OF02G7QK7.23.23.C01.1.454.CMB.1.raw
  modified_base (214)..(214): a, c, t, g, unknown or other
  misc_feature (214)..(214): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagagcgtgggnatcagtgaatcactgacaggctacgagatacaccttcaacgtaatttgaatatacgtaacgtgggtagcgacgtacggccccgtagggaaaacggcgtacgtaggtggacgtgggcgtgggtgtagtccgtaggtgttagacggtaacgtaccgggacttagtcttacgaagtacgttacgaaacgggtccgtaaggtaccgtacgacgaccgttcgaaccgttacggaacctaccgttaccgaaaggtaaacgaacaccgtacctagttacggaaccttggccgtaccggcgtacgtacccgtcgtaacgaccgaaccggtccgggtcgttaacgttacgtttacggtttacgacggtaccggtagggtaacgggccgggacggtcccgggtaacggtttacgggtttacggtaatttaggttagttcggttaacggtcgggtacggttcggggtagggacccgggttaacgggg

SEQ ID NO: 48919 - DNA, 809 bp, Homo sapiens
  misc_feature: GYAE6OF02IYE3C.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggagttgggggaggaactgctcagtttggacccagagggaaccatggaagccccagctcagcttctcttcctcctgctcctctggctcccagagaccaccggagatattcttttgacacagtctccagacatcgtgtctgtgtctccagggganagagcccaccctcgtcctgcgagggccagtcagagtgttcgccgactccgtggcctaggtaaccaaacgtaaaaaccgtcggaccacgaccctacccgacgggtccttccggtactactttaccgagttacgggacctaacctaactaccccgaaacggaacggggtaccccaaccggtcggacccgtaaccgtccccggaacgggtaccgtaacggggtttaccgaacgggttcgggtaccctaaggggttccgggtaccgttaccgggttacggggggtaaaccctaacgggttaacccttttaccggtaacccttacccgttaacccgtaaaccggtacgttaccgtaacggtaccgtaaacgggtttccgtaaccccggtaacccggttcggtaaaccggtttaacgttttcggtaacccgttaaagtttttacgttaaccgttacgttaccgacgtaaccgtacggttacgggaccgtccggtacggtacccttagtcccgtacccgtttccggaccgtaagggtcctacggacgtggtaacgtacgtaacgaaccggtacgtggtacgacgtcgacctcgtaacttccgtagttcctaccg

SEQ ID NO: 48920 - DNA, 881 bp, Homo sapiens
  misc_feature: GYAE6OF02FYOY1.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctcggcctcccagacgaccaccggagattattcttttgacacagtctccagacatcgtgtctgtgtctcgaaggggagagacgccctacccgtctccgtgccgagggcccaggtccaggtacgttggttcggcccgtacttccgtttcgggaccttacgggtaaccaaaacctaaaaccgttcggaaccctaacgccccttacccggacggtccttccggtacttattccgaacgtcgggacctaactacgttaacccgaaaccggaccgggtaccccaacggtcgggaccacgttaaccccggacggtaaccgttaggttccgaggttaccggtacgtacggttcggtaccgttcggtacgggtaacacgtactttacgccttacccggttacaaccgtgtaaccgaagttcccgtaacgtccggggtacctaacccggttgtaacggttttacctttacgaccgttttaaggtttttaacctttcgtaccggtttcgaaaacgggtttccccgtaaagggtttcccgggaccgtttccggaacgtttacccggttaaccgttcccgttaacccggtttcccgggaaccggttaaaacgggtcccgttaaacgggtaacgttaccggggtaaaggttaacccggtaaacggggttaaaacccggtaacgggttttcccgggttaacccgggtccttaaccgggtaccccgtaaagtttccccgtttgttaccccggtttaaccggtttaccc

SEQ ID NO: 48921 - DNA, 656 bp, Homo sapiens
  misc_feature: GYAE6OF02IVO8U.23.23.C01.1.454.CMB.1.raw
  modified_base (372)..(372): a, c, t, g, unknown or other
  misc_feature (372)..(372): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacggagaattggtgcagtctgggcctgaggtgaaagaagccgtggggcatcagtgaaagtcacctgcaaggctcaggatacaccttacacctaaatttgatatcaacgtggtcgcgacgacggccccgtagggaaaagggctacggacgtggacgtgggcgtcgggtagagttccgtagttggttagacgaacgtaccgggntacttactctaagtaagttacgaacggaccaggctcgacgtcctagaaccgtagaactaccgttaccaggaaacgaaacacgaccttagttaggaacctgaccgaccgtcctacgtacctcgtagaccgacgaccgggcgttacgttaacttgtttcgtcggacggtaagacgggtacgggaacggtaccggtggtttaacggttttaggggtaactttacggttagttacggttaacggttcgggtaacggtttccgggttacggggtacccgtaaccggggg

SEQ ID NO: 48922 - DNA, 609 bp, Homo sapiens
  misc_feature: GYAE6OF02JC7PK.23.23.C01.1.454.CMB.1.raw
  modified_base (182)..(182): a, c, t, g, unknown or other
  misc_feature (182)..(182): n is a, c, g, or t
  modified_base (325)..(325): a, c, t, g, unknown or other
  misc_feature (325)..(325): n is a, c, g, or t
  modified_base (363)..(363): a, c, t, g, unknown or other
  misc_feature (363)..(363): n is a, c, g, or t
  modified_base (482)..(482): a, c, t, g, unknown or other
  misc_feature (482)..(482): n is a, c, g, or t
  modified_base (511)..(511): a, c, t, g, unknown or other
  misc_feature (511)..(511): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatatttcttttgacacagtcctaccagaccntcgtgtctgtcgtctccagggggtacagacgcccaccctctccttagcgaacgggccagtcaggtacgttggttcgcccgtacttcccgttggccctaggtaaccaacgaaaaaccgttcgccacgcctcccaggcctcgtcnttcatgcactactaccaacgacgggaccacgtcggacnctccacggctagggtcagtcggacaggtcgctcgtggacgacgtacttcgtacctcgtctaacgctacgcgcagtcgaccgtccagtaccgtattcggtactacgtttattcgtcgtcngtacaacggtcgccgtcgtccggcctacnccgttaccgtccgtacgtagaccgtacgtacgtggaactagtacgaaacggtctacggtacgtcacgtacacccgtacgttctccggttaccttaccg

SEQ ID NO: 48923 - DNA, 715 bp, Homo sapiens
  misc_feature: GYAE6OF02F9EHL.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtcgtcgtccgaggggagagagcccaacccgttctcctgccgacgggccagtcagagtgttcggccgtactccgtcggcctacggtaaccaaaccaaaaaccgtcggaccacgaccctacccgacggtccgtccgtactacgttcgaacgttcggacctacgactacccgaacgaccgggccacgtcggaccactacccgacggcgtacggttacgacggtcggacgtaggtgccgtcgtacgggacgtagtactacgtacctcgtaccgtacgacgtcgacgtacgtagtccgtaccgtaccgtacggtaacgttacgttacgtacgttagtttacttaccgttacgtacgtaacgacgtacggtcgggccctcggtaccgtacttacgtaccttaccggttacgggtaacccgtaacgggtaccgtaccgtacggtacgggtaactacggtaaacgggtaaaccgtaacggggttcgtaccggtcgtaccgaccgttaccgaccgttaccggtttacgtccgttacc

SEQ ID NO: 48924 - DNA, 500 bp, Homo sapiens
  misc_feature: GYAE6OF02ITRUD.23.23.C01.1.454.CMB.1.raw
  modified_base (416)..(416): a, c, t, g, unknown or other
  misc_feature (416)..(416): n is a, c, g, or t
  modified_base (454)..(454): a, c, t, g, unknown or other
  misc_feature (454)..(454): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtctccaggggagagagccaccctctcctgcagggccagtcagagtgttgccgactccttggcctggtaccaacaaaaacctggccagcctcccaggctcgtcattcatggcacatccaacagggccactggcatcccaggcaggttcagtggcagtggctctgggacagacttcactctcacgatcagcagtgtcgaccctgacgatttgcagtttattactgtcanctaacgtggcgcctggcctatcaccttcggccaggacncgactggtagatgaaacgatagtgtcgtagcaccagtctcgtcttc

SEQ ID NO: 48925 - DNA, 692 bp, Homo sapiens
  misc_feature: GYAE6OF02F7RIO.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagagccgtgggcatcagtagaaagtcacctgacgaggcttacaggatacaccttcacctaaattgatatacaactgggtgcgacacggccccgtagggaaacgggcctacggagtggagtcgggtcgtgggtagacgttccgtaggttgtagaaggtaacgtaccggggctacgttctacgtaacgtaaggtttacgaacgggtccgaacgggtcctacgtacgaccgttacggaacccgttacggaaaccctaccgttaccgaagtaaacgaaaccgtaccgtaccctaacggtttacgggaaccgttcggaccgggtccggtcccgtacgacccttcgtaccggaaccgaccgtaccgggtccgttaggttaacttgttcggacggcggtaggacgggtcggacggtccggtggtttacggttttacgggaattagttaggttaggttacggtacggttacggtcgggtacgggaccggtaacgggg

SEQ ID NO: 48926 - DNA, 789 bp, Homo sapiens
  misc_feature: GYAE6OF02FZCP8.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagacgaccaccggagatattcttttgacacagtctccagacatcgtgtctgtgtctccgaggggagagacgtcccaccctctcctgcgacgggccagtcagagtggtcgccgtactccgttggcctggtaaccaaaccaaaaccgtggaccgacgccctaccgaggtcctacgtactacgttcagtcggactacactaccaaacggacgggacctacgttcggaccctaacgtacccgacgggtacggttaccgggttacgacggttcggtaaccgagggtttaccgggcccgttaacgggtccggggtaaaacgtacgggttaacccttccgtaacccgttccgttacccgtaaccggtactaccgtacgtaaccggtacgggtttaccggtacccgtaacccggtaggtaaccggttttacgttttacggacctttaaacggtttttaacttaaccgttgggtaacctaacggtacccgtaacgggtttcgggacccgttacccggttacgggttacccttacggttaccccgttaacccggttcccggaaaccggtaacggtaccgtaccggtaagtacgtacggtaacgtaaccggaacgtagtccggttcgacggtcgacctacgtacgtccgttagttcctaaccg

SEQ ID NO: 48927 - DNA, 656 bp, Homo sapiens
  misc_feature: GYAE6OF02JRTME.23.23.C01.1.454.CMB.1.raw
  modified_base (204)..(204): a, c, t, g, unknown or other
  misc_feature (204)..(204): n is a, c, g, or t
  modified_base (369)..(369): a, c, t, g, unknown or other
  misc_feature (369)..(369): n is a, c, g, or t
  modified_base (567)..(567): a, c, t, g, unknown or other
  misc_feature (567)..(567): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtcgttctccgagggganagacgcccaccctctcctgcgacgggccagtcagacgttcgtgccgactcgtcgctggtaaccaaacaaaaccgtggccacgcctaccgaggtcctcgtctacttcacgtggaccacgactaccaacgcgggtaccacgtcggacactccgaggtctacggtacnggtcggctacggcgtcgtcggacggtacgacgtacgttactactccgtaactacgtactcgtacggcgttacggttacggtacccgtacccgtaggttaacgttcttttacggactttacggttttactaacggttcgtacgctaacgtcgtcggccgtgtaccggtactactccgtaacgttccgacggtacgtacnccgtagtcgtacgtacgtaaccgtaacgacgtacggtcggtaccttaccggtcggtaaacctaccggttttctacggttacccttaacg

SEQ ID NO: 48928 - DNA, 778 bp, Homo sapiens
  misc_feature: GYAE6OF02H9NFO.23.23.C01.1.454.CMB.1.raw
  modified_base (757)..(757): a, c, t, g, unknown or other
  misc_feature (757)..(757): n is a, c, g, or t
tcagacgcgagtatcacgaccggtgctcgatttagtacacgtgattagggattgggggagaactgctcagtttggacccagagggaaccatggaagccccagctcagcttctcttcctcctgctcctctggctcccagagaccaccggagatattcttttgacacagtctcagacatcgtgtctgtgtctcgaggggagagacgccaccctctcgtgcagggccagtcaggtagtgttcgccgtactccgttggcctaggtaaccaaaacctaaaaacgtggaccaacgcctcccgaaggtcctcgtactaacgtttcaagtcggacaacacgtaccaaacgtgggaccctacgtacgacgtacgtaccccggaagggtcctaagggtttcccgaagggtacggtacgtaacgggttcgggccgttaaccggttaggggaacctaacggttacctttaccacccgttaccgttcgaaacggtaacttccggaaagtaccgttaacggttcggtacccgtaaccccgttaggtaaccgttagttttacgggaaccgttttaagtttttaaccgaacgttttagggtaaccaaggttaaaccgtaaccgggttcgggaccgtacccggttacggtacccttaaacgttcccggttaaacccggtttcggaaccgtaaacgggacctttcgggaacgtgggtaaagtaccgtaacgaaaaccggttaccgtgggttaacaggttaccgaccctaaacgtntttaccgtcgttacttaaccg

SEQ ID NO: 48929 - DNA, 785 bp, Homo sapiens
  misc_feature: GYAE6OF02FXXET.23.23.C01.1.454.CMB.1.raw
  modified_base (457)..(457): a, c, t, g, unknown or other
  misc_feature (457)..(457): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagagtgcccactcccacgagaattggtgcagtctcggcctgaggtgaacgaagccgtggggcagtcgagtagaaagtccaccgtgacgaacggccttacgacggtactacctaaccgttacctaaccttaaaagttttcgaagttactaccgtaaacccggttggggtaccggacgaccgacccggtaccccggtaacggggtaaaacgggtccgtaagggacggtaagggtcggttaggggtaccggttaggggtacgttacggttccgtaaggttggttaggaacggtaacgttccggggntttacttacgtacgaaggttaacgttacgaacggcgtacgccgtagaccgcttacgacgtacggtaacacgttacgaacgaactaaccgacgtacctagttcgaacgttcggacccgtcgtaccgacgttaccgtacggtaccgacgtaccggacccggttcggtttaacgttacgtttagtagttaccggaaggttagggaacgggtccgggtaacgggtccggtaacgggtttaaggtttttacggggtaaatttacggttttacggtaggtttaccgggttaagggtacccggttaggggttacccgggaccggttaaccggggg

SEQ ID NO: 48930 - DNA, 657 bp, Homo sapiens
  misc_feature: GYAE6OF02F6K81.23.23.C01.1.454.CMB.1.raw
  modified_base (189)..(189): a, c, t, g, unknown or other
  misc_feature (189)..(189): n is a, c, g, or t
  modified_base (202)..(202): a, c, t, g, unknown or other
  misc_feature (202)..(202): n is a, c, g, or t
  modified_base (538)..(538): a, c, t, g, unknown or other
  misc_feature (538)..(538): n is a, c, g, or t
  modified_base (637)..(637): a, c, t, g, unknown or other
  misc_feature (637)..(637): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtntctccgagggganagagccaccctctcctgcagggccagtcagagtgttcgccgactccgttggcctaggtaccaacaaaacctggaccacgcctaccaggctcgtcattcatggacactactacccgaacgacgggccaacgtcggaccactcccgaggctacggttccaggtcggactacggtggtccttcggttaggggacaacggtacttcaccgttccgtacaaccggtactacgaacgtaccgtacggttccgtacccggtaacccgttacggtacgtttacgttttccgacgtttaagttttacgttaacgtcgttacacgtcgtaacggtcggacttccgnggtccctagtccgtacctcgggaccctaagggccttcgacgtcggacgaacgtacggaaaacgttcggtacgttacggaccgttacgaccgtaccttanccgtttacgtactttacccg

SEQ ID NO: 48931 - DNA, 682 bp, Homo sapiens
  misc_feature: GYAE6OF02I45VL.23.23.C01.1.454.CMB.1.raw
  modified_base (374)..(374): a, c, t, g, unknown or other
  misc_feature (374)..(374): n is a, c, g, or t
tcagacgcgagtatcacgaccggtgctcgatttagtacacgtgattagggagttggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacgaccttcgaccaaatttcgatactcgaacgtgggtgcgaacaggacccctaggaaaacggccttacggaggtggatgggccgtgggtgacgtccgtaggtcgttggaagtaacgtaccggggntacgttctacgagtaacgttcaaggccgaggtcctcaacgtcctggtacccgtacggaaacctccgtttaccgaaagtaacgaaccgacgtaccctaagtttcggaacgttggaccgtccgggtacctcgaccgttacgtcgaaccgaacggtaccggtccgtaggttaactttacggttaggtacggtacgtaacggtacgggtacgggtacggtacccggtcggttaaggttttacggaacgtttaacgtttaggcggtttaacggtcgggttaacccgtcggttacggggtaccggtaaccgggg

SEQ ID NO: 48932 - DNA, 691 bp, Homo sapiens
  misc_feature: GYAE6OF02F3DH4.23.23.C01.1.454.CMB.1.raw
  modified_base (194)..(194): a, c, t, g, unknown or other
  misc_feature (194)..(194): n is a, c, g, or t
  modified_base (204)..(204): a, c, t, g, unknown or other
  misc_feature (204)..(204): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggcctcccagacgaccaccggagatattcttttgacacagtctccagacatcgtgtctgtgtcnccgagggganagagcccacccgtctcctgcgaacgggcaggcagtagttgtcgccgactccgtgcctaggtaccaaacaaaacctgaccacgccctccgaggtcctcgtacattcacgtggcctacactaccaacggaccgggacctacgtacggcctaaccgtaccccgaggtccgtaaggtccgaacggttcggaccgtaggtaccggtccggttacgtacggggactaacggtaccttacgtaccgtaccgtaccgaacgtacttacgaagtacgacggttacgtaccggtaccgtagtaacgttctttaggacttagtttacttagtcgttacagtctaggtggtaccgcgtaccgttcgacgttaacgtcctaccggttaacggccgttaacggacgtaccgtacggtaacgtagtaaacgtaacggttaaaccggtcgttaacgggtcgtaccggacggtaccacccggtactttccgtacgtttaacccg

SEQ ID NO: 48933 - DNA, 788 bp, Homo sapiens
  misc_feature: GYAE6OF02HLQRQ.23.23.C01.1.454.CMB.1.raw
  modified_base (201)..(201): a, c, t, g, unknown or other
  misc_feature (201)..(201): n is a, c, g, or t
  modified_base (209)..(209): a, c, t, g, unknown or other
  misc_feature (209)..(209): n is a, c, g, or t
  modified_base (225)..(225): a, c, t, g, unknown or other
  misc_feature (225)..(225): n is a, c, g, or t
tcagacgcgagtatcacgaccggtgctcgatttagtacacgtgattagggagttgggggaggaactgctcagtttggacccagagggaaccatggaagccccagctcagccttctcttcctcctgctcctctgcctcccagacgaccaccggagattattactttttgacacagtcctccagactatcgtgtctgtcgtcncgagggangacgcctacctctccncgacgacggtccagtcaggtacgttggttcgaccgtcttccgttggtcccttaacggtaacccaaaaccgtaaaaaccgttccggaccgaccggaccccgtcccgtacggtcctaccggttctacttaccgtgttccggaacgaccctacctaccgaaccggccggacccgaacgtcggacctaccgacccgagggtcgttacggtaccgaggtcgggaccgtaggtcggtcgtacggtacgggaacaccgttacgtttacacctttacgtaccgaccgtattccgaacggtctacggtccgtaaccgttaccgcgtttaacggtttacgtttacgtaaccggttttaaagttttccgttacgttacgtaccgttacgtaccgggtaaccggttaccgtccgggtcccgtcggtaccctttaacggtcccgttacccgggttaaccggtaaccggtaccggttacgtaacggttcccgaagggttaacgtaaccggttaaaggaaacgtttacgtaacggtcgtaacggtcacggtaccctacgttcgttaccttcttacccg

SEQ ID NO: 48934 - DNA, 825 bp, Homo sapiens
  misc_feature: GYAE6OF02GB0IL.23.23.C01.1.454.CMB.1.raw
tcagacgcgagtatcacgaccggtgctcgatttagtacacgtgattagggattgggggaggaactgctcagtttggaccagagggaaccatggaagcccagctcagcttctcttcctcctgctctctgctccagacgaccacggatatatttctttgacactagtctcccagactatcgtgtcgtgtgtcgtcggagggagacgcgacctacctctccgtgcgacggccaggtcagtacgtcgtcgccgtactccgttcggaccgtacggtaaccctaaaccgaaaaccgtcggaccgtaacggtccccttacccggtacggtccgttaccggtctacttaccgtacggtacggacctacgtacctacccgaaacggaccggaccgtacgtcgacgtaccctacccggacggtacccggttaaggttaccggtacggacggtacgtcggtacggttcggttaccgggtacgggaaacgtaccgtaacgttacctaccgttacgtaccggtacgtaacttccggagggtaccgtacgggttaccggttaccctaaccgggttagtaaccggtttaggttttaccgaaccgttttaagttttaccggttaccgtagggttaccgtaacggttacgttaacgggtccggtacccggtttacggtcccggttaccgttacccgttacccgttaccggggtaaccgaccgggtaaacggtccgtaccgggtaacggtaggtaaccgtaacggtaacccgggtaacggttcgtaccggggagttccgtaacggtacccgtaccttaggtcccggttttaccttggtaaccc

SEQ ID NO: 48935 - DNA, 726 bp, Homo sapiens
  misc_feature: GYAE6OF02INKXS.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggcctcccagagacccaccggagatatttcttttgacacagtctccagacatcgtgttctgtgtctccgaggggagagcgcccaccctctcctgcacgggtccagtccgagaggttgttcggaccccgtactcccgttgggccccttacggtaacccaaaccaaaaaccgtcggccaccgacccttcccgacggcctccgtctacttacgatcggccacacgtcccgaacgaccgggcctaaccgtcggacctaccgtcccggaggtccgtacggttcgtaggtcggccgaggtggtccgtcgtagggacctaacgtccttaccgtaccttacgtaccgtaacgtataccgagtacgtaggttccgtacccgtacccggttagtaaccgttagtttaccggtacgttaccgttttaacttacggttcgtacgttacggacgttaaccgggtcgtaccggtaccgtacgttaccgtctaccgttacccggtacggtaccggacggtaccgtacggtacgtaggttacgtaggtaaccgtaacggtacgtacggtcggtaaccgtgtaccgaccgttactcgttacgttccttaaccg

SEQ ID NO: 48936 - DNA, 771 bp, Homo sapiens
  misc_feature: GYAE6OF02GR2CY.23.23.C01.1.454.CMB.1.raw
  modified_base (182)..(182): a, c, t, g, unknown or other
  misc_feature (182)..(182): n is a, c, g, or t
  modified_base (257)..(257): a, c, t, g, unknown or other
  misc_feature (257)..(257): n is a, c, g, or t
  modified_base (293)..(293): a, c, t, g, unknown or other
  misc_feature (293)..(293): n is a, c, g, or t
  modified_base (324)..(324): a, c, t, g, unknown or other
  misc_feature (324)..(324): n is a, c, g, or t
tcagacgcgagtatcacgaccggtgctcgatttagtacacgtgattagggattgggggagtcaacaaccacatctgtcctcgagaggacaccctgtgaccacagctcctcaccatggactggacctggacgatcctcttcttggtggcagcagccagagtgcccactcccacgagattggtncagtctgggcctggaggtgaagacgccgtgggcatcagttagaaacgtcacctgcaaggtcttacgaggataccnccttaccaactaatttcgatactacaacgtgggtcncgtacaccggtccccgagggaaacgggtccncgggaaggtcgggaagtcggggtccgtggggtagtacggttccgttagggtacggttaggaaggtaaacggtcccggggacttaacgtttccgacgtaaggtaacggttacgaaaccgggtccgacggccttacggaccggtcctacggtaacccgtaggaaacccttactaccggaaagaaacgacctacggtacccttaaggtttacgaacggttcggacccgggtaccgtccgttacgcccgtttaccggacgaacccggtaaccggtcccgggttacgttacgttaacgtttaggttcgggtacgacgggtacggggtacggggaccggggtacggtccccgggttaaggttttaacgggtttaggggtaatttacgggttttagtacgggttacgttacccgggtaaggtttccgggtccggggtaacgggtaaccccgggg

SEQ ID NO: 48937 - DNA, 964 bp, Homo sapiens
  misc_feature: GYAE6OF02GTFA1.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttccctctgtcctactcgtcggtacctccgagtacttcccgaccggtacgtaaagttggtcgttacgaccacgtacgtcctaccgacgaccctaccgttcgtttccgtttcgtcccgggtaaccgggggaacgtaccaccctacccgttctccgcggacggtaccgggcccgactacgtacgttggtacaaccgtaacggttactaccgtccggttaacgtaaaccaacggtaacggtaaccggtccgtacgggtacccggacggttccccgaacccggtacggtccttacccactacgtactagtacggtaaccttaccgttaccggtagggtaccgggaccctacgggacgtaccgtaccgtaccccgacccgggtcccttaccgttaacgggacggtacggtcggtacggggtttccggggtaaccgggtacggggtaaacttaacccggttaccgttaaccgtaccctaccgtacccgtaaaccgtcctaccccggtaacgtaacggttacccgtaaacgggtacccgtaacggtacggtaacgttttacgtttaaccggttaactttaacggttttaacgttaacggttaccggttacgaaccggtaaaccggttaaacccgggttaagtaaccggggtttaccgaacccgttaaccgttactttaaccgtttaccgtttaacccgggttccccgggttaaccggggtaaccgggttaacgttaaacgggtacggttaaaccttaaacggtaaccgtaaaccgttacgttacggtaccgtacgtaccgtaccgtacgttccgtaacttcgttcgtaaccgttcccttacccggtccctagtcccg

SEQ ID NO: 48938 - DNA, 777 bp, Homo sapiens
  misc_feature: GYAE6OF02GTR2B.23.23.C01.1.454.CMB.1.raw
  modified_base (204)..(204): a, c, t, g, unknown or other
  misc_feature (204)..(204): n is a, c, g, or t
tcagacgcgagtatcacgaccggtgctcgatttagtacacgtgattagggattggggggaggaactgctcagtttggacccagagggaaccatggaagccccagctcagcttctcttcctcctgctcctctggctcccagagacccaccggagatattcttttgacacagtcctccagcatcgtgtctgtgtctccgagggganagacgcccaccctctccgtgcgacggccagtcgagtgttgttcgacccgtacttccggttcggaccttacggtaacccaaaaccgaaaaacccgttcggacccgtaaccgccccgttaccccgaacgggtcccttaccggtacctaacgttttaccgacggttcgggacctacctaaccgttaccccggaaaccggccggggaccccttacgggtacggtaccgacccgtacccggagggttaccgtaacgggtttcgaacggggtacggacggtaggtacggtcgtacgggtacggggaactacgtacctacgtaccgtctacgacgtactacgacgtacgtacgtacgaccgtccgtacggtacgtttagtttacgacgtttctttaacgttcgtagtaccgtagtacgtacgggccgttccggaccgttccgtcgttaaccctccggtaccgttaccgggaaccggtaacggtaccgttacggagtacgggacgttaacggaaccggtaacggttccgtaggtaccggtactccggaccttaacgttccgttccgttacgttaccctacg

SEQ ID NO: 48939 - DNA, 765 bp, Homo sapiens
  misc_feature: GYAE6OF02GVYOT.23.23.C01.1.454.CMB.1.raw
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaacgtgcccactcccacgacggaattggtcgcagtcgtggcctgaggtgaagacgcctgggcatcaggttagaaagtcaccgtgacgtaaggcttcgaggtacttacctaccgttacaaccctaaattttcgaattactacaacgttgggacgaccgacgacggtaccccgtaagggaaacggccttaacggagtcggtaaggttcgggtcgttaggggtctacggttcccgtaggttggttacggaacgtaacgttacccgggtactacgttacgtacgtagtaacgtttaccgacggtacccagggtcctacgacgtccgtacggtaccgtacggtaacctaccttaccgaagtaacgaactaccggtaccttagttacggaacttcggaccgtaccgtcctacgtaccctcggtacgaccgtaccgtacgggttacccgttagttaaccgtttgtccggttacggacgggtaggtaccgggtacggggaaccgtccgggttaacggtttacggttttaacggggaaacttttacggttaggttaacggttacggtttacccgggacggttttaccgggaccggggttaaacccggtacccgggggg

SEQ ID NO: 48940 - DNA, 715 bp, Homo sapiens
  misc_feature: GYAE6OF02JCXXV.23.23.C01.1.454.CMB.1.raw
  modified_base (672)..(672): a, c, t, g, unknown or other
  misc_feature (672)..(672): n is a, c, g, or t
tcagacgcgagtatcacgaccggtgctcgatttagtacacgtgattagggattgggggaggaactgctcagtttggacccagagggaaccatggaagccccagctcagcttctcttccgtcctgctcctctggcctcccagacgaccaccggagatagtttctttgacacgtagtctaccagacatcgtgtctagtgtctccggagggtagagacgcccaccgtctcgtcgcgacggccagtcaggtagtgttacgcccgacttccgtggcctaggtaacccaaacgaaaaccgtcgacctagcccctaccgtacgccgtacgtaccacttcgagtccggacaactactaccgtaagcggtccaagtcggacacgtcccgaggtccgacggttcacggtcgacgtacgtcggcgtaccggttacggaaccgtacgtaccgtaccgtactaccgttacggaccttacgcgtacgtaccgtagtacgtccccgtacgtacggtacttaggttacgtaccgtttaagtttaaccttcgtacgtcgtacggtaactacgggccgtcggtccgtacgttaccctaggtcccgtaccgtcggaaaccgttaggtaccctacggtcgtacggtacgtaccgggttaaagaaccggttcgtaccggtcgtaaacccggtntaacccggttaaccgtcggtttaacgttccgttcccttaaccg

SEQ ID NO: 48941 - DNA, 744 bp, Homo sapiens
  misc_feature: GYAE6OF02FN6CK.23.23.C01.1.454.CMB.1.raw
  modified_base (288)..(288): a, c, t, g, unknown or other
  misc_feature (288)..(288): n is a, c, g, or t
  modified_base (292)..(292): a, c, t, g, unknown or other
  misc_feature (292)..(292): n is a, c, g, or t
  modified_base (430)..(430): a, c, t, g, unknown or other
  misc_feature (430)..(430): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtcgcccactcccacgaggaattggtgcagtctgggcctgaggtgaagagccgtgggcatcagtgaaagtcacctgacaaggcttacgaggataccaccttcaacctaaatttgatatacaacgtggtancganacggaccccgtagggaaaggtctcggagtggagtgggcgtgggtagtacggtacctaggtgttaggagtaaacgtaccgggaccagtttccgtacgaacggtaagttaccgaaacgggtccgtaagggcctacggacnccgtacgaccgtaacggaacctaccgttaccgaaggtaaagaaaccgacgtacccgtaagtttacgggaacgttacgcccggaccgggtcccgttacggtaacccgttaccgtacggaacccggtaccggacccgggtcccggttacgttaacgtttacgtttggtacggtcggaacggtacgggaccggggtacgggtacccgggtaccggttaggttttttaacggggtaaacgtttaaggtttaacggttaggtttacgggttacgggtaccggtttaccgggttacggggtacccgggtaaacccggggg

SEQ ID NO: 48942 - DNA, 874 bp, Homo sapiens
  misc_feature: GYAE6OF02H6EKH.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggcctcccagaagacccaccgggagattatttctttttgaccactacgtcctaccagacatcgtgtctgtcgtctaccgaggggagagagcccaccctctcctcggcacgggccagtcgaggagtcggtcgccgtacctccgttcggtcctacggtaacccaaaacctaaaaccgtcggaccacgcccctaacccgaggtccttacctctattaccgacgtcggaccaacacctaccgaaacgaccggggacctaccggtcggacccgtaccgtacccccgacgggtaaccgttaagggttcccgaggggtaccggtaccggtaggggttacggtccggttaacgggtacggggtaaaccgttaaccggttaacccttccgttaaccgttacccgttacccgggtaaccgtaaccgtacgtaccgggacccgttacggtttaccccgggtaaccccgggtaccccggtacggttaaacgttttaccggttttaaccgttacggttttaaaccgtttttaaccgtttaacccggttttaggttaccgtaacggttaccgttaaccgggtaccgggtccgggttacccgtcgggttacccttacccgttacccgttacccgtttaacccggtaaccggtaacccgggttcccgttaccgtacgggtacgggcttaaaccggtcgtaaaaccgttcggtacggttccgacgtccgaccttacgtacttcggttacgttccttacccg

SEQ ID NO: 48943 - DNA, 810 bp, Homo sapiens
  misc_feature: GYAE6OF02I1MXC.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtgtactcgagggganagacgccaccctctcctgcagggtcccagtcagtagtgtcgccgtactcctggcctggtaccaacaaaacgtcggaccagtcctaccgaggcctcggtcaacttcgacgtacggacctacgaactaccaaacgacgggtcccaacgtcggacaaccgtccgaggccgtaacggttcgaaggtccggacgtaggtccggccgttacggtacgggaacctacggttaaccttaccgtacgttacccgtaaccgaccggtaaactccggtaacgtacccgtaaacggggttccgttaacccggtaacccccgttaggaaaccccgggtttattttaccgggaacctttaagttttaaaccgcgtttaaacggttccaacggtaccggttaaaccggtcgggtacccgggtacccgttttaccgggacccgtttaaaccgtccccggttaaccccgggtttagggaacccggttaaaccggggtaaccctttcccgggaagttccgggtaaacggttacccgaaaccggttaaaacccggaccgttcgggtaaccggtaccgtacggtaccccttaaagtacccggtttaccttccggttaccttaaccccg

SEQ ID NO: 48944 - DNA, 728 bp, Homo sapiens
  misc_feature: GYAE6OF02INC0U.23.23.C01.1.454.CMB.1.raw
  modified_base (581)..(581): a, c, t, g, unknown or other
  misc_feature (581)..(581): n is a, c, g, or t
tcagacgcgagtatcacgaccggtgctcgatttagtacacgtgattagggattgggggagaactgctcagtttggacccagagggaaccatggaagccccagctcagcttctcttcctcctgctcctctggctcccagagaccaccggagatattcttttgacacagtctccagacatcgtgtctgtgtctcgaggggagagacgcccaccttctcctgcgagggccagtcaggagttcgttcgccgtacttccgttcggtccttacggtaaccaaaaccaaaaaaccgttcggacccaacggcccctacccgacggaccgttcgtcctacgttctaactcgggacacgtaacctacccgaaaacgcgggaccctacgtaggaccaccgttaccccggaggtaccgagggttccaggtcggacgtagggtcggtacttcggtacgggaactaaccggttctactaccgtctacgacgtactacgacgtcgtaacgttcggtaaccgtcccgtacgtacgttctttacgacgttacgttttaattaccgtttcgtactaacggcgtaaccggtcgggtaccnccgttacggaccttctacccgtaccgttcccggtaaccggtaacggacccgttacgaccgtacggaacgttacgaaacggttaacgtacggttggtaccggtacgttacggcccgttaaccgagtttccgtacggttcccttaaccc

SEQ ID NO: 48945 - DNA, 662 bp, Homo sapiens
  misc_feature: GYAE6OF02GTK3G.23.23.C01.1.454.CMB.1.raw
  modified_base (155)..(155): a, c, t, g, unknown or other
  misc_feature (155)..(155): n is a, c, g, or t
  modified_base (241)..(241): a, c, t, g, unknown or other
  misc_feature (241)..(241): n is a, c, g, or t
  modified_base (537)..(537): a, c, t, g, unknown or other
  misc_feature (537)..(537): n is a, c, g, or t
tcagacgcgagtatcacgaccggtgctcgatttagtacacgtgattagggagttgggggaggaactgctcagtttggacccagagggaaccatggaagccccagctcagcttctcttcctcctgctcctctggcctcccaggacgaccaccgganattattctttgacacagtctaccagactatcgtgtctgtgtcctacgaggggatagcgcccacctctcctgcgacggccagtcagngttcgtcgcctacgtcttggctacgtaaccaactaaacgtcgccacgccctaccgagtctcgtactattcgacgtgcgaactctaaccgaacggtaccggcctacggtcggaccgtcctaccggtaacgtcggttaacgttcgtacggtacggacgtacggtacggtccgtacggtcggaacgtacgttaccgtccttaccgtaccgtaccgtacggtactagaccgttacgtaacgttcggaacccgttaccggtacgtaagtttccgttacgtacgtttaagtttacgtacgtntacgtacgtacggacgttcggcttcgcgttctacgtcgtacccgtgtacagtccgtgacgagaagtacgaaccgggtaattcgtacggacgtctaacggactccgtacgttactccttactcccg

SEQ ID NO: 48946 - DNA, 672 bp, Homo sapiens
  misc_feature: GYAE6OF02HO0OU.23.23.C01.1.454.CMB.1.raw
  modified_base (199)..(199): a, c, t, g, unknown or other
  misc_feature (199)..(199): n is a, c, g, or t
  modified_base (523)..(523): a, c, t, g, unknown or other
  misc_feature (523)..(523): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggcctccagagaccaccggagatattctttgacacagtctcagacatcgtgtctgtgtctcgagggganagacgccacctctcctgcgagggccagtcagagtgtcgccgtactctggcctggtaaccaaacaaaactggaccagcctccacggtctcgtactatcagtcgcacactaccgaacgacgggccaacgtcggacctacgtcccgaggtacgtaacgggttccgaggtacggtcgtaagggttcggaccgttacggtacgggaacaacgttcgttacacctcgtacgacgtacgtcgaagtccgtagtccggtaccgtaccgtagtaccgttacgtttcggaacttttaggtttaacttacgtagtaccgtacgtacgttaccggnggaccgttccggtacggtacttaccgtccgtaaccgtttaccggaccggtaaacggtcctaccggtaaggtggtaacgtacgttaaacggaacgttcgtcgggtacgtacgtacgaccgtacgttacgttaccgtcggttacttaccgg

SEQ ID NO: 48947 - DNA, 710 bp, Homo sapiens
  misc_feature: GYAE6OF02FL9GZ.23.23.C01.1.454.CMB.1.raw
  modified_base (395)..(395): a, c, t, g, unknown or other
  misc_feature (395)..(395): n is a, c, g, or t
tcagacgcgagtatcacgaccggtgctcgatttagtacacgtgattagggattggggggaggaactgctcagtttggacccagagggaaccatggaagccccagctcagcttctcttcctcctgctcctctggcctccagagaccaccggagatatttcttttagacacagtctccagacatcgtgtctgtgtctccgaggggagaggagcccacctctcctgcgacggccaggtcaggtgtgttcgccgtacttccgtggtccgtaggtaacccaaaaccaaaacccggcggaccgacgtccctaccgacggtccttccggtactagttcagtcgacactaactaccaaacgccggcctacgtcggaccacgtcccgaggtcgtacgttacggnggtcggagtaggtcggtctacgggtacggacgtacgtacgttccacgttaccgtaacgacctacgtaccgtacgacgtacggttccgaacccggttccgtaggtaccgtttcgtttacgtacggttaacttttacgttacgttcgtaaccgtcgtaaccgtacggttccgggtaccgtccggtacgtacctccggtaccctaccggttaccggaaccggtaaggtccgtaacgtacggtagaacggtaacgaaacggtaaaccgtacgggttgtcgaccgttagaacccttagtacctcggtttattcccgttac

SEQ ID NO: 48948 - DNA, 833 bp, Homo sapiens
  misc_feature: GYAE6OF02GN1GD.23.23.C01.1.454.CMB.1.raw
  modified_base (141)..(141): a, c, t, g, unknown or other
  misc_feature (141)..(141): n is a, c, g, or t
  modified_base (210)..(210): a, c, t, g, unknown or other
  misc_feature (210)..(210): n is a, c, g, or t
  modified_base (824)..(824): a, c, t, g, unknown or other
  misc_feature (824)..(824): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggcctccaagngaccaccggagattatttcttttgaccacagttctaccagacatcgtgtctgtacgtcctcgagggganagacgtccaccgtctcctgccgacggccagtcacggtagtgttacgccgacttcccgttgggcccttcggtaacccaaacctaaaaaccgtcgggaccacgtacccgtcccgaacggtccgtacgtcctatttccgacttacggaccactacgacctaacgacggtccaacggtcgccgaaccttccgaacgggactacggttccggttagggcgacgtacggtcggtacgacgggttacgggaactaacggtaccttacgtcccttacgtaaccgtacttacggtcccacggtaaccggaagggttccggttaccccgtaccggtttaacgggttacgtttaaccgtttcggtaacgttaactttttaacggttccggtttaagtccccgtaccgttaaccgggttaacggtacccggttcccgggttacccgttaacggtcccgttttaaacccggccctttaaacccggggttttcccgtaaaccggggaaaccggttacccgttacgggtaaaccggttcgggaacggtaacggtaaaccggttaaacgttaccggggtggttacgttaccgtaccggtacccttaaggtaccttcggtttaacccggtntttacccgg

SEQ ID NO: 48949 - DNA, 768 bp, Homo sapiens
  misc_feature: GYAE6OF02F2N5O.23.23.C01.1.454.CMB.1.raw
tcagacgcgagtatcacgaccggtgctcgatttagtacacgtgattagggagttggggagtcaacaaccacatctgtcctcgagaggacaccctgtgaccacagctcctcaccagtgactggacctggacgactcctcttcgttggtggcgagcagaccagaacgtcgacccacgtcccgacggaaggtaagttggtcgcgtaggtcgtcgggtcctggaggtagaaaggaacggccggtggggcctagtcgaaggtacgaaacggtccactgacgaaggtacttcgaaggtatacctacctccgaaccttaattcgaacttactaccgtaacggttgggtaccgacggaaccgtaccggtaccccggtaagggtaaacgggtccgttaacgggtagggtcggtaggtcggggtacgtaggggttcgtaaccggttcgttaggttggttaacggaacggtaccggttaaccgggactacttacgacgtaagtaaacggttacggacggtccgaacgtcgtacgtaccgtaccgtcgtaaccgtagaaccctacgtacgaagaaaccgaacaccgtacgtacggtacgtaacgtcgtaccgccggtacttaccgacctaccgtacgaaccgtacggtccggtaccgttagttaactttcggtaggtcggtaggacggtacgggtcggaggtaccggtagtttacggtttacgtaagtttacggtagttcggtaggttacggtacggtcggtaccggtacggtaaccggg

SEQ ID NO: 48950 - DNA, 677 bp, Homo sapiens
  misc_feature: GYAE6OF02IDNIJ.23.23.C01.1.454.CMB.1.raw
  modified_base (192)..(192): a, c, t, g, unknown or other
  misc_feature (192)..(192): n is a, c, g, or t
  modified_base (220)..(220): a, c, t, g, unknown or other
  misc_feature (220)..(220): n is a, c, g, or t
  modified_base (239)..(239): a, c, t, g, unknown or other
  misc_feature (239)..(239): n is a, c, g, or t
  modified_base (319)..(319): a, c, t, g, unknown or other
  misc_feature (319)..(319): n is a, c, g, or t
  modified_base (647)..(647): a, c, t, g, unknown or other
  misc_feature (647)..(647): n is a, c, g, or t
  modified_base (655)..(655): a, c, t, g, unknown or other
  misc_feature (655)..(655): n is a, c, g, or t
tcagacgcgagtatcacgaccggtgctcgatttagtacacgtgattagggattgggggaggaactgctcagtttggacccagagggaaccatggaagccccagctcagcttctccttcctcctgccttcctctggcctcccagacgaccaccggagattattttcttttagaccactagtcctaccgatacnttcggtgtctggtctctccgaggggtanagtacgccctacctctccngcgacggccacgtcaggtacgtggttcgcctacgtctcggcctacgtaaccaaacaaaccgtcggaccacgtccgtaccncggtctacgtctacttcagtcggactactacaccgaacggcggtccagtcgctaacgcccgtaaggcctacgttcgaggttcgaacgtcggtacgtccggtaggtacggactacgtccgtcaccgttccgagtaccgtacgccaggtcttacggtaccgaccgtaacccggtgttacgtttgttacgtacgtttacggttacttactaccgtagaccgttacggttacgccgggttccgtcgtaccgtttacgtaccgtccgttacccgaacggttacccgaaggtcctaaccggtggactacggtagaaccggtaagtctacgggtnacgctacncgttactcgttcgtacctccgg

SEQ ID NO: 48951 - DNA, 995 bp, Homo sapiens
  misc_feature: GYAE6OF02IEK1H.23.23.C01.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctccagagaccaccggagattattcttttgacacagtctccagacatcgtgtctgtgtctcgagggganagagccaccctctctgcagggccagtcagagtgttcgccgtactcgttcggcctacggtaaccaaaccaaaaaccgtcggaccacgccctacccgaggctacgtctattcatcggaccactactaccaacgacgggcccacgtcgggacctaacgtacccgacgggtaccgtaacgggtttacacgggttacgggtaccgtaacggggtttcggggtccccgttacgggttaaccgggggtaacctaaaccggggttaaccccgttttacctaaaccccgttttacccgttaacccggttaaacccggtaaccgtttacccggaacgggtaaccctttaacggggtttaccccgggttaaccccgggtaacccccggtttaagggtttaaacccggtttaaacggttttttaccgggtaaacccggtttttaacggtttttttaaaccggtttaaaccggtttacggtttaaccgtaaccggtaaccggttaaacccgggttaacggggtcccgttaaccccgggtttacggttacccccgtttaaacgtttaccccggttaaacccccggttttaccggggaaaccccggttaaaaccgggggttaccgttaaccccggggtaacgggtttaccgggggtaaaccgggttaaaccggtttaaacccggggtaaaaaaaccggttaacccgggttacggggttaacccgggttaaccgttttaccggacccccgttaaaaacccggtttccggttttaacccggtttacggttttacccccgttttaaccccgg

SEQ ID NO: 48952 - DNA, 705 bp, Homo sapiens
  misc_feature: GYAE6OF02FYKCC.23.23.C01.1.454.CMB.1.raw
  modified_base (184)..(184): a, c, t, g, unknown or other
  misc_feature (184)..(184): n is a, c, g, or t
  modified_base (338)..(338): a, c, t, g, unknown or other
  misc_feature (338)..(338): n is a, c, g, or t
  modified_base (595)..(595): a, c, t, g, unknown or other
  misc_feature (595)..(595): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtncagtctgggcctggaggtgaagagccgtgggcatcagtgaaagtcacctgcaaggtctacgaggtatacaccttcaccgtaaatttgaattatacgtaactgggtgcgaacgtcggaccccgtagggaaaacggtcgtacggacggtggaacgngggtcgtgggtaggacgttccgtaggttcggtttaggaacggaacgtaaccggggtctaacgtttcctacgtaagttaaacggttacgaacgggccgtaagtcgtacgacgcccgtagacccgtacgggaacctaccttaaccgagtaaacgaaacgacgtaaccctacgttttacgggaaccttggaccgtcggacccgtgtacccctgtaccggaacgtaacccggacggtccgttagtaagtttcgttgtcggngtacgggacggcgggacggtcccggtacggttaggttttacggaacgtttagttaggttacggtacgttacggggttaccgttacgggtacggggtacccgtaacggggg

SEQ ID NO: 48953 - DNA, 719 bp, Homo sapiens
  misc_feature: GYAE6OF02GLUV6.23.23.C01.1.454.CMB.1.raw
  modified_base (192)..(192): a, c, t, g, unknown or other
  misc_feature (192)..(192): n is a, c, g, or t
  modified_base (204)..(204): a, c, t, g, unknown or other
  misc_feature (204)..(204): n is a, c, g, or t
  modified_base (606)..(606): a, c, t, g, unknown or other
  misc_feature (606)..(606): n is a, c, g, or t
  modified_base (697)..(697): a, c, t, g, unknown or other
  misc_feature (697)..(697): n is a, c, g, or t
tcagacgcgagtatcacgaccggtgctcgatttagtacacgtgattagggattgggggaggaactgctcagtttggacccagagggaaccatggaagccccagctcagcttctcttcctcctgctctctggctccagagaccaccggagatattcttttagacacagtctaccagtacatccgtgtctcgtntctccagggganacgagtccaacctctctaggcaagggccaagtcgagtacgtgttcgaccgtactccgtggcctaggtaacccaaacaaaaccgtggaccagccctaccgagtcctagtactacttactagtcggaccaacgtactaacccgaaacgaccggggtacctaacggtacgccgaaacttcccggaaggtaccgtaaggtttaccaacgggttacggaacgtaacggggttcggcccgtttaagggtacgggaactaacggttaaccttacgaccttaaccgcgtaaaccgtactttcgaaacggttctaacgggtcgttaaccggtaccgtacggtaacgttacgtttacgaaaccgttagttttaacttaacgtcggttaacacggttacaacgggtacggccnccggtttagtcctaacgttctaaccggtcgaacgtaaacggctacgacggtagagtaagtaccgaaaacgtcgtggtacgcgtcgaacccngttaatcgtacctattaacccg

SEQ ID NO: 48954 - DNA, 726 bp, Homo sapiens
  misc_feature: GYAE6OF02IM8SV.23.23.C01.1.454.CMB.1.raw
  modified_base (525)..(525): a, c, t, g, unknown or other
  misc_feature (525)..(525): n is a, c, g, or t
tcagacgcgagtatcacgaccggtgctcgatttagtacacgtgattagggagttgggggaggaactgctcagtttggacccagaggaaccagtggaagccccagctcagcttctcttcctctgctcctctggcctcccagacgaccaccggatatacgtttctttgaccacagttcctaccagacgtactccgttgtcttgtcgtctaccggaggggacgagacgtccctacccgttctccgtacggcgtacgggcctaggtaccgaggtaggttcgtacgccgtccgttccgttcggtacctacggttaaccaaaccgtaaaaccgtcggacctacggtacccctcccgtaacggtcttaccgtcgtacttccgtgtcggacacgtactaccgaacgcggtacctgtaccggctaccgtccgagacgtcgttaccgaggtacggacgtgtacggtcgtcgtaggactcgtacctacgtctcgtacgacgtcacgtacggctgtccgtaaccgtaccgtacgttnttaacgttctacgttaagtttaccgttctcgcgcgtaaccgtaggtccgtctaccggttcacccgttaactcccgtaccggtttaccggaacgtccggtaacttacggagttccgggtaaatacccggaaggtttaaccgcgttacgggttcccgaacgttaccggccgttaactaccggttcttacgttcccgttaacgg

SEQ ID NO: 48955 - DNA, 638 bp, Homo sapiens
  misc_feature: GYAE6OF02HM113.23.23.C01.1.454.CMB.1.raw
  modified_base (183)..(183): a, c, t, g, unknown or other
  misc_feature (183)..(183): n is a, c, g, or t
  modified_base (202)..(202): a, c, t, g, unknown or other
  misc_feature (202)..(202): n is a, c, g, or t
tcagacgcgagtatcacgaccggtgctcgatttagtacacgtgattagggattgggggacggaactgctcagtttggacccagagggaaccatggaagccccagctcagcttctctcctcctgctcctctggctcccagagaccaccggagatattcttttgacacagtctccagacatcgtntctgtgtcctcgagggganagagccacccgtctcctgctagggcctaggtcagagtgttgcctactccttggcctggtaccaacaaaacctgccagtcctccagctcgtcattcatcggactactactaccaacgacggccaacgtcgaccacgtcccgacggcgtacggtccgagtcggcaggtgccgtcgtcggggtaacacgtaccttcaaccttcctacgaacgtactagacgtaccgagttacgtaccgaccccttaggaccgtttacgtttcgacttagtttaacgttctacgtacacggtacgtacggtcgtacgtaccgtcgtacctgtacccgtaccgttaccggccggtaaacgggtccttaaccgggacggtacgggaagtaacgtacggaaacggtcgtacggtcgtaccttacgaccgtaccttagtccgttcgtacttacg

SEQ ID NO: 48956 - DNA, 688 bp, Homo sapiens
  misc_feature: GYAE6OF02IBLR3.23.23.C01.1.454.CMB.1.raw
  modified_base (207)..(207): a, c, t, g, unknown or other
  misc_feature (207)..(207): n is a, c, g, or t
  modified_base (322)..(322): a, c, t, g, unknown or other
  misc_feature (322)..(322): n is a, c, g, or t
tcagacgcgagtatcacgaccggtgctcgatttagtacacgtgattagggattgggggagaactgctcagtttggacccagagggaaccatggaagccccagctcagcttctcttcctcctgctcctctggctccagacgacccacggagtattattcttttgactactacgtctaccagactatcgtgtctgtgtctcgagggganacgacgccctacccgtctccgtgcgacgggcctagtcagtgtcgtcgctactcgtcgctacgtaaccaaacgaaacgtcgaccacgcccaccgagtcttacgtctacgttcgtancggacacgtactaccgaagtcggacctgtcggacctacgtacccggaggtaccgtaggtccgtaggtccggacgtaggtcgtcgtacggtaggaccacgttctcctacgtccgtacgagtactacgaggtaccgtacgtacggacccgtaccggtagttacgtttacgttaccgtgttttaaacgtttcggtacgttataccgttacgtaacggtaccggtccgtcccgttaccgtcgggtaccctttaacggtcccgttaacccggttacgggaccggtaaaccggtgttaccgagtacgtaaggtaccgtaaaggaaccgtcggtgttaccgacgtacacgtccgttagtcgttacgtcttacc

SEQ ID NO: 48957 - DNA, 690 bp, Homo sapiens
  misc_feature: GYAE6OF02JH3SR.23.23.C01.1.454.CMB.1.raw
  modified_base (370)..(370): a, c, t, g, unknown or other
  misc_feature (370)..(370): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggcctcccagagaccaccggagatattcttttgacacagtcctccagacatcgtgtctgtgtctccgaggggagagagccaccctctccgtgcgacgggccagtcgagagtgttcgccgtacctccgttggccttggtaacccaaacaaaaacccgtcggaccacggacccttcccgacggcctccgtctattcacgtggacacgactccaacgacgggccaccgtggaccagtacccgnggccaagggttcaggtcgccgaggtcgactcggtagggacagtactcactcctacgacggtaatcgacgcgtaacggttccgacccggtcccgtacgtaacgttaacgtttttccggaaccgttaagttttttaaactcgttagtccgttaaccgacgtaacggtccggacgtcccgtaggttaccctagttccgtacccgttcgggaacccgtaaggtacctcggtaaccgtggaacggtagttaaaccggggaaaactttggaacgggttcggtaacggcgttaacctaccgttacgttaccgttggttacccgttcc

SEQ ID NO: 48958 - DNA, 797 bp, Homo sapiens
  misc_feature: GYAE6OF02FQB76.23.23.C01.1.454.CMB.1.raw
  modified_base (112)..(112): a, c, t, g, unknown or other
  misc_feature (112)..(112): n is a, c, g, or t
  modified_base (210)..(210): a, c, t, g, unknown or other
  misc_feature (210)..(210): n is a, c, g, or t
tcagacgcgagtatcacgaccggtgctcgatttagtacacgtgattagggattgggggaggaactgctcagtttggacccagagggaaccatggaagccccagctcagctcnctcctcctgctcctctggctacccagagtaccgaccggagatattctttagacctacagtctccagtaccattcgtgtactgtgtctacctagggganagtagcccaacctgtcctagcacgggccagtcagtagtgtgccgaactcctggacctaggtaacccaaacgaaaaacctggaccaggacccctaccgtaaggcctaccggtccaacgttcaacgtcggaccacgtaacgtaccgaacggtacgggacctaccgtagggacccaacgttacccgaggtaccgtaaggtccggtaggtacggaaccgtacgggtcggtaccgtacggtacggggtaactaacggtacccgtttaaccgaaccttaccggtaccgtaaacccgtacgttaaccgacgtactaacggggttacgtacccgggtaaacccctggtaaaccgttacgtttacggaccgtttaggtttaaaccttacggtaccgttacgtaaaccggtccaaacggttcgcccgtaaccggccggtactaacgtcgttaacccgttcggaaccgtaacgtacccgtagtaaccggtagggtacgtaaacgggtaccgttaaaacgtaccgttaaccggggtacgaccggtttacccggaacccttaaccggtaaccggttccgttacccggttacgttaacccg

SEQ ID NO: 48959 - DNA, 810 bp, Homo sapiens
  misc_feature: GYAE6OF02ING95.23.23.C01.1.454.CMB.1.raw
  modified_base (211)..(211): a, c, t, g, unknown or other
  misc_feature (211)..(211): n is a, c, g, or t
  modified_base (767)..(767): a, c, t, g, unknown or other
  misc_feature (767)..(767): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctaggccttacccagacgaccacccgggatatactttcgttttcgacactagtccttccgaagaccagttccgtgttctggtntccgtcccgtagggggacagacgcccgtaaccctcgtccgtgaccgcgggtaccacggttacaggagttcggttgccccgtaacgttccttagggcccttaacggtaaccaaaaccgtaaaaaacccgtcgtacccgaacgtccccgtaccgacggtccctcggtaccgtacttctacgtcggacctaaccgtactacccgaaccggacgggtaccctaacgtcggacctccgttaaccccgtggtaccgtaagggttccgtagggtaaccggtcgtaacgggtttcgccggttccggtacggtaacgtaacgtactttaccgaccgttactacccgtaggtaccgttagaacgtccgtaaagtccggtaccgtaaacccggttacggaaacgttcggtttacgtaccggtttaacgttttaaccgtaacgtttcggtaacgacgttaccggtaaaggtccggtaccggtacttcccgggtacttacgtaccgtaccgttcccgacggacggttaaccgtcgacgttgaacgtacggtataaacggtaccggttancggtactccgtaacctaccgtacgttccgttacgtccgttacg

SEQ ID NO: 48960 - DNA, 547 bp, Homo sapiens
  misc_feature: GYAE6OF02FPZWZ.23.23.C01.1.454.CMB.1.raw
  modified_base (277)..(277): a, c, t, g, unknown or other
  misc_feature (277)..(277): n is a, c, g, or t
  modified_base (281)..(281): a, c, t, g, unknown or other
  misc_feature (281)..(281): n is a, c, g, or t
  modified_base (322)..(322): a, c, t, g, unknown or other
  misc_feature (322)..(322): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacacttcacaaatttgatatcaactggtncganaggcccctggaaaagggctcggagtggatgggactgggtgngtcctagtgttgagaataccgggcattctcaggaattcaaagggccagggcctcgagtcctgacctgggaacaccgttaccagaagaacagcccatttaggaacttgacgcggcctgacctctgacgtacaccggccgtagtattattgtagcgagaggtcgaggccggtacgtagttttgggaacttagttatcggtatacggtactcggttgggcctaagggg

SEQ ID NO: 48961 - DNA, 621 bp, Homo sapiens
  misc_feature: GYAE6OF02GQXDR.23.23.C01.1.454.CMB.1.raw
  modified_base (189)..(189): a, c, t, g, unknown or other
  misc_feature (189)..(189): n is a, c, g, or t
  modified_base (200)..(200): a, c, t, g, unknown or other
  misc_feature (200)..(200): n is a, c, g, or t
  modified_base (571)..(571): a, c, t, g, unknown or other
  misc_feature (571)..(571): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattcttttgacacagtctccagacatcgtgtctgtntctcgaggggnagagccacctctcctgacgacgggtccagtacagacgtgttcgccgtacgttcctggccttaggtaaccctaacgaaaaccgtggaccacgtcctaccgaggtcctcgtacacgttcagtcggacactactaccaacgacggcctagtacggctactacccgaggctacggttcaggtcggtctaggtcggctacggtaggtaccagtaccgttcaccgttacctacgacgtactcgaacggttacaggtccgtaaacgccgtggtaacgttatttcgacgtttacgttagttaactgactaggcttaacggcggtacgcgtagtacctacgtccgtaaccgttcggacctaggaccttcgagagacggtntaacggaacgtaacgtgtcggacacggactaccgagttctcggtataccg

SEQ ID NO: 48962 - DNA, 783 bp, Homo sapiens
  misc_feature: GYAE6OF02I6NCR.23.23.C01.1.454.CMB.1.raw
  modified_base (395)..(395): a, c, t, g, unknown or other
  misc_feature (395)..(395): n is a, c, g, or t
tcagacgcgagtatcacgaccggtgctcgatttagtacacgtgattagggattggggagtcaacaaccacatctgtcctcgagaggacaccctgtgaccacagctcctcaccatggactggacctggacgatcctcttcttggtggcagcagtccagaagtcgcccactacccgagaggaattggtgacctagtccgtagggcccttggacggttagaaacggacggtcccgtaggggacattcgaagttacgaaaagtccgtaccgtgacgtaaggtccttcgaacgtacgtacctaccttaccaaaccgtaatttcgaatctaaccgacgttgggacacgtaccgtacggtaccccgtaagggaaacggtcgtacgggtaagttgggtaacgngggtccgtagggtactacgtcgttagtgttacgaagtaaccgtcgggacttcttcgagtaacgtagtcaaacgggcacggtacgtacctggccttacgacgtacgaacgttacctacggtaaagacgtaactaccgaccttaaaggttccaaacggtcggaccgtcccggaacttcccggtacctaccggtaacgtcccggacttaaccgggtccgttaagttaacgtttcccggttaagccggtaccggtaacggggacggtacccggttacgggaccggttacgggtttaacggtttacgggtaaccgtttaaggttaccggtacggggttacttacggggttaccgggttaaccgggtacccgggtaacgggttaaccccggggg

SEQ ID NO: 48963 - DNA, 805 bp, Homo sapiens
  misc_feature: GYAE6OF02HJLH8.23.23.C01.1.454.CMB.1.raw
  modified_base (185)..(186): a, c, t, g, unknown or other
  misc_feature (185)..(186): n is a, c, g, or t
tcagacgcgagtatcacgaccggtgctcgatttagtacacgtgattagggattgggggagtcaacaaccacatctggtcctcgagaggacacccctgtgaccacagctcctcaccatggactggacctggacgatcctcttcgttggtggcagcagccagaagtgcccactccacgagaattggnnagtcgtcggctgaggtgaacggacgccgtgggcagtctagacgaaagtcaccgtgacgaacggtcttacgagggacttaacgacccttaccaaccgttaaaagttttgaattaacttaccgaaccgttggggtctaccggacgaaccggtaccccggtaagggaaacgggtccgtaggaggttagggacggtgggcggttacggggtgtacggttccggtaggttggttacggaaagttaacggtacccgggtacttacggttacctaggtaacggttaaacgttacgtaacggccgtacggtaccgtaccgacggtcccgtaacgtaacggtacgtaaacctaccgttaaccgaaggaaacgtaaccgtacggaacccgttaaggtttaccggaaaccgtcgggttaccgccggttacccgtacgtttaccgtaccgttaacggaccccgggtaccggtcccgggtaccgtttggttaaccgttttacgtcgggatcgggaacgggttccggacggggtccggtaccggttaggttaccgggttttagaacgttttacggtaaggttcgggtaacggtcggttaaccggcggggttaccggggaccggtaacccgggg

SEQ ID NO: 48964 - DNA, 783 bp, Homo sapiens
  misc_feature: GYAE6OF02FYUFT.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatattctttgacacagtctccagacatcgtgtctgtgtctccgaggggagagacgccgaccctctccgtgcgacgggccagtccaggagttggttcgccgtacttccgttggccctaggttaacccaaaccgtaaaaaacccgtcggacccgtaacgccccttaccccgaacgggtcctaccggttcaactttccgagttacgggacaccgacttaccccgaaaccgacggggtacccaaacgttcggacctaccgtaccccgacgggtaccgtaacgggttccaacgggttcggtaccgacgggttacggcccgttacgggttacgggacctaacggtaacctttccgtaaccgttccgtacccgtaaacccgtacgtaccgacggtaccgtacggttaccgtaccccggtacccgtagggttaaaccgttcgttttacggaccgtttaagttttaccgttaacgtcgttacgaggtaccgtaaccggtcgggacgtcccgtggtaccctaacgttccgtacccggttcgaaaccggtacggtaccctcgggtacgacgtaacggtacgtaaccggtaaacgtacgtacggtgaccgttaggcctaccgtatccggttactacccttaccg

SEQ ID NO: 48965 - DNA, 802 bp, Homo sapiens
  misc_feature: GYAE6OF02I6SJ5.23.23.C01.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacacgtgattagggattgggggaggaactgctcagtttggacccagagggaaccatggaagccccagctcagcttctcttcctcctgactcctctggctcccagagaccaccggagatattctttgacacagtctccagacatcgtgtctgtgtctccgagggganagcgccacctctctgcgagggccagtcgagtacgtcggttcgacccgtactcccgttggacccttacggtaaccaaaaccgtaaaaaccgtcggtacccacgacccctacccgagggtccctaccggttcatttaccagtcggtacacctaatacccgaacgcgggaccctacgtcgggtacaccgtcccgaaggtcctaaggttcgacggtcggcgtaacgggtcggtacctacggtaggaaccgtacgtaccttaccgtacgtacccgttactaaccggtactaccggacgtccgttacggttaccgtaccccggtaaccggtacggttaccgttaaacgtttcgtaaccgtttaacggttttaacgtttaacgtcggttaacccgacgttaaccgtacggtacggtacccggttaaccgtccgggttaccttacgttcccggtaacccggttacggggtaacctaaaccgggttaccgtaccggtaaccgggtcgggaacgttaaccggtaaacgggttaaacctaacgggttcgttaccgggactaccgggtacccgtaaacccggttactccgggtttacggtccctttaaccgg

SEQ ID NO: 48966 - DNA, 728 bp, Homo sapiens
  misc_feature: GYAE6OF02GEE6F.23.23.C01.1.454.CMB.1.raw
  modified_base (194)..(194): a, c, t, g, unknown or other
  misc_feature (194)..(194): n is a, c, g, or t
  modified_base (207)..(207): a, c, t, g, unknown or other
  misc_feature (207)..(207): n is a, c, g, or t
  modified_base (322)..(322): a, c, t, g, unknown or other
  misc_feature (322)..(322): n is a, c, g, or t
tcagacgcgagtatcacgaccggtgctcgatttagtacacgtgattagggattgggggaggaactgctcagtttggacccagagggaaccatggaagccccaagctcagcttctcttcctcctgctcctctaggcctcccagagaccaccggagatacttcttttgacactagtctccagacatcgtgtctgtntctccgagggganagacgccaaccctcgtcctgccgacggggcctagtcaagggtacgttgttcggacccgtacttccgttcggccttacggtaaccaaaccaaaaccgtcggaccacgcctacccgnggtccttcgtacactttacgagtcggacacacgtaccaacggtcgggcctaacgtcggactacctacccgaaggaccgtaggttacagggtacggtcgtaaggtcgggacttcgggtacgggaacctacggtacttcgaccgttccgttacgaaccgtagtacgacgttcgaacgttcccggtaccacccggttaacgtacgtttacttacggtacgttaaacgtttcttaacggttacgtacgtaaccggtacgtaaaccggtccgggtacccttaccgggtcgttacccgaacgttcccggttaacccggtcggtacgaaaccgggtcctaaccggtgtacgagttaaccgaacggaacgtagtgtacggaacttcgacgtacttacgtcttacgttacctccg

SEQ ID NO: 48967 - DNA, 872 bp, Homo sapiens
  misc_feature: GYAE6OF02FRS6B.23.23.C01.1.454.CMB.1.raw
  modified_base (189)..(189): a, c, t, g, unknown or other
  misc_feature (189)..(189): n is a, c, g, or t
tcagacgcgagtatcacgaccggtgctcgatttagtacacgtgattagggattggggggaggaactgctcagtttggaccctagagggaaccatggaagccccagcgtcagcttctcttctcctgctcctctggctcccagaggacccaccggagtactagttccttttagacacagttctccagaacnttcgtcgtctggtcgtccgtccgaggggagacgacgtcccaccctcgtaccctgtccgacgggaccaggtaccaggtaacgttggttacggacccgaacttcccgttgggtaccgttacggttaacccctaaaaccgtaaaaaaccccttcgggtacccgaaccgaccccgtacccccaaggtacccgtaccggtacctaacttaccacgtacggactaacctaacgttaaccgaaaccgaacgggggacccctaacggttaccggggacctaacccgttaccccggtaacggggtcccggttaacgggtttcccgtaacgggtacgggtaccgtaacggtttcgggcccgttccggtacgggtaaccgacggtacccgttcgtaacccgttcctaccggtacccgtagtaccacggtaccgtacggtacggttcccgaacccggtttacgtaaccgggttacggttttacggaaccgttaacggttttaacgtttaccgttcgttaacgtacggttaaccgttaaccgggttacgggaccggtacccgtcggggttacccttagtaccggttaccccgttagggtaaccccgaagggtccgtacggtaggttaccggacgtagtaaccggaacggttactggtacgtactaccggacttaccgtctcgttactacgttaccg

SEQ ID NO: 48968 - DNA, 795 bp, Homo sapiens
  misc_feature: GYAE6OF02FQWO1.23.23.C01.1.454.CMB.1.raw
  modified_base (200)..(200): a, c, t, g, unknown or other
  misc_feature (200)..(200): n is a, c, g, or t
tcagacgcgagtatcacgaccggtgctcgatttagtacacgtgattagggagttggggagtcaacaaccacatctgtcctcgagaggacaccctgtgaccacagcctcctccaccatggactcggacctggacgtatccctcttcgttgggtggcagcacgaccgaagaagtcgcccctacctcccgagaaggtattggngcgagtcgtcggtcctaggaggtagaaagacggccggtggggactagtcaggtagaaactcctaccgtgacgaacggtcttagacggtaactacctaccttaccaaccgttaatttagaacttacgtacgtaacggtggggtctaccggtacgtacgggtaccccggtaaggggaaaccggtcgtaacggtacggtagggtacggtgggtacggttacggggtagttacggttccgttaggttggttaccggaaaggttaccgtaccgggtacttacgttcgtaacggtacgtaacgttacggaacggtccgtaggtcctaccgtacgtaccgtacgtaccgtaacggaccttaccgacgtaaggaacgaaccgtaccaccgtttacgtacggtacgtccggcggtcccgtaccgtcgtcccgtacggacgaccggtaccggtccggtaccgttagtttaccgttagttcgtacggacggacgggtaggtaccgggtccggtaccgtttcgggttttaaggtttacggtaagtttaccgttaggttaggtttacggtcggttaccgggtcggggtaccgggtaccggtaaccggg

SEQ ID NO: 48969 - DNA, 629 bp, Homo sapiens
  misc_feature: GYAE6OF02FUH81.23.23.C01.1.454.CMB.1.raw
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccggagatatttcttttgacacagtctccagacatcgtgtctgtgtctccgaggggagagacgccaccctctcctgcagggccagtcagagtgttcgccgactccttggcctggtacccaaacaaaacctggaccagccctccaggcctcgtcacttcatcggaccacactacccgaacgacgggaccacgtcggaccactccccgaggtcctaggttacacggtggcgtacggtggtaccgtcggtacgggactacgtacttccaccttcgtacgacgtactcagctacgtcgtaccgaccgttcgaacttagtttacacgttacgtttaacgttacgttacgttccgacgtaacgtacggtcggaccgtccgtcggtacctctaccgtaccgttccgaaccgtaacggacgttcgacgtagtacgacgtaggaaaccgtagtcggtacggtactcggacctacctacgtcgtactcttaccg

SEQ ID NO: 48970 - DNA, 896 bp, Homo sapiens
  misc_feature: GYAE6OF02F842L.23.23.C01.1.454.CMB.1.raw
  modified_base (110)..(110): a, c, t, g, unknown or other
  misc_feature (110)..(110): n is a, c, g, or t
tcagacgcgagtatcacgaccggtgctcgatttagtacacgtgattagggattggggacgtcaacaaccacatctgtcctcgagaggacacctgtgaccacagctcctanaccatggactggacctggacgactcctcttctggtgcagcacgcagaagtcgccctactcccaacgtagtaacgttggtagcctagttcgtcgggacctggtaagggtacgaaaggacgtccggttaggggacctacgttacgtacggtaacggtaaacgttccgaacctgtaaccgtagggttaccttacggacggtaactacccttaaccgttacctaaaccgttaaaagtttcaacttaactacgtaaacgggttcgggtacgaccggtaacgacccggtaacccggtaaggggtaaaccggtcgtaacggtcggttaaggtcggtacgggtcggttaagggcctaccggttactaaggtttcgttaagggaaccgtaacggttaccggtacttacgtccgttaacgaaaagggtttccgtaaaccggaacggtccccgaacggttactacccggtaagtacccgtaccggtaaccgtaaccggtaacctttaccgttaaacccggaacgtaaaaccggtaccctaaccggtaccgtttaaacggtaccgttaacggtccgggtaccccgttacgggttacccgtacccggtacgtttccgaacccgggacgttaccggtaaccggtacggtttacttaacgttacggttacgacggtttaccgggagggaccgggtcggttccggttacgtacgggtttttaagggtaccgttaaaggttccgtttaaggtacgggttacgtttccggggccgtttaacggggaccggttacggtaaccggg

SEQ ID NO: 48971 - DNA, 729 bp, Homo sapiens
  misc_feature: GYAE6OF02GQAHW.23.23.C01.1.454.CMB.1.raw
  modified_base (204)..(204): a, c, t, g, unknown or other
  misc_feature (204)..(204): n is a, c, g, or t
  modified_base (311)..(311): a, c, t, g, unknown or other
  misc_feature (311)..(311): n is a, c, g, or t
  modified_base (365)..(365): a, c, t, g, unknown or other
  misc_feature (365)..(365): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagaccaccgggagatattcttttgacacagtctccagacatcgtgtctgtgtcgtccgagggganaggacgccacccttcgtcctgcgacgggccagtcagtagtgttcgccgtactcgtggcctcggtaaccaaacaaaaccgtgaccacgcctccgagcctcgtctatcngtacgacacgacaccaacgacggccagtcggcacgtccgaggactaggttacgnggtcggcgtaggtcgtcgtacgtacgggactacggtactttacactccgtacgtacgtactccgaagccgttaacggtcgtacccggtaacccgttggtaaccgtttagtttacgtaacccgttaagttttaccgtacgtttacgtcgtacgtaccggttaccgggtacggtccgttccggttacgacccgtttacctaaccggttacccggttaccgggaaccggttaaccgggtaccgttacgggtaccggttacggggaaaggtaccgttaaaccgggaaaccggttaccggttaggtcccggttaacgttaccggaccgtttaaaccggtccgttacgtttaccggttcctttaaccccg

SEQ ID NO: 48972 - DNA, 731 bp, Homo sapiens
  misc_feature: GYAE6OF02JVJIE.23.23.C01.1.454.CMB.1.raw
  modified_base (204)..(204): a, c, t, g, unknown or other
  misc_feature (204)..(204): n is a, c, g, or t
  modified_base (338)..(338): a, c, t, g, unknown or other
  misc_feature (338)..(338): n is a, c, g, or t
tcagacgcgagtatcacgaccggtgctcgatttagtacacgtgattagggattgggggaggaactgctcagtttggacccagagggaaccatggaagccccagctcagcttctcttcctcctgctcctctggctcccagagacccaccgggagatatttcttttgacacagtctccagacatcgtgtctgtgtctcgagggganacgagccaccctctcctgccgagggcccaggttccaggtacgttcgttgacccgtcttccgttcggccttaggtaaccaaaacaaaaaccctcggaccacgtccccgtacccgacggcctccgtactacttacngtacggacacctactaccgaacgaccgggtacctaacgtcggacctacgttaccccggaggttaccggtacggttaccgacgggtcggaccggtacggttccgggtacgtcgggttaacgggaaccgacgtaccgttaccgacctcgtaccgacgtacgtaacgcgacgtcggtacgtcccgacctacgtacgttcgttatccgttaacgtttagttccgtgtactacggtcgtacgtcggcctcgtcgtcctacgccgttaccgtacgggtaccgtacggtactacgtaccgtagggtaacccgtaggaaccggtaaacgttccgggtacggtaccgtaacccgttcggaccgttaacccggttacgttacggtttacctacccgtttaacg

SEQ ID NO: 48973 - DNA, 737 bp, Homo sapiens
  misc_feature: GYAE6OF02F8W59.23.23.C01.1.454.CMB.1.raw
  modified_base (125)..(125): a, c, t, g, unknown or other
  misc_feature (125)..(125): n is a, c, g, or t
  modified_base (182)..(182): a, c, t, g, unknown or other
  misc_feature (182)..(182): n is a, c, g, or t
  modified_base (205)..(205): a, c, t, g, unknown or other
  misc_feature (205)..(205): n is a, c, g, or t
  modified_base (552)..(552): a, c, t, g, unknown or other
  misc_feature (552)..(552): n is a, c, g, or t
tcagacgcgagtatcacgaccggtgctcgatttagtacacgtgattagggattgggggaggaactgctcagtttggacccagagggaaccatggagccccagctcagctctctctcctgctcctnggctccagacgaccaccggagtactattctttagacacacgtctaccagacattcgngtctagtcgtcgtcgaggggtanacgacgacccaccctactccctagaccgagggacctaggtaccaggtacgttggtcgaccggtaccttccgttggaccgttaggtacctaaaaccgtaaaaccgtcggaccaccgtccgtacccgagggaccttcgtactacgttacagtacggctaactaccgtaccgaccgacgggtaccacggtaccggactaaccgtcccgaagcgttaaggtcgaggttacgacggtcgggtcgtacgtacggaacgggtacgtacgtaccgttcccaacgttccggaaaccggttacaggtaccgagtcccgtaaacggtccgtacccggtacggtacgtacgtttacgtnttaccggttattttaccgacgtttcgacgtaacgtcgaccgtcgggtccttccggaacgttacctcgtaacccgttccgggacgaaacccggtcggtacctaccgggtctaggaacgttacggaacgtaacgggtactgggtccctacgggtcaaccgttacgtactccgttacggacccttccg

SEQ ID NO: 48974 - DNA, 727 bp, Homo sapiens
  misc_feature: GYAE6OF02JCBMO.23.23.C01.1.454.CMB.1.raw
  modified_base (502)..(502): a, c, t, g, unknown or other
  misc_feature (502)..(502): n is a, c, g, or t
  modified_base (706)..(706): a, c, t, g, unknown or other
  misc_feature (706)..(706): n is a, c, g, or t
tcagacgcgagtatcacgaccggtgctcgatttagtacacgtgattagggattgggggaggaactgctcagtttggacccagagggaacccatggaagccccagctcagcttctcttcctcctgctcctctggcctcccagagaccaccggagatattcttttgacactagtctccagacatacgtgtctgtcgtctccgaggggacagacgcccaccctctcctgcgtacgggcccaggtccaggtagttaggttcgaccccgtacttcccgttagggccccttacggggtaaccctaaaaccgtaaaaaaccccgtcggtaccccaacggtccccctacccgacggtacccttccgtactacttcctaagttacgggacctacactacccgaacgacgggaccctacgtcggaccacctacccgaggcgtacggttcgacgtcggactacggtggacctcgtacggacgtacggtaccttacgaccttcaccgactaacncgacgtcgtacgtcgtaccgacccgtgtacgttactttagacgttaacgtttacgttcgttagaccgtacgtaccgtacgggtccggtaccgcccgttacgacccgtacgttacccgtaccgtccggtaaccgaaccggtaccgtacgtaccggtagtaggaacgtacgtaaccgtacgtcggtacgtccgtacgaccttaccngttaccgttccttattacccg

SEQ ID NO: 48975 - DNA, 739 bp, Homo sapiens
  misc_feature: GYAE6OF02FFM8S.23.23.C01.1.454.CMB.1.raw
  modified_base (223)..(223): a, c, t, g, unknown or other
  misc_feature (223)..(223): n is a, c, g, or t
  modified_base (723)..(723): a, c, t, g, unknown or other
  misc_feature (723)..(723): n is a, c, g, or t
tcagacgcgagtatcacgaccggtgctcgatttagtacacgtgattagggagttgggggaggaactgctcagttggacccagagggaaccatggaagccccagctcagcttctcttcctcctgcctcctctggcctcccagacgaccaccggagatattccgtttagacacagtctccagaccatcgtgtctgtcgtcctccgagggacagcgacccaccctnccctggccgtacgggccagtccaggacgtgttcggaccgacttcccgttagggtccctagggtaaaccctaaaccgaaaaccgtcggacccgaggtcccccttaacccggacggtcccttaccggtacctactttaccgagttcggaccaacacgttaccaaccgtacgggtacccaacggttcgacctaacgccccgtaagggtccgttacgggttaccgtaggtcggtaccgtcgggtacggtccgtacggtagggaacccgtacgtaacccgttactaacccttccgtaccgaccgtacaccggtacgaccgtacgttccggacccgtaacccgttgtacgtttacgttcgaacgttagtttacctacgtcgtacgacgtaccgtacggtacgtcccggcgtacggacccttacgtcccgtaccggttaccggacgtacggtctacgtacgtagactaggtaaccgacgtagtcggtacctcgtacgactacccgtntcgtacgttctacccg

SEQ ID NO: 48976 - DNA, 591 bp, Homo sapiens
  misc_feature: GYAE6OF01B9UF7.3.50.E06.1.454.CMB.1.raw
  modified_base (416)..(416): a, c, t, g, unknown or other
  misc_feature (416)..(416): n is a, c, g, or t
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatccctccctgtctgcatctggtaggggacagagtcaccatcacttgccggcaagtcagagtattagctaggtattaatggtatcagacaaaacgagggaaactcccttaaatttgatctatgctgctactcctagtttcgacgtaaaggttcgggtaccctatacgaaggttcaagtggacaggtggatcgtggacagtacttcactctacaccatcagctagtctacgagtctagtaagttntttcgaccttaactttactacgttacgtaacaactaaggtacgtttaactaaggtttacctttaggttaaccttttaccgtaccgttttccgggaccctaggggtaacctaaacggtggaaacctagtaaccgaaaacgtacttggtacggaccttaggaccctacgtattcccg

SEQ ID NO: 48977 - DNA, 495 bp, Homo sapiens
  misc_feature: GYAE6OF01BOXJ3.3.50.E06.1.454.CMB.1.raw
  modified_base (469)..(469): a, c, t, g, unknown or other
  misc_feature (469)..(469): n is a, c, g, or t
  modified_base (489)..(489): a, c, t, g, unknown or other
  misc_feature (489)..(489): n is a, c, g, or t
  modified_base (492)..(492): a, c, t, g, unknown or other
  misc_feature (492)..(492): n is a, c, g, or t
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctccctgtctgcatctgtaggggacagagtcaccatcacttgccgggcaagtcagagtattagcaggtatttaaattggtatcagcaaaaaccagggaaagcccctaaattttgatctatgctgcatccagtttgcaaagtgggtcccatcaaggttcaatggcagtggatctgggacagatttcactctcaccatcagcagtctacagcctagaagtattttgctaactttactactgtacaacagtagttacagttacttggtatttcactttcggcctggaccaagtcganatcaaacgactgtggctgcnctntcg

SEQ ID NO: 48978 - DNA, 546 bp, Homo sapiens
  misc_feature: GYAE6OF01BVF5Z.3.50.E06.1.454.CMB.1.raw
  modified_base (275)..(275): a, c, t, g, unknown or other
  misc_feature (275)..(275): n is a, c, g, or t
  modified_base (389)..(389): a, c, t, g, unknown or other
  misc_feature (389)..(389): n is a, c, g, or t
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctccctgtctgcatctggtaggggacagagtcacatcacttgccgggcaagtcagagtattagctaggtattaaattggtatcagacaaaaccaggaaancccttaaatttgatctatgctgcatccagtttgacaaaggtcgggtccatctaaaggttcaatggcagtgatcgtgggacaggtatttcactctcacctatcagctagtctacncgtacctagaagttatttgacttaacttactatcgacaactagtacgttactagttacttaggttacttactacgtttcggaccttacgggtaacctaaggtcgaactactaacccgaaagtaacttcggtacggacttagacctaacgtgttaccg

SEQ ID NO: 48979 - DNA, 559 bp, Homo sapiens
  misc_feature: GYAE6OF01ECH61.3.50.E06.1.454.CMB.1.raw
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctccctgtctgcatctgtaggggacagagtcaccatcacttgccgggcaagtcagagtattagcaggtatttaaattggtatcaagacaaaaaccagggaaagccctaaacttttgatctatgctgcatccagtttgctaaagtgggtcccatcaaggttcaatggcagtgatctgggacagtatttcactctacacatcagcagtcacagcctagaatatttgactaacttactactgtacaatagtacgttactagttactttggttactttacgtacgttttccggcccgttagggtaaaccctaaaggttcggaactaacgttaaccgaaaaaccgtaacgtacggttaggacccttaggaccctaaccctagttacccg

SEQ ID NO: 48980 - DNA, 535 bp, Homo sapiens
  misc_feature: GYAE6OF01DQ38F.3.50.E06.1.454.CMB.1.raw
  modified_base (393)..(393): a, c, t, g, unknown or other
  misc_feature (393)..(393): n is a, c, g, or t
  modified_base (532)..(532): a, c, t, g, unknown or other
  misc_feature (532)..(532): n is a, c, g, or t
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctccctgtctgcatctgtaggggacagagtcaccatcacttgccgggcaagtcagagtattagcaggtatttaaattggtatcagacaaaaacagggaactccctaaattttgatctatgctgcatccagtttgactaaaggtgggtacccatcaaggttcaatggcagtggatcgtgggactagtatttccacttctacaccatcagcagtctaacngcctagaagtattttagactaacttactactgtacaactagtagttactagttacttggttatttcacgtttccggccctaggggtaacccaaaggttcggaatactaccgaaaacgtactggtacggactagcacctntcg

SEQ ID NO: 48981 - DNA, 551 bp, Homo sapiens
  misc_feature: GYAE6OF01BCOXN.3.50.E06.1.454.CMB.1.raw
  modified_base (274)..(274): a, c, t, g, unknown or other
  misc_feature (274)..(274): n is a, c, g, or t
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctccctgtctgcatctgtaggggacagagtcaccatcacttgccgggcaagtcagagtattagcaggtatttaaattggtatcagacaaaacaggaaanccctaaatttgatctatgctgcatccagtttgcaaagtgggtcccatcaaggttcaatggcagtgatcgtgggacagattcactctcaccatcagcagtctacagcctgaagtattttagactaactttactactagtacaaacgtagtagttaactagttactttagggttactttctaaccgttttccgggtacccttaggggtaaccctaaaaggttcggaactagttaccaaaaccggtaacgtaggtacggtctaggaccaccgtattaccg

SEQ ID NO: 48982 - DNA, 627 bp, Homo sapiens
  misc_feature: GYAE6OF01DC612.3.50.E06.1.454.CMB.1.raw
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatccctccctgtctgcatctgtaggtgacagagtcaccatcacttgccgggcaagtcagagtattagctaggttatttaattggtatcaagacaaaaacgagggaaactaccccttaaattttgaatctatgctgctatcctagtttgacgtaaggtcgggtcccaagtacgaaaggtttcaagttcggacaggtggatcgtagggactagtactttcgacttcctacaacctattaccgaagtctaagttacctaacgacgtacccgtaaggtaaacgtttacttttacgaccttaaactttacttacctgttaacaaacgtagtaacgtttaactacgtttaacgtttggttactttccgtaacccgttttccgggacccgttagggaacccgtaaaggtacggtaactacgtaaccaaacgtacgtcggtacggacctacggcctacctacg

SEQ ID NO: 48983 - DNA, 519 bp, Homo sapiens
  misc_feature: GYAE6OF01CUPMA.3.50.E06.1.454.CMB.1.raw
  modified_base (267)..(267): a, c, t, g, unknown or other
  misc_feature (267)..(267): n is a, c, g, or t
  modified_base (398)..(398): a, c, t, g, unknown or other
  misc_feature (398)..(398): n is a, c, g, or t
  modified_base (511)..(511): a, c, t, g, unknown or other
  misc_feature (511)..(511): n is a, c, g, or t
  modified_base (515)..(515): a, c, t, g, unknown or other
  misc_feature (515)..(515): n is a, c, g, or t
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctccctgtctgcatctgtaggggacagagtcaccatcacttgccgggcaagtcagagtattagcaggtatttaaatggtatcagacaaaacnggaaacgccctaaatttgatctatgctgcatccagtttgactaaaggtcgggtcccatcgaaggttcaatggcagtggatcgtggactagtatttcactctacacatcagcagtctacacgcctagaagtntttagactaactttactacttgtacaacgagtacgttaacagttacgttgttactttctacgtttcggtcgtagggacctaaaggtgacatacaaacgtactgtaggctgacncctnttcg

SEQ ID NO: 48984 - DNA, 645 bp, Homo sapiens
  misc_feature: GYAE6OF01CW067.3.50.E06.1.454.CMB.1.raw
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatcgacccagtcctccactcctccctgtctgcatcgtggtaggggacagagtcaccatccacgttcgccgggcaagtcagagtattagctaggtaatttaatggtatcagaacaaaaccgagggaaactacccttaaatttgatctatgctgcactcctagtttcgacgtaaagggtcgggtaccctagtacgtaacggttacaaaggtggacgtaggtaggtagtcggtagggaactaaggtactttccacttcctacgaaccattaccgagacctagttacctacgacgtccgtaagtaagttactttacgaccttaactttacttactacgtacgtaaacaggttaacgttactaagttacgtttagtttaactttccgttaaccgtttacccgggtacccgtagggtaaacccgtaaggtcggtaacctagttaaaccaaacggttacttacggtacggtactcgacctaaccgtgttacccg

SEQ ID NO: 48985 - DNA, 622 bp, Homo sapiens
  misc_feature: GYAE6OF01BX37T.3.50.E06.1.454.CMB.1.raw
  modified_base (224)..(224): a, c, t, g, unknown or other
  misc_feature (224)..(224): n is a, c, g, or t
  modified_base (278)..(278): a, c, t, g, unknown or other
  misc_feature (278)..(278): n is a, c, g, or t
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatccctccctgtctgcatcgtgtaggggacagagtcaccatcacttgccggnaagtcagagtattagctaggtatttaaatggtatcagacaaaaccgaggaaacnccccttaaatttgatctatgctgctatcctagtttgacgtaaagtcgggtacccagtacaaggttcaagtcggctaggtggattcgtagggactaggtactttcacttctacaccataccagtcagttacctacacgcctagtaagttcttttacgaccttaacctttacttacgttacgtacaaacgtagtaaccgtttacgtaacccttacccccgttccgtaccgttaccgtaccggtttaccggggacgggtaacgggaacccgttaagggtcggaacgtaactaccggaaaaccggtagttacgggtacggaccttacggaccctaacccgtggttccc

SEQ ID NO: 48986 - DNA, 738 bp, Homo sapiens
  misc_feature: GYAE6OF01EC5FT.3.50.E06.1.454.CMB.1.raw
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctcctgtctgcatctggtaggggacagagtcaccatcacttggccgggacaagtcagagtattagcaggttaatttaaattggtatcagacaaaaacgagggaaactaccccttaaattttgattctatgactgctatcctagtttcgacgtaaaggttcggggtacccctaagtaccgtaaaggtttcaaagttcggacgtaaggtaggtaagttaccgtagggggaacctaaggttacgttttacccaccgtttaccttaccgaaacccttaattaccgaacggtaccttaagggttaccctaaacgtaacgtacccgttaagggtaaacggtttagttttttaaccgaccgtttaaaacctttaccgtttaaccgttacggttaaccaaaacgtaacgggtaacgttttaaaccgtaacggtttacgttttaacggttacttttaccgttaccggttttacccgggacccccgttaggggaaacccgttaaaggggtcggtaaactacgtaaaccgtaaaacgtacgttacggtcggacttacgcctaacgtcgttaccg

SEQ ID NO: 48987 - DNA, 677 bp, Homo sapiens
  misc_feature: GYAE6OF01EGROK.3.50.E06.1.454.CMB.1.raw
tcagagacgcactccacgaccggtgctcgatttagatctactgacaacacacaagggggagtcagtctcagtcaggacacagcatggacatgacgggtccccgctcagctccgtggggctcctgctactctggctccgaggtgccagatgtgacatccagatcgacccagtcctccatccctccctgtctgcatcgtggtaggggacagacgtcaccatcacgttcggccgggacaagtcagtagtatagactaaggttaatttaaagttggtatacgaagaacaaaaaccgagggtaaacctacccttaaagtttgattactatgtactcgactactccgtagttagacgtaaagggtcgggtacccagtacgtaaggttacaagtcggacgtaggtcggtactacggtaggactagttacttacgaccttactaccgaacctagtaccgacgtactacgttaacctaacgacgtcttaaggtaacgttacttttacgaacctttaaaccgtttactaacgttcgtaaccgtaaacgttagtaacgttacgttaacgtttacggtttacgttacctttaccgtaccgtttacccgggtacccgttagggtaaaccgtaaggtcgaactaacgtaaacgtaaacgtacgtcggtaccgtactacgaccagtcttacg

SEQ ID NO: 48988 - DNA, 562 bp, Homo sapiens
  misc_feature: GYAE6OF01BK75N.3.50.E06.1.454.CMB.1.raw
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctccctgtctgcatctgtaggggacagagtcaccatcacttgccgggcaagtcagagtattagcaggttatttaaattggtatcagacaaaacagggaaacgcccctaaatttgatctatgctgcatccagtttgactaaaggtgggtcccatcaaggttcaagtggactagtgatcgtgggactaggtactttcgacttctacacctatcagctagtctacacgcctagaagttattttgactaactttactactgtacaactagtagttacgtagtttactttggtactttccgtaacgtttccggaccccgttagggaaccctaaaggtcggaacctacttaccgaaaacgtaactcggtacggacttaggacctacgtgttcg

SEQ ID NO: 48989 - DNA, 747 bp, Homo sapiens
  misc_feature: GYAE6OF01D6LI1.3.50.E06.1.454.CMB.1.raw
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctcctgtctgcatctgtagggacagagtcaccatcacttgccgggcaagtcagagtattagcaggttatttaaattggtatcaagacaaaaacgagggaaactaccccttaaatttgatctatgctagcatcctagtttcgacgtaaaggtcgggtacccagtacgtaaacgggtttacaaacgttggaccgtaggtacgggtacttccggtaaggggtaaccgtaaggttaacttttccgtaaccttcccttaccgaaccctaattaccgacggtacctaacggttacctaacgtacggtcccttaagggtaaacttttacgttttaccggaaccttaaaacccgttttaccttaacgtttaccggtaacctaaacgtaacgttaacgtttaaaccgttaagtttaaccgttttacggttaacttttacccggttaaccgtttccggtaaccccggtttagggaaacccgtttaaagggtccgggtaaaccttaacggttaaacccgaaaaaccggttaagttcggggtacgttacccgtacgggtaacccctaaccgttaagtttccccg

SEQ ID NO: 48990 - DNA, 678 bp, Homo sapiens
  misc_feature: GYAE6OF01EYCNU.3.50.E06.1.454.CMB.1.raw
tcagagacgcactccacgaccggtgctcgatttagatctactgacaacacacaagggggagtcagtctcagtcaggacacagcatggacatggagggtccccgctcagctccgtggggctcctgctactctggctccggaggtgccagatgtgacatccagatcgacccagtctccatccctcctgtctgcatcgtggtagggacagacgtaccacctatccacgttcggccgggacaaggtcaggtagttaatagcgtaaggttaatttaaagttggtatacgaagaaccaaaaaccgaagggaaaccgtaccccgttaaacgttttgacttactagtcgtctgcctacttccgtagtttacgaacgtaaacgggtcgggtaccctaagtacgtaaggttacaagtggacgtaggttaggagtcgtagggactaagttactttacaccttactaccaacctactacagtactaagtacctaacgaccgtaccgtaagtaaagtttatttacgtaccttaaccttaacttacgttacgtaaccaacgttaaaggtacgttaacgttacgtttacgtttagtttaacttaccgttaccgtttccgggtacccgttacggaaacgtaaggtcgaataacgtaacgaaacgtacgtcgtacggtacacgcctactgttccg

SEQ ID NO: 48991 - DNA, 621 bp, Homo sapiens
  misc_feature: GYAE6OF01CICEG.3.50.E06.1.454.CMB.1.raw
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatccctcctgtctgcatctggtaggggacagagtcaccatcacgttcggccgggcaagtcagagtattagactaaggttaatttaaagttggtatcaagaacaaaaaccgagggaaactaccccttaaattttgatctatgctgcatcctagtttcgacgtaaaggtcgggtaccaagtacgtaaggttacaaagtcggactaggtacggattcggtacgggactaggtaactttccaccttactacccaacctatccgagcgtaagttacctaacgacgtacctaagtaagttacttttacgaccttaactttactacgtactaacgtaactaggtacgtttaactagtttacgtttgttaacttttaccgtaccggtttccggaccgtagggtaacctaaggtcgaactactaacgaaacgtattaggtcgctacgacctctgttcg

SEQ ID NO: 48992 - DNA, 640 bp, Homo sapiens
  misc_feature: GYAE6OF01AHS9H.3.50.E06.1.454.CMB.1.raw
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctccctgtctgcatctggtaggggacagagtcaccatcacttgccgggcaagtcagagtattagtactcgttgcctggtatcagacaaagaccaggcagacgcccaagcctccttatctctgatcgcctactaagtttcgactacgtacggttcggggtaccccaacgtaaccgttccgaacggcggacgtaggtggacttcggtagggaacgaggtacgttaccaccgttcctaccaccctactcgaacggtccaacggtccctacggcctaccggtcccgtacggacgtaagttcggttacggtaacttaaccgtttaacgttaccgtacgtaaccctaacgtaagttacgtagtaacgtttaaggtttacgttagggtaccggttaccgggacccggtaaagggaaccgaaacgtaagtaaacgtaaacgtaaccgaaaccgtaagtcggtaggtccgtacg

SEQ ID NO: 48993 - DNA, 670 bp, Homo sapiens
  misc_feature: GYAE6OF01DD01B.3.50.E06.1.454.CMB.1.raw
  modified_base (245)..(245): a, c, t, g, unknown or other
  misc_feature (245)..(245): n is a, c, g, or t
  modified_base (280)..(280): a, c, t, g, unknown or other
  misc_feature (280)..(280): n is a, c, g, or t
tcagagacgcactccacgaccggtgctcgatttagatctactgacaacacacaagggggagtcagtctcagtcaggacacagcatggacatggacgggtcccccgctcagccttccgtggggcctcctgctactctggctccgaggtcgccagatgtgacatccagatcgacccagtcctccactccctccctgtctgcatcgtaggtaggggacagtacgtcacctatcacgttggcccggganaagtcaggatatagactaggttaatttaagtgtancagaacaaaacgagggaactacccttaaatttgatctatgtactcgtacactaccgtaggtttacgacgtaaacgggtcgggtaccaagttcgaacggttactaagtcggtacgtaggtggtacgtcggtagggactaggttactttccacctctaccaacctcgttacagtacgtacgtccgttaacaacgtcccgtaagtaagttcttacgaactttaaccgtttacgtaacgtagtacaaagtcgttaaacgttacgtaacgttacgtttaggttaaccttttacgaccggttttacccgaccggttaacggtaaccgaaggttacggaacttacgtaaaccgaaacggtacgtggtaccggtataccggcctaaccgtagttcccg

SEQ ID NO: 48994 - DNA, 665 bp, Homo sapiens
  misc_feature: GYAE6OF01AS4K2.3.50.E06.1.454.CMB.1.raw
tcagagacgcactccacgaccggtgctcgatttagatctactgacaacacacaagggggagtcagtctcagtcaggacacgagcatggacatgagggtccccgctcagctcctggggctcctgctactctggctccgaggtgccagatgtgacatccagatgacccagtctccatcctcctgtctgacatctggtagggacagagtcaccatcactgccggcaagtcagagtatagactaggttaattaagtggtatcagaacaaaacgaggaactacccttaaagtttgatctatgctgctatcctagttagacgtaaagggtcgggtacccagtacgtaaggttacgaagtggacgtaaggtggacgttcggtacgggactagtactttacacttaccgtaccacctacgtccgacgtaccgtaactcctaacgtaccgtaccgtaagtaacgttacgtttacgaacccttaaccgttaccttacgtacgtaacctaacgtaaggtaacgttaaccgtaacgtttaccgttaggttactttacccgtacggttcccggtacccgttaacgggtaaacccgtaaagggtccgtaaacctaacgttaaacccgtaaaaccggtacgttacgggtacggtaccgtagaccctaaccgtgttaccgg

SEQ ID NO: 48995 - DNA, 685 bp, Homo sapiens
  misc_feature: GYAE6OF01CTA23.3.50.E06.1.454.CMB.1.raw
tcagagacgcactccacgaccggtgctcgatttagatctactgacaacacacaaggggggagtcagtctcagtcaggacacagcatggacatgagggtccccgctcagcctccgtggggctcctgctactctggctccgaggtgccagatgtgacatccagatcgacccagtcctccactccctccctgtctgcatctggtaggggacagagtcaccatcacgttcggccgggcaagtcagtagttatagcgtaaggttaatttaaagttggtatcaagaacaaaaaccgagggaaacctaccccttaaatttgattctaatcgctacgactacttaccgtagtttacgaacgtaaagggtccgggtaccctagtacgtaaaggttacaagtcggacgtaggtggatcggtagggaactaggttactttcctacttcctacctaacctataccgacgctaacgttaccgtaacgaacggtcctaggtaaacgtttagttttcgaacccttaactttacgttactacgttaactaaacgtagttaacgttaacgttagtttaacgtttggtttaactttccgttaccgtttccgggtaccgtaacgggtaacgtaaacggtcggaaacctacgtaaccgtaaaaccgtacggttacgtacggtactagaccctaacgtcgttaccg

SEQ ID NO: 48996 - DNA, 656 bp, Homo sapiens
  misc_feature: GYAE6OF01E0BQL.3.50.E06.1.454.CMB.1.raw
  modified_base (267)..(267): a, c, t, g, unknown or other
  misc_feature (267)..(267): n is a, c, g, or t
  modified_base (276)..(276): a, c, t, g, unknown or other
  misc_feature (276)..(276): n is a, c, g, or t
  modified_base (292)..(292): a, c, t, g, unknown or other
  misc_feature (292)..(292): n is a, c, g, or t
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctccctgtctgcatctgtaggggacagagtcaccatcacttgccgggcaagtcagagtattagcaggtatttaatggtatcagcaaaaaccngggaaaccntaccctaacttagtanatactagtcgtctcgactactacgttagtacgaacgtaacgggtccggtacctacgtaacggtacgtaacgtaggtacgtacgtaggtagtacgtcggtacggtacgtagttacttacctacctacctaccctaacctactacgacgtacgtacgtaccgtaacgtaccgtacgtaagtaacgtttacgttacgtaaccttaaccttaaccttacgtacgtaacctaacgtaacgttaacgttaacgttacgttacgttacgtttacgttaccgttaccggttacccggtaccggtaccggtaaacgtaaggtacgtaacgtaacgtaacgaaacgtacgtacggtacgtcgtcgtaccgtacg

SEQ ID NO: 48997 - DNA, 730 bp, Homo sapiens
  misc_feature: GYAE6OF01EXQGZ.3.50.E06.1.454.CMB.1.raw
  modified_base (225)..(225): a, c, t, g, unknown or other
  misc_feature (225)..(225): n is a, c, g, or t
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatccctcctgtctgcatctggtaggggcagagtcacctatcacttgccggganaagtcagtagtattagcgtaggttatttaagtggtatcgagaacaaaaaccgagggtaaaaccgtaccccttaaagttttcgattacctagtgtcctgcctattccctagtttcgaacgtaaagggtccgggtaccatacgtaaggttcaaggtcggacgtaggtagtacgtcgtagggtactacggtactttaccgacttacccgtacaaccccgtagtaccgagtaccgaacgtttaccgaacttacggacccgtagtaaacgttacttttacggaccttaaaccgttttactacccgttacgtaacctaaacgaggttaacctttacgtaacggttttacggttacggttttaacctttccgtaaccgggttttcccggtacccgggttaccggggaaacgttaaaccgggttccggaaaccgttaacgtaaacccggtaaaacccggttagttcggggacggtttacccgacgtaaccccggttaacctaagtttccccgg

SEQ ID NO: 48998 - DNA, 662 bp, Homo sapiens
  misc_feature: GYAE6OF01DHFEF.3.50.E06.1.454.CMB.1.raw
tcagagacgcactccacgaccggtgctcgatttagatctactgacaacacacaagggggagtcagtctcagtcaggacacagcatggacatgagggtccccgctcagctccgtggggctcctgctactctggctccgaggtgccagatgtgacatccagatcgacccagtcctccatcctccctgtctgcatcgtggtaggggacagagtcaccatcacttcgaccaggacagtcagtagttatagcgtaaggttaatttaaagttggtatacgaacgaaccaaaaacggacgggtaaacctacccctttaaagttttgacttctagtgctgactacttccgtagtttacgacgtaacgggttcgggtacctagttacgtaaacggtttacaagtcgggtactaggtggtaactcggtaggaactagtacttcacgtctacacgtactcgagtctagtacacgtacgtacctaggtaacgttagtttacgaactttaaacttactaacgtacgttaacgaacgtaagttaacgtttacgaacggttttacgttacggttttactttaccgttacccggtttccggacccggttaacgggaacctaaagggtacgtaactacgtaaacgtaaacgtacggtgtacgtcacgtccaccgttacg

SEQ ID NO: 48999 - DNA, 687 bp, Homo sapiens
  misc_feature: GYAE6OF01BNUXB.3.50.E06.1.454.CMB.1.raw
  modified_base (230)..(230): a, c, t, g, unknown or other
  misc_feature (230)..(230): n is a, c, g, or t
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatcgacccagtctccatccctccctgtctgcatcgtggtaggggacagagtcaccatcacgttcgccggganaagtcagagttatagacgtaggttaatttaagttggtatacaagaacaaaaacgagggaaacctaccccttaatttgactctatcgtctgactactaccgtagtttacgaacgtaaacgggtcgggtacccaagttaccgtaacggttacaaggtcggtagtagggtagtacgtccggtaggaactaggttacctttacaccgttctaccgtaacctacgtaccacgtctaacgtaccgtaacgtacgtaccgtaaggtaacgtttacgtttacgaaccttaacctttacgtacgttacgtaaccaaagttacggttaacgttaccgttacggtttacgtttacgttactttaccgtaccggtttcccggaccgttaacggtaaccgtaacggtcggtaactacgtaaccgtaaaccgtacgtacgtccggtacccacctaacgtccttcgttaccg

SEQ ID NO: 49000 - DNA, 611 bp, Homo sapiens
  misc_feature: GYAE6OF01AUL3Q.3.50.E06.1.454.CMB.1.raw
  modified_base (431)..(431): a, c, t, g, unknown or other
  misc_feature (431)..(431): n is a, c, g, or t
  modified_base (442)..(442): a, c, t, g, unknown or other
  misc_feature (442)..(442): n is a, c, g, or t
  modified_base (606)..(606): a, c, t, g, unknown or other
  misc_feature (606)..(606): n is a, c, g, or t
tcagagacgcactccacgaccggtgctcgatttagatctactgacaacacacaagggggagtcagtctcagtcaggacacagcatggacatgagggtccccgctcagctccgtggggctcctgctactctggctccgaggtgccagatgtgacatccagatcgacccagtcctccatcctccctgtctgcatctggtaggggacagagtcaccatcctacttcggccgggacaagtcaagtagtattaggctaaggtttaatttaaagttggtatacgaagaaccaaaaaccgagggaaacctaccccttaaattttgactctatcgctgactactctaggttacgacgtaacggttcggtacccagtacgaagttcaagtggataggtgagtcggaggtactattacttcacgtcctacactatacgacngtactactacncgtactagtagttacttacgacttaacttacgtactacgtaactaacgtaaggttacgttacgtaagtttcgttacgtttaacttccgttaccgttcgtaccgtacggaaactaacggtacgaactacgttaaacaagttacttggtacactagccctaacgtnttccg

SEQ ID NO: 49001 - DNA, 745 bp, Homo sapiens
  misc_feature: GYAE6OF01C2YOM.3.50.E06.1.454.CMB.1.raw
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtcctccatccctcctgtctgcatctggtagggacagagtcaccatcacgttggaccgggcaagtcagagttagttagacgtaaggttaatttaaagttggtaatacgaagaacctaaaaaaccggaggggtaaacctacccctttaaaagttttcgaacttcttagtcgtactacgtacctaacttaccgtaagtttacgacgtaaaacgggttcggggtaccctaacgtacgtaaacggtttaccgaaagttcggacgtaaggtaggaacgttacggtaggggtaactaaggttaactttccgacctttaccgacccgtaacacgttacgacgtacgtacgtactaaccgacgtaccgttaagtaacgttagtttacctaacttaaaccttttactaacttacgttaactaacgtaacgttaaacgtttaacgttacggttaacgttttacggtttaacctttacgtaacccgggtttccccggtacccggtaacgggtaaaccgtaaaggttcggaacttaacgtaaccgtaaaacgtcgttcggtacggtactcggtacccacgttccgttaccg

SEQ ID NO: 49002 - DNA, 735 bp, Homo sapiens
  misc_feature: GYAE6OF01EWT58.3.50.E06.1.454.CMB.1.raw
tcagagacgcactccacgaccggtgctcgatttagatctactgacaacacacaagggggagtcagtctcagtcaggacacagcatggacatggagggtccccgctcagctccgtggggctcctgctactctggctccgaggtgccagatgtgacatccagatcgaccgagtcctccactccctccgtgtctgctatcgtaggtacggggacaaggactaccacctaacttccgtaccgttcgggaccccgggagtaacggttccgaaggtaacgttagttaacggtacgttaaagggtttaacttttaaaaggtcggttaactacgaaacgaaaccgtaaaaaccgggacggtaaaacccgttaccctttaaacgtttgaacgttactacgtcgtacgtacgactacgttacgtaggttagaacggtaacggttcggtaccctaggttacgaaggttacgagttcggacgttaggtcggtaaccgttggtaacgggtaactacggttacctttaccgaccgtaccttacgaacgttctacgactacggtactacgaactacgtaccgttaaggtacttacgttactaaccttaacgttacttaccgtagttaaccgtaagtaacgtacgttaaccgttgttaactttgttaccttagtcccggttacgcccgttaagacgttaggactaagaccaacgtacgtacggtacgtacgtgtaccacgtagtcgttacg

SEQ ID NO: 49003 - DNA, 569 bp, Homo sapiens
  misc_feature: GYAE6OF01A2WCH.3.50.E06.1.454.CMB.1.raw
  modified_base (200)..(200): a, c, t, g, unknown or other
  misc_feature (200)..(200): n is a, c, g, or t
tcagagacgcactccacgaccggtgctcgatttagatctactgacaacacacaagggggagtcagtctcagtcaggacacagcatggacatgaggtccccgctcagctcctggggctcctgctactctggctccgaggtgccagatgtgacatccagatgacccagtctccatcctccctgtctgcatctgtaggggacngagtcaccatcacttgccgggcaagtcagagtattagcaggttatttaaatggtatcagacaaaaccaggaaacaccccttaaatttgatctatgatgcatcctagtttagactaaaggtcgggtacccagtactaagttcaagtggactaggtggatcgtaggactagtattcactctacacatcgacgctactctaacacgcctagtaagtactttcgtactaccttaactactcgtaacaacgtagtacgttaacgtagttacgtttagttaacttcgtaccgtttccggaccgtacgggaacctaagggtacgtactaacgtaccgaaacgtacgtcggtacggaccttacgcgtacctcttacg

SEQ ID NO: 49004 - DNA, 730 bp, Homo sapiens
  misc_feature: GYAE6OF01CF1B2.3.50.E06.1.454.CMB.1.raw
  modified_base (324)..(324): a, c, t, g, unknown or other
  misc_feature (324)..(324): n is a, c, g, or t
tcagagacgcactccacgaccggtgctcgatttagatctactgacaacacacaaggggggagtcagtctcagtcaggacacagcatggacatgagggtccccgctcagctcctggggctcctgctactctggctcgagatgccagatgtgacacccagatcgacccagtctccactccctccctgtctgctactcgtggtgggacgacaggtacgtctatctacttcttcgttcggaccgggtactaagtcgtaggtagttagtttaagtttaattttaatttaaagttggtatacgtaacgttacaaaccgtacgggaaaccncccgttaacgcttaccgtgtacttctagtgtcctgactacgtaccttaagttaacgaacggtcggggttacctagtacgtaaggtcgaggtgacgtaggtcggtactcggacggtaactagtacttcaccttctacctactataccgtaagttaccgtaactaaccgtaacgtagttaagttctttaaccgaacctttaaacgttcctaacgttacgtaaccgtaaacgttaacggttaaccgttacccgtaccccgtttaccccgtaccggtacccgtttaccgttaccgggttccgggaacggggtaaccgggtaacggtacggggtaacggtaaggttaaccgtaaccggtaacgtaaccggtggttaaacccgggataccgtacccgtacgttacttcccgg

SEQ ID NO: 49005 - DNA, 630 bp, Homo sapiens
  misc_feature: GYAE6OF01EIT50.3.50.E06.1.454.CMB.1.raw
  modified_base (224)..(224): a, c, t, g, unknown or other
  misc_feature (224)..(224): n is a, c, g, or t
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctccctgtctgcatctggtaggggacagagtcaccatcacttgccgggnaagtcagagtattagcaggttatttaaattggtatcaagacaaaaaccgaggaaacgtaccccttaaattttgattctatgtctgctatcctagtttgacgtaaaggttcgggtacccaattacgaaggttacaagtggactaggtggtatcgtagggactagtactttcactctacaacctatcgagtcacgttactaacgagtcctaggtaacgttatttacgaacttaaaccgtttactaacgttagaactaaacgtagtaacgtttaaccgtagtttaacgtttaggttaccttttaccgtacgttttcccggaccgttagggaaaccctaaagggtcgtaaactaacttacgaaaaccgtagtacgggttacggaccctaggaccctaccgtagtttcccg

SEQ ID NO: 49006 - DNA, 594 bp, Homo sapiens
  misc_feature: GYAE6OF01ELM5P.3.50.E06.1.454.CMB.1.raw
  modified_base (231)..(231): a, c, t, g, unknown or other
  misc_feature (231)..(231): n is a, c, g, or t
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatcgacccagtcctccatccctccctgtctgcatcgtggtagggacagacgtcaccatcacgttcggccgganaaggtcagagtatagcaggttaatttaattgtatcagacaaaacgaggaaacgtaccccttaaatttgatcttatgtctgctatcctagtttgacgtaaggtcgggtaccagtacgtaaggtttacaagtggtactaggtggtatcggtacgggatacgtacttttacaccttccgtacctacctactaccgactacgtactctaacgtacgtccgttaagaactttatttacgtaacctaacgtttactaacgtcgtaactaacgagttaacgttacgtaacgttagtttgttactttactacgtttccgacgtcggaactaggtcgaatacgtacgaactagtgtcgtcgatcactgttcg

SEQ ID NO: 49007 - DNA, 625 bp, Homo sapiens
  misc_feature: GYAE6OF01A7YHY.3.50.E06.1.454.CMB.1.raw
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctccctgtctgcatctggtaggggacagagtcaccatcacttggccgggcaagtcagagtattagctaaggttaatttaaagttggtatcaagaacaaaaccgaggaaactaccccttaaatttgatctatgctgctactcctagtttgacgtaaaggtcgggtacccagtacgtaaggttacaagtcggacgtaggtaggtagttcgtagggactagtactttcactctaccactatcagctagtctaacagtacctagtaagttatttacgaaccgttaactttacctacgtacgtaaccaaacgtacgttaacgttaacgtagtttactttacggttaactttaccgttaccgtttaccggtacccgttacgggaaccttaaaggtcggtaacctacgtaaccgaaacgtacgtcggttacggtactacgacctacgtacgttaccg

SEQ ID NO: 49008 - DNA, 1042 bp, Homo sapiens
  misc_feature: GYAE6OF01E0P67.3.50.E06.1.454.CMB.1.raw
  modified_base (240)..(240): a, c, t, g, unknown or other
  misc_feature (240)..(240): n is a, c, g, or t
  modified_base (1029)..(1029): a, c, t, g, unknown or other
  misc_feature (1029)..(1029): n is a, c, g, or t
tcagagacgcactccacgaccggtgctcgatttagatctactgacaacacacaagggggagtcagtctcagtcaggacacagcatggacatgagggtccccgctcagctccgtggggctcctgctactctggctccgaggtgccagatggtgacatccagatcgacccagtcctccacttccctccctgtctgcatcgtggtaggggacaggacgtaccaccatccacgttcggccgganaaggtcagtagttatagacgtaaggttaatttaaagttggtactacgaacggtaaaccgaaaaaaccggtacggggaaaaccgttacccctttaaaagttttcgaacttacgttaacgtcgtacgtacggtacctaaccgttaccggtaaggttttacggaaaccggttaaacggggttcccgggggttaacccctaaggtttaaccgttaaacggggtttaccaaagggttaccgggtacggtaacgggttaccggggtaacgtttaccgggtaaaccggggtaacttaaccgggtttaaccgtttttacccgtaacccgtttaccgttaaccccgtaaacccgttaacgttaacccggtaaccgggttaaaccccgttaacgggtttaaaccccctaaacgggttaacccggttaaccccggtttaaggggttaaaccgtttttaaccgtttttaacccgggtaaaccccttttaaacccggtttaacccgtttaacccggttaacggttaaacccttaaaacccgggtttaacgggtttaaaaccggttttaacccgggttaaaccggtttttacgggttttttaaccgggtttttacccttttaacccgggttttaccccgggttacccgggggttaaccccggttaaaccggggtaaaacccggttaaacgggttacccgggtaaaaccttaaacggttaaaacccccggtaaaggggttaacccggtttacggggttacccggggtacccttaacccgggtaaccccgtttaaacccgggttntttaacccccggg

SEQ ID NO: 49009 - DNA, 899 bp, Homo sapiens
  misc_feature: GYAE6OF01DLWCD.3.50.E06.1.454.CMB.1.raw
tcagagacgcactccacgaccggtgctcgatttagatctactgacaacacacaagggggagtcagtctcagtcaggacacagcatggacatgacgggtccccgctcagcctccgtggggctcctgctactctggctccgaggtgccagatgtgacatccagatcgacccagtctccatcctccctgtctgcatctggtagggacagtacgtccaccatcacgttcggccggacaagtcagtagtagtacgacgtaggttatttaaagttggtatacgaagaaccaaaaaccgaacgggtaaaccgtacccttaaacgtttacgatacgtatcgactcgactactacgtagtttacgacgtaaggtcggggtaccctagttaccgtaaaggttacaagtcggtacgtaggtagggaacgttacggtagggtaaccgtaacggttaactttaccgtaaccgttacctaaccctaacctaacgttaccgaacggtacctaacggttaaccctaaccgtaacgttacccgtaaacggttaaacggtttacgtttttaaccggtaacccttttaaaccgtttttaaacccggttaaccttaaccgggttaaacccgtaaaaccgtttaacgggtttaaaccgttttaaaccccgggtttaaaggtttttaacccggtttttaacgggttttttaacccgttttacccggttttaaccccggttttacccccgggggttaaaccccggtttaaaccggggtaaaacccggtttaaaacggggttaaccggggtaaacccttaaaaccggttaaacccggtaaaaacccgggttaacggtttaacgggttacccgggttaacccgttaacccggtaccccgttaaacccgttccgttttaacccgg

SEQ ID NO: 49010 - DNA, 775 bp, Homo sapiens
  misc_feature: GYAE6OF01AG3BB.3.50.E06.1.454.CMB.1.raw
tcagagacgcactccacgaccggtgctcgatttagatctactgacaacacacaagggggagtcagtctcagtcaggacacagcatggacatgagggtccccgctcagctccgtggggctcctgctactctggcctccggaggtcgccagatgtagacatccgagatcgacccagtcctccactccctcctgtctgcatcgtaggtagggacagacgtccaccatacctacgttcggcccggataagtcaggtagttagtagacgtaaggtttaattaaagttggtatacgaagaaaccgaaaacgaagggaaacctacccctttaagtttacgacttgtaatcgcgtacgactactacgtagttacgacgtaacggtcggacctagtacgtaagtacgtaagtcggtacgtagtacgggtacgttaccggtacgggaattaacggttacctttccgtacccttacctacccgtaacctacgttacctaccgtaccgttaacgttacccgtaacgaccgttaaccgtaaggttaaactttaacgtttaccgtaaacgttaaccgtttaattacgttacgttaacgaaagttaaacgttaggtttaaaccttacggtttaacgttacggtttaacctttacccgttaaccccggtttcggtaacccggtaaaccgggaaaccgttaacggccggttaaaccctaaaccggttaacgaaaccggtacccgttaaggttccggtaaccgtccgaaccctttaacccgtcggtttacccg

SEQ ID NO: 49011 - DNA, 588 bp, Homo sapiens
  misc_feature: GYAE6OF02JC4YZ.3.50.E06.1.454.CMB.1.raw
  modified_base (409)..(409): a, c, t, g, unknown or other
  misc_feature (409)..(409): n is a, c, g, or t
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctcctgtctgcatctgtagggacagagtcaccatcacttgccgggcaagtcagagtattagcaggtatttaaatggtatcagacaaaaacgaggaaacacccttaaatttgatctatgctgcatcctagtttgacaaaggtcgggtaccatcaaggttcaagtggctagtggatcgtagggactagtactttcacttctcaactatcaagctagtctaacagtccgtagaattnttttacgaccttaaacgtttactacttcgtaacaaacgtaagtaacgtttaactaaggtttactttaggttaacttttaccgtaaccgttttccggacccttaggggtaaccctaaagggtcggaaactagtaaccgaaaacgtacgttggtacggaccttagaccctaccgttatccg

SEQ ID NO: 49012 - DNA, 605 bp, Homo sapiens
  misc_feature: GYAE6OF02J091C.3.50.E06.1.454.CMB.1.raw
  modified_base (276)..(276): a, c, t, g, unknown or other
  misc_feature (276)..(276): n is a, c, g, or t
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctccctgtctgcatctgtaggggacagagtcaccatcacttgccgggcaagtcagagtattagcaggtatttaaatggtatcagacaaaaacagggaaacncccctaaacttttgatctatgactgcatccagtttgactaaagtcggggtccatcaaggttcaagtggcagtggatcgtaggggacaggtattttccactctacaccctatcgacgacgtacgtactacgacgtaccgtagtaacgttatttcgaacttaacctttacgtaacgttcgtaacaaacgtaggttaacgttacgtaacgtttacgtttaggttaactttacgtaccgtttccggacccgttagggaacctaaggtacggtaactagtaacccgtaaacgtaccgttgggtacggtacctacgtaccgtacgttacttaccg

SEQ ID NO: 49013 - DNA, 524 bp, Homo sapiens
  misc_feature: GYAE6OF02GEYKF.3.50.E06.1.454.CMB.1.raw
  modified_base (265)..(265): a, c, t, g, unknown or other
  misc_feature (265)..(265): n is a, c, g, or t
  modified_base (271)..(271): a, c, t, g, unknown or other
  misc_feature (271)..(271): n is a, c, g, or t
  modified_base (339)..(339): a, c, t, g, unknown or other
  misc_feature (339)..(339): n is a, c, g, or t
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctccctgtctgcatctgtagggacagagtcaccatcacttgccgggcaagtcagagtattagcaggtatttaaatggtatcagcaaaacnggaaanccctaaatttgatctatgctgcatccagtttgacaaagtgggtccatcaaggttcaatggcagtgatntggacagattcactctcacatcagcagcctgcagcctgatgattttgactaactttattactgaccaaacgtagttaataactacccgtcgtacgtaacggttcgaccgaaggggaccctaaggggtcggaacgtactaacgaagttaacggaacttgggtacggtcctaggacccaccgtaacg

SEQ ID NO: 49014 - DNA, 501 bp, Homo sapiens
  misc_feature: GYAE6OF02GSQYV.3.50.E06.1.454.CMB.1.raw
  modified_base (387)..(387): a, c, t, g, unknown or other
  misc_feature (387)..(387): n is a, c, g, or t
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctccctgtctgcatctgtaggggacagagtcaccatcacttgccgggcaagtcagagtattagcaggtatttaaatggtatcagacaaaaaccagggaaagcccctaaatttgatctatgctgcatccagtttgactaaaggtggggtccatcaaggttcaatggcagtggatcgtagggacagtattcactctcaccatcagcagtctacngcctagaagttatttgactaacttactactgtacaactagtagttacagttacttgttatttcacttcgcctaggacaagtgacatacaacgtactgtcggctgacacctatcg

SEQ ID NO: 49015 - DNA, 557 bp, Homo sapiens
  misc_feature: GYAE6OF02HZ7W6.3.50.E06.1.454.CMB.1.raw
  modified_base (407)..(407): a, c, t, g, unknown or other
  misc_feature (407)..(407): n is a, c, g, or t
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatccctcctgtctgcatctgtaggggacagagtcaccatcacttgccgggcaagtcagagtattagcaggtattaaattggtatcagacaaaaaccagggaaaagcccctaaacttttgattctaatgctgcatcctagtttgactaaaggtcggggtacccattcgaaaggttcaaagtggacaggtggaatcgtagggacagtatttcgacttctcaccatcagcagtctacngcctagaagtattttgactaactttactactgtacaacagtaacgttacagttacttgttatttacgtaccgtttcggcccttagggaccctaaaggtggtaacctaagtaccaaaccgtactggtacggtcctacgactacctattccg

SEQ ID NO: 49016 - DNA, 554 bp, Homo sapiens
  misc_feature: GYAE6OF02IW5T2.3.50.E06.1.454.CMB.1.raw
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctcctgtctgcatctgtagggacagagtcaccatcacttgccggcaagtcagagtattagcaggtatttaaattggtatcagacaaaaccgaggaaacgaccctaaatttgatcgtatagctagcatccagttagactaaaggtcgggtccatacgtaagttacaatggcagtgatcgtagggactagtatttcacgtctacaccatcagcagtctactagcctagaagttattttgactaaacttactactatacaactagtattaactagttacgtttgttactttctaacgtttccggaccgttagggaaccctaaggtacggtaactaacgtacaaacgtaacgttaggtacgtactacgactaccgtattaccg

SEQ ID NO: 49017 - DNA, 627 bp, Homo sapiens
  misc_feature: GYAE6OF02FWAT1.3.50.E06.1.454.CMB.1.raw
  modified_base (271)..(271): a, c, t, g, unknown or other
  misc_feature (271)..(271): n is a, c, g, or t
  modified_base (621)..(621): a, c, t, g, unknown or other
  misc_feature (621)..(621): n is a, c, g, or t
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctccctgtctgcatctggtagggacagagtcaccatcacttgccgggcaagtcagagtattagcaggtatttaatgtatcagacaaaacaggaacncccttaaatttgattctatgctgctatcctagtttgactaaggtcgggtacccatacgtaaggttcaagtcggactaggtaggactcgtagggactaggtactttccaccttctaccaacctataccagactagtcctaacgaggtccctaggaaagttcttttcgaaccttaactttacctaacgttagtaccgtaaacgtaggttaaccgtttaacgtaaggtttaaccgtttaggtttaactttccgtaacggttttcccggaccgtttacggggaaccctaaagggttcgaacctaacgtaaccgaaaccgttaacgtggttaccggtacttacggaccttaccgnttaccg

SEQ ID NO: 49018 - DNA, 534 bp, Homo sapiens
  misc_feature: GYAE6OF02HB0Z3.3.50.E06.1.454.CMB.1.raw
  modified_base (272)..(272): a, c, t, g, unknown or other
  misc_feature (272)..(272): n is a, c, g, or t
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctcctgtctgcatctgtagggacagagtcaccatcacttgccgggcaagtcagagtattagcaggtatttaaatggtatcagacaaaaccaggaaanccctaaactttgatctatgctgcatccagtttgactaaaggtcggggtcccagtctaaaggttcaagtggcaggtggatcgtgggacagtatttcactctcaccatcagcagtcacacgcctgaagtattttgactaacttactactgtacaactagtagttacagttacttgttatttcgtaacgtttccggacccttgggaaccgtaagtcggaactaagtacaaacgtacgttggtaggtcctaggacctaccattccg

SEQ ID NO: 49019 - DNA, 627 bp, Homo sapiens
  misc_feature: GYAE6OF02JFI44.3.50.E06.1.454.CMB.1.raw
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctccctgtctgcatctggtagggacagagtcaccatcacttggccgggcaagtcagagtattagcaggttatttaattggtatcagacaaaaccgagggaactaccccttaaattttgatctagtgctgctatcctagtttagacgtaaggtcgggtacccagtacgtaaggttacaagtggacgtaggtggtatacggtagggacagtactttcactctaccacctatcgagactacgtactacgacgtcctagtaagttacgttttacgaccttaacttaccgttacgttcgtaactaaacgtagttacgtttaacgtacggtttacgttttacggtttaactttaccgttacgttttcccgggacccgttagggtaaccgtaaggttacggaacctaacgtaaccgaaacggtactcgggtacgtcctacggaccctacgttactaccg

SEQ ID NO: 49020 - DNA, 657 bp, Homo sapiens
  misc_feature: GYAE6OF02H9TR1.3.50.E06.1.454.CMB.1.raw
  modified_base (302)..(302): a, c, t, g, unknown or other
  misc_feature (302)..(302): n is a, c, g, or t
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctcctgtctgcatctgtaggggacagagtcaccatcacttggccgggcaagtcagagtattagcaggttatttaattggtatcagacaaaaaccagggaaactacccttaaattttgatctatgctncatcagtttgactaaggtcgggtccaagtcgtaaggttcaagtggacaggtgatcgtaggactaggtactttacacgttacctacacctattccaagtctaagttacctaacgtacggaccttaggtaaagttacgtttttacgaaccttaaacctttaactacgttcgttaacctaaactaaggtaacgtttaaccgtaaggtttaaccttttaagggtttacttttacccgtacggttttttacccgggaccccgtttagggggtaacccctaaagggttacggaaccttaaagtaccccgtaaaaacgtaccggttggtcggtacctaggtaaccctaacccgtatttcccg

SEQ ID NO: 49021 - DNA, 608 bp, Homo sapiens
  misc_feature: GYAE6OF02HM7SR.3.50.E06.1.454.CMB.1.raw
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctccctgtctgcatctgtaggggacagagtcaccatcacttggccggcaagtcagagtattagctaggttatttaaattggtatcagacaaaaaccgagggaaactacccttaaatttgatctatgctgcatcctagtttcgacgtaaaggttcggggtacccagttacgtaaggttcaaagtggactaggttggatcgtagggactagtactttcacttctacacctatcagctacgtactacagtacctagtaagttattttacgacttaaacttactactagtacaaactaagtacgtttaacgtagttacgtttaggttactttacgtaccgttttccggacccgttagggaacctaaagggtcggtaacctaacgtaaccgaaaccgtacgttacggtacggtaccgtacgtaccctaccgtattccg

SEQ ID NO: 49022 - DNA, 653 bp, Homo sapiens
  misc_feature: GYAE6OF02IDCQI.3.50.E06.1.454.CMB.1.raw
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctccctgtctgcatctggtagggacagagtcaccatcacttggccgggcaagtcagagtattagcaggttatttaaattggtatcagacaaaaccgagggaaacaccctaaacttttgattctatgctgcatcctagtttgacaaaggtcggggtacccagtactaaggttcaaatggacaggtggagtcgtagggactagtatttacacttcgtacaacctactacaagcctaagttcctaaccacgaccttagtaaagttaactttttacgacttaaaccgtttacttaacgtacgttactaaacgaagttacgtttaacgtaagtttaaccgtttaggtttaacttttaccgtaaccgttttccgggacccgttacggggtaacccgttaaaaggtcggtaacctaacgttaacccgtaaaaccgtaacgttacggttacggtaccgttacggaaccctacccgtaatttaccgg

SEQ ID NO: 49023 - DNA, 747 bp, Homo sapiens
  misc_feature: GYAE6OF02H72C3.3.50.E06.1.454.CMB.1.raw
tcagagacgcactccacgaccggtgctcgatttagatctactgacaacacacaagggggagtcagtctcagtcaggacacagcatggacatggaggggtccccgctcagctccgtggggctcctgctactctggctccgaggtgccagatgtgacatccagatgacccagtctccatccctcctgtctgcatcgtggtaggggacagagtccacatactacttcggccgggacaagtcaagagtattagactaggttaatttaagttgtatcgaagaacgaaaaaccgagggaaacctacccttaaacttttagacttactaatgtctacgactatacctagttagacgtaaggtcgggtaccagtacgtaaggttacaagtggacgtaaggtcggtaacgttcggtaacggtaacgtaacgttacgttttaccaaccgtttcccttaaccgaacccttaagtacccggtaacgtaccgttaaacgttaccgttaacgaaccgggtccgttaaaggttaaacggtttactttttacgaacgtttaaacctttacgtaacgtacgttaaccgtaaacgtaacggttactttaaaccgaaggttttacgttttacggttaacttttacccgtaccggttttacccgggcccggttaacgggtaaaccctaaagggtcgttaaacccgaagtaaccccgtaaaacggtacgttacgggacgtaccgttacgtaccctaccgtacttccgg

SEQ ID NO: 49024 - DNA, 757 bp, Homo sapiens
  misc_feature: GYAE6OF02JLQOK.3.50.E06.1.454.CMB.1.raw
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatccctcctgtctgcatctggtagggacagagtccaccatcacttggccggacaagtcagtagtattagactaggttaatttaaagttggtattacgaagacctaaaaacgagggtaaacgtaccccttaaaacgttttgattctaagtcgtctagcactccgtagtttacgacgtaaaggttcgggtacccctaagtacgtaaacgggttcaaagtcgggtacgtacgggttaggtaactccgggtaggtaaacccgtaggttaactttccgaacttccgtaccctaacgtactaccgaggtaccgtacgttaacctaccgtacgtaccgttaagtaaagtttcttttaaccggacttaaaccgtttaactccttaacgttaaccgaaacgttaacggttaacgtttaaaccgttagttttaaccgggttttaacgttttaaccgtttacccgtttaacgttttacccgggacccgtttaccggggtaaacgtaaaacgggttccggtaaaaccttaacggttaaccgtaaaccgtttacgtcgggttaccgtacgttaccgaacgtttacccagttttaccgg

SEQ ID NO: 49025 - DNA, 525 bp, Homo sapiens
  misc_feature: GYAE6OF02FROXI.3.50.E06.1.454.CMB.1.raw
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctccctgtctgcatctgtagggacagagtcacatcacttgccggcaagtcagagtattagcaggtatttaaatggtatcagacaaaaacaggaaagccctaaacttttgatctatgctgcatccagtttgactaaaggtcggggtccagtctaaaggttcaagtggctagtggtatcgtagggacagtatttcactctcacatcagctagtctacagtcctagaagttatttgactaaacttactactagttacaacgtagtagttacagttacttgtatttctacgtttcgcctaggacctaaggtcggactacgtaactaacgaacgtggtcgacgtcgcctacattc

SEQ ID NO: 49026 - DNA, 784 bp, Homo sapiens
  misc_feature: GYAE6OF02GU0O3.3.50.E06.1.454.CMB.1.raw
  modified_base (220)..(220): a, c, t, g, unknown or other
  misc_feature (220)..(220): n is a, c, g, or t
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctccctgtctgcatctgtagggacagagtcacatcacttgccggnaagtcagagtattagctaaggttatttaaagttggtaatcgaagtaaccaaaaaaccgaggggtaaaactacccccttaaaattttgaattctaagtcgctagcctataccgtagtttcgacgtaaaggtccgggtaccagttacgtaaggttcaaagtcggactaggtcggacttcggtagggaactaggttactttaccacgttcctacctaacctattaccgaacgtacctaaggttaccaacgtaccgtacccgttaaggtaaacgtttagttttaccggaacctttaaaccgtttaaccgtttaaccgttacggttaaccctaaacggttaacgggtttaaaccgtttaaccgtaaacgggtttttaaccgttttaacgggttttaaccctttttaccgttaaacccgggtttttccccgggaccccggttttaaggggaaaccccgttaaaaggggttcccggttaaaaccttaaaccggttaaaccgaaaaacccgggtttacgttacgggttaaccggtacccgttacggaccccgttaacctacggttttacccg

SEQ ID NO: 49027 - DNA, 618 bp, Homo sapiens
  misc_feature: GYAE6OF02IDPSL.3.50.E06.1.454.CMB.1.raw
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctcctgtctgcatctgtaggggacagagtcaccatcacttcgccggtcaagtcagagtattagcaggttattaaattggtatcagacaaaacgaggaaacgccctaaactttgatctatgctgcactcctagtttgactaaaggtcggggtacccatacgtaaggttacaaagtggactaggtaggacttcggtaggactagtatttaccactcctaccaacctatcgagtcagttaccacacgcctagacttgtactttgacttaacgtttactaactcgaacctaaacgtactaaagttaaccgtaccccggttagttaaccgggttaccggttacccgggaaccgtaaacgggtacccgaaaggggttaccggaagtaactaccgtaacgttaaccgacgttacgggtcggtaccgtacggtacctacccgtattacccg

SEQ ID NO: 49028 - DNA, 602 bp, Homo sapiens
  misc_feature: GYAE6OF02HSCBT.3.50.E06.1.454.CMB.1.raw
  modified_base (201)..(201): a, c, t, g, unknown or other
  misc_feature (201)..(201): n is a, c, g, or t
  modified_base (251)..(251): a, c, t, g, unknown or other
  misc_feature (251)..(251): n is a, c, g, or t
  modified_base (458)..(458): a, c, t, g, unknown or other
  misc_feature (458)..(458): n is a, c, g, or t
  modified_base (481)..(481): a, c, t, g, unknown or other
  misc_feature (481)..(481): n is a, c, g, or t
  modified_base (486)..(486): a, c, t, g, unknown or other
  misc_feature (486)..(486): n is a, c, g, or t
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctcctgtctgcatctgtagggacagngtcaccatcactgccggcaagtcagagtatagcaggtattaaatggtatnataacaaaaacagggaaacaccctaaacttttagatactaatcgtctagcaacttccgaagttttgaccgtaaaaggttcggggacccattacgaaaggttaccaagtggactaggtagaagttcgtagggactaggtattacgactctacaccatacagtaactcgtaacaactaggtaactagttttcactaacttactactganaacagtaacgttacacgtacccnccgtntacctacgtttccggacgggtaacgggacctaacggggtaggaacgtaacgttaaccaaaacggtaaccgttaggaccggtacgttacgaacccaaccgttacttcgttagttccc

SEQ ID NO: 49029 - DNA, 643 bp, Homo sapiens
  misc_feature: GYAE6OF02GEJNV.3.50.E06.1.454.CMB.1.raw
  modified_base (219)..(219): a, c, t, g, unknown or other
  misc_feature (219)..(219): n is a, c, g, or t
  modified_base (302)..(302): a, c, t, g, unknown or other
  misc_feature (302)..(302): n is a, c, g, or t
tcagagacgcactccacgaccggtgctcgatttagatctactgacaacacacaaggggagtcagtctcagtcaggacacagcatggacatgaggtccccgctcagctcctggggctcctgctactctggctccgaggtgccagatgtgacatccagatgacccagtctccatcctccctgtctgcatctgtagggacagagtcaccatcacttgccggnaagtcagagtatagcaggtatttaaatggtatcagcaaaaccgaggaaagccctaaatttgatctatgctgctatccagtttnacgaaagtcgggtcccatcgtaaggttcaagtggacagtggatcgtaggacagtactttcacttctccgaacctatcagactagtacctacgaacgccctaggaacgttgtttttacgacctaaacctttaacttacgttacgtaaccgtaaacgaaggttaacgttaaccgtaacgtttaccgtttacgggtttaaactttttccgtaaccgtttttaccgggtacccccgttaggggtaaacccgtaaacgggttcggaaaccgttacgtaaacccggtaaaacggtaaccgttcgggtacggtacccgtttacggaccctaacccggtactttcccgg

SEQ ID NO: 49030 - DNA, 567 bp, Homo sapiens
  misc_feature: GYAE6OF02FGUI8.3.50.E06.1.454.CMB.1.raw
  modified_base (207)..(207): a, c, t, g, unknown or other
  misc_feature (207)..(207): n is a, c, g, or t
  modified_base (276)..(276): a, c, t, g, unknown or other
  misc_feature (276)..(276): n is a, c, g, or t
tcagagacgcactccacgaccggtgctcgatttagatctactgacaacacacaaggggggagtcagtctcagtcaggacacagcatggacatgagggtcccccgctcagctcctggggctcctgctactctggctccgaggtgccagatgtgacatccagatgacccagtcctccatccctccctgtctgcatctggtagggacagntcaccatcacttgccgggcaagtcagagtatagcaggttatttaatggtatcagacaaaacgaggaacnccccttaaatttgatctatgctgcatcctagttgcgtaaaggtgggtaccctatacgtaagttcaagtggacagtggatcgtagggacagtatttcactctacacatcagctagtctacacgtcctagtaagtatttacgacttaacttactactacgtaacaactagtaacgtttacaaggtttaccgtttaggttactttacgtaccgtttccgggaccttacgggaacctaaagggtcgaactaactaccgaaacgtacgtggtacggtcttacgcctacctattccg

SEQ ID NO: 49031 - DNA, 737 bp, Homo sapiens
  misc_feature: GYAE6OF02FPQIY.3.50.E06.1.454.CMB.1.raw
  modified_base (725)..(725): a, c, t, g, unknown or other
  misc_feature (725)..(725): n is a, c, g, or t
tcagagacgcactccacgaccggtgctcgatttagatctactgacaacacacaagggggagtcagtctcagtcaggacacagcatggacatgagggtccccgctcagctccgtgggctcctgctactctggctccggaggtcgccagatgtgacactcagatcgacccagtcctccactccctccgtgtctgctattcgtagggtagggacaggtacgtccaacctatcctacgttcgggacccgggactaacggtacaaggtagttagttacggcgtaaggtttaacttttaaagttcgggttaataccgaaagaaacccgtaaaaaaccgggaacgggtaaaacccgtaacccccttttaaagttttacgaacttaccttaagtcgtacctacggtacctaccttcgttagtttacgacgtaaacggggttccgggtacctaagttacgtaacggttacaaggtcggacgtaggtacggtacgtacgggtacgggaactagtactttacacctcgtacctactactacgacgactaccgtccgtacgacgtacgtaccgtagtacgttcgttttaagtttccgactttaaaccttttacttcgtaactacctaaagtacgttaacttaaccgtccggtacgtacggtaccgtaccggaacggtacggtacgtaggggtacgacgtaacgtacgtaacgtaacggtacttggtacgtccggtanacccgtactacg

SEQ ID NO: 49032 - DNA, 758 bp, Homo sapiens
  misc_feature: GYAE6OF02IOZZX.3.50.E06.1.454.CMB.1.raw
tcagagacgcactccacgaccggtgctcgatttagatctactgacaacacacaagggggagtcagtctcagtcaggacacagcatggacatggacgggtccccgctcagcctccgtggggctcctgctactctggctccggaggtcgccagtatgtcgacatccagatcgacccagtcctaccactccctcctgtctgctatcgtaggtacgggacagtacgtaccacctatcgtacgttcggaccgggtactaaggtccgtaaggtagttaacgtacggtacgtaaagggtttaattttaaaacggttcggtaacttaccgtaaacggaaaccgtaaaaaaaccggtaacgggggtaaaaccccttaacccccgttttaaagttttaacgtaacgttacgtaacgttacgtcgtcgtactacgttaccgtagtttacggaacgtaaacgggttccggtacctagtacgtaacggtacagtcggtacgtagtacggtagtcggtaacggtactaacgttctaccgtacttccgtacactacgtacgtacgtactgtacgtaaccacgtaccgttaagtaagttcctttaacgacttaaccgttactagtactaacaacgtagttacgtaacgtacgttacgtttagtcctttaccgaccgtttaccggacgttaccgggtaacgtaacggtcgtaacctaacgttaaccggtaaccgttagtcggttaccgccgttacgaacccgttacctgttaacg

SEQ ID NO: 49033 - DNA, 549 bp, Homo sapiens
  misc_feature: GYAE6OF02FVTBY.3.50.E06.1.454.CMB.1.raw
  modified_base (271)..(271): a, c, t, g, unknown or other
  misc_feature (271)..(271): n is a, c, g, or t
  modified_base (279)..(279): a, c, t, g, unknown or other
  misc_feature (279)..(279): n is a, c, g, or t
  modified_base (381)..(381): a, c, t, g, unknown or other
  misc_feature (381)..(381): n is a, c, g, or t
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctccctgtctgcatctgtagggacagagtcaccatcacttgccgggcaaggtcagagtattagctaggtatttaaagtggtatcagacaaaaaccngggaaacncccttaaatttgatctatgctgactatcctagtttgactaaaggtcgggtacccatacgtaaggttcaagtggacagtggatcgtggactagtatttcatcncacatcagctatctacacgtcctagtaattctttgactaacttactactgtacaacgtagtagttactagttactttggttactttcgtactttccgaccttagggaacctaaggtcgactacgtaacgtaaacgtacttacggtcgtacctacgactacctattccg

SEQ ID NO: 49034 - DNA, 657 bp, Homo sapiens
  misc_feature: GYAE6OF02I4015.3.50.E06.1.454.CMB.1.raw
  modified_base (204)..(204): a, c, t, g, unknown or other
  misc_feature (204)..(204): n is a, c, g, or t
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatccctccctgtctgcatcgtgtagggacagngtcaccatcacgttcgccgggcaagtcagagtattagctaggtatttaagttggtatcagacaaaaccgaggaaacgtaccccttaaacgtttgattctatgctcgacactcctagtttgacgtaaaggtcggggtccaagtcgtaaaggttactaaagtggactaggtagatcgtagggactagtactttaccactcttaccactactacgagtcctaataccgtaacgtacgtaccgtaggaaacgttagttttacgaccttaaaccgttttacctaactttacggtaactaacgttaacggttaacgtttaaccgtaaggttttaccgttaggtttacgtttaccttaccgttttcggtaccccgttgggtaacttaacggtaacggtacggtacgtaaccgttaccggtaagtaacggttggtaccggtacgtacgactcccgttaacg

SEQ ID NO: 49035 - DNA, 692 bp, Homo sapiens
  misc_feature: GYAE6OF02IB1R1.3.50.E06.1.454.CMB.1.raw
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatccctcctgtctgcatcgtggtaggggacagacgtccaccatcacgttcggccggcaacgtcagagttatagactaggttaatttaaagtggtatcgaacgaacaaaaacgagggaaacctacccttaaactttgatctatcgtctcgactactctagttgacgtaaggtcgggtaccatacgtaagtacagtgacagtggacttcgaggaactgtacttcgacctctacactatacgacgactaacgtctaacgtacgtaccgttaagtaaagtttacgttttacaacctttaacgtttaacctacgtacgtaacgaaacgtaagttaacgtttaacgtaacggtttaaccgttttagtttaaccttttcccgtaaccggtttttacccggggaccccgtttaaccgggggtaaacctttaacggggtacgtaaacccgtacgttaaaccgtaaaaccggttaccggttggtaccggttaacccgtaccgtaaccgtacccgttacgtttaaccccgg

SEQ ID NO: 49036 - DNA, 680 bp, Homo sapiens
  misc_feature: GYAE6OF02H0S1A.3.50.E06.1.454.CMB.1.raw
  modified_base (240)..(240): a, c, t, g, unknown or other
  misc_feature (240)..(240): n is a, c, g, or t
  modified_base (449)..(449): a, c, t, g, unknown or other
  misc_feature (449)..(449): n is a, c, g, or t
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatcgaccagtctccatcctcctgtctgcatctgtagggacagagtcaccatcaccttggccgggacaagtcagagtattagngtaaggttaatttaaattggtatcaagacaaaaaccgagggaaacacccttaaacttttgacttctaatcgctgactatcctagtttacgacgtaaaggtcgggtaccacgttacgtaggttactaagtggacgtaggtaggtactcgtagggactagttactttaccaacgttcctactacctataccgacgtactaacgttctaacncggtacctaagtaacgtttacgtttacgaaccttaaactttactacgtacgtaacgtaaacgtagttaacgttaacgttacgttacgtttaccgtttactttaccgttaccgtttacccgggtaccgttacgggtaaaccgttaacggtacgtaaccgttaacgtaacccgttaaaacggtacgtttcgggtaccggtactaccggtaacctacccgttacgtttacccgg

SEQ ID NO: 49037 - DNA, 779 bp, Homo sapiens
  misc_feature: GYAE6OF02G3J5G.3.50.E06.1.454.CMB.1.raw
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatcgacccagtctccatcctccctgtctgcatcgtaggtagggacagagtcaccatcacttcggccggcaagtcagatagtacgcgtaaggttatttaaagttggtatacagaaccaaaacgagggaaactcccttaaattgatctatcgctagctactccgtagttgacgtaacggtcgggtaccagtacgtaaggttacaaggttcggatacggtaggtacgttaggtacggggtactaaggtttacctttacctaccgttaccgtacctaacccgtagttaccaaccggtaccgttaaccgttacctaacggtacccgttaacccggtaaggttaacgtttaccggttttaacgaacccgtttaaaccgtttaacgttaaccgtacgttaaccgaaacgttaaccgttaaacggtttaaccgttaacgggttttaaccgttttacgggtttaaccgtttttaaccggtaaccccgttttccggggtaacccccggttaggggtaaaccccgttaaagggttccggtaaacctaaccggttaaaccgggtaaaaccgttaccggtttacggttaaccggttcccgttaaccggtaccccgttaagttccctttaaccgg

SEQ ID NO: 49038 - DNA, 800 bp, Homo sapiens
  misc_feature: GYAE6OF02J28ND.3.50.E06.1.454.CMB.1.raw
  modified_base (501)..(501): a, c, t, g, unknown or other
  misc_feature (501)..(501): n is a, c, g, or t
  modified_base (511)..(511): a, c, t, g, unknown or other
  misc_feature (511)..(511): n is a, c, g, or t
  modified_base (649)..(649): a, c, t, g, unknown or other
  misc_feature (649)..(649): n is a, c, g, or t
tcagagacgcactccacgaccggtgctcgatttagatctactgacaacacacaagggggagtcagtctcagtcaggacacagcatggacatgacgggtccccgctcagctccgtggggcctcctgctacctcgtggcctccggaggtcgccagatgtgacatccagactcgacccagtcctccactccctccctgtctcgctacgttccgtgggtaacggggacacggacctccaaccccagttccgtaccggttccgggaccggacgtaacggtaccgtaaggtaagttacggttaacgacgttaaaggtttaattttaaggttacggtacaaccgaaacgaaaaccggaaaaaaacccgggtaacgggtaaacccctttaacccccgttttaaaagtttacgacttaccgttaagtccgtacgtaccgtacgttaacccgttaccggttagttacggaaccggtacggggtacccgtactaacgttacggtactaacgnggtccggtanacgggttgacgttggaaccggtcttaacgttctaccctacgtccctaaccgtcgaccggttacacgaccgttacggacacccggtaagtacgtaacggttaattccgtttacccaaacgttaccttaacgtccgttanaaacctaacggtagtaaactttacgttagtttaaccgttgttaccttcccggttactaccggtaccgtaggtaacccgtaagtacgtaccggtaactaaccgtaagttacccgggtatcccgggtacaacccggttctaaccgttccgttg

SEQ ID NO: 49039 - DNA, 670 bp, Homo sapiens
  misc_feature: GYAE6OF02FW4K5.3.50.E06.1.454.CMB.1.raw
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctcctgtctgcatctgtagggacagagtcaccatcacttgccgggacaagtcagagttatagctaaggtatttaaagttgtatacagacaaaaacgagggaactacccttaaatttgattactatgctgctatctagtttacgacgtaaaggtcgggtacctaagttccgtaaaggttctaagtcggcgtaaggtggtaactacgtggggaactaaggttactttccaacttcgtaccctaaccgtataccaacggtacctacgttacctaacgtaccgtacccgtaggttaaaggttacttttacgaaccttaaacccgttttaacctacgttaccgttaacgtaaaccgtaagttacggttaacttaaggttaccttttaggttaacctttacgttacccgtttcggtaccgttacggaacgtaacggtcggaactaacggtaacctaaaacgtcgtacggtaccggtacgtacggtaccctacgtagttccg

SEQ ID NO: 49040 - DNA, 714 bp, Homo sapiens
  misc_feature: GYAE6OF02JDI4X.3.50.E06.1.454.CMB.1.raw
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatcgaccagtctccatcctcctgtctgcatcgtggtagggacagagtccactactcacgttcggccgggactaagtcgaagtacgtattagacgtaggttaatttaagttcggtactacgaagtaaccaaaaaccgagaacgaaaccgtaccccgttaaaagttttgaacttcgttatcgtctagactactacgtagttagacgtaacggtcggtacctattaacgtaagttacgtaagtcggacgtaggtacgtacgtcgtagggactaacgttactttacctaccttactacctaaccgtagttaccgaacgtacctaaggttcctaacgtaccgtacgttaaggttaacttacgttttaacaaccgtttaactttacctacttaacgtacctaaacgtacgttaaacgttaacgttacgttttacgtttaggttacttttacccgttaaccgtttccgtacccggttaacggtaaccggttaacgtaacggttaaccttaacgtaaaccgtaacgggtaacttcgggaccttcggacgtaccgtaaccttacg

SEQ ID NO: 49041 - DNA, 802 bp, Homo sapiens
  misc_feature: GYAE6OF02G6BBM.3.50.E06.1.454.CMB.1.raw
  modified_base (233)..(233): a, c, t, g, unknown or other
  misc_feature (233)..(233): n is a, c, g, or t
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatcgacccagtcctccatccctcctgtctgcatcgtggtagggacagacgtccaccatcacgttcggcccggganaagtcagagttagtacgacgtaaggttaatttaaagttcggtatacgaagtaaaccgaaaaaccggaagggtaaaacccgttacccctttaaaagttttcggaactttaccgttaacgtcggtacttacgacctacgtttacccgttaaggtttacggaaaccgttaaacggggttccgggtaaccccctaagttaaaccggttaaacggttacgtaaacggttcgggaaccgttaagggtacggtaaacgttcgggtaacgggtaaaccgttacggtttaaactttcccgtaacctttaccgtacccaaacccgttaactccggtaacctaccgttaacggtaaccttaaccggaaccgtaccgttaacggttaatttaccggtttacaaaccctttaacgttaacctttacgtaacgtaaccaaacggttagttacgttaaccgtagttttaacgttacgtttatttacccgttaaccggttcccgtaccgttacggaattaaccggtagtaacctagttaacccgaatcccggttagtccggttacacggtactacgtacgttacg

SEQ ID NO: 49042 - DNA, 753 bp, Homo sapiens
  misc_feature: GYAE6OF02J24O0.3.50.E06.1.454.CMB.1.raw
  modified_base (356)..(356): a, c, t, g, unknown or other
  misc_feature (356)..(356): n is a, c, g, or t
tcagagacgcactccacgaccggtgctcgatttagatctactgacaacacacaagggggagtcagtctcagtcaggacacagcatggacatgacgggtccccgctcagctcctggggctcctgctactctggctccgaggtgccagatgtgacatccagatcggacccagtcctaccatccctcccgtgtctcgctatcgtagggtacgggacagacgtccgacctatccgacgttcggccgggacgaacgtcgaacgtagtattacgacgtaggttatttaagtggtactacgaacgaaccgtaaaaccgacgggtaaaccttaccccgttaaaagttttcgacttacgttacgnggtaccgtacgtaccgtacgttacccgtaaggtttaccgaaccggttaaccgggttccgggtaaccctaagtaccggtaagggttacctaacggtacggtaccgtaacgggttacggtaaccgttacggttaacggggaacctttacgttaccgttaccgtaccttaccggtaccacccgtagtacgactacgtaacgttacctacgaacggttccaaaggtttactacgtttaccgaactttaccaccttagtactaactagacgtaacgtttacgtaggttactttaacgtcctttaaccgtcgttacccgccggttacgacgttaacgtaccggacttaacgaaccggtaacgtacgttacggtcgtaacctgtaacccgtactcggtttaacg

SEQ ID NO: 49043 - DNA, 734 bp, Homo sapiens
  misc_feature: GYAE6OF02F0SZ7.3.50.E06.1.454.CMB.1.raw
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatcgacccagtcctccatccctccctgtctgcatcgtggtaggggacagacgtccacctatccacgttcggccgggacaacggtcaggtagttattagacgtaaggttaatttaaagttggtatacgaagaaccaaaaaccgagggtaaacctacccctttaaagtttagattactagtcgctgactactaccgtagtttgacgtaacgggttccgggtacctagtacgtaaggtactaagtcggacgtaggtgtagtacggtaggaactagtacttacaccttctaccactactacagtctacgtccaacgtcgtaccgtaagtaaacgtttacgtttacgtaaccttaaccgtttaacctacgttacgtaacccgtaaagtacgttaacgtttaccgtaacgttttaccgtttacggtttaacctttaccgtttaaccgggttttacccgaaccgggtttaccgggaaaaccgttaagggttaccggaaaccttaaacggtaaacccgtaaaaccggttacgttacgggttaacggtaccgttaaccgtacccgttaaaccgtctttaacccgg

SEQ ID NO: 49044 - DNA, 592 bp, Homo sapiens
  misc_feature: GYAE6OF02FI5FV.3.50.E06.1.454.CMB.1.raw
  modified_base (203)..(203): a, c, t, g, unknown or other
  misc_feature (203)..(203): n is a, c, g, or t
  modified_base (209)..(209): a, c, t, g, unknown or other
  misc_feature (209)..(209): n is a, c, g, or t
  modified_base (282)..(282): a, c, t, g, unknown or other
  misc_feature (282)..(282): n is a, c, g, or t
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatcgacccagtctccatcctccctgtctgcatctgtagggacagngtcacntcacttcgccggcaagtcagacgttatacgctaggttatttaaagttggtatcaagaacaaaacgaggaaacnccccttaaatttcgatctatgctgcactctagtttgacgtaaggtcgggtacctaatcgaagttcaagtcgacgtagtagatcgaggtacagttacttcactctaccactactcgactcacgtactacgtacgtccgtagtaagttgtttacgtacttaaccttaactacgttacggtactaacgagttttttttaacgacgttaagttacgtttacgttactttaccttacgttaccgtccgtacggtaactaacggttacgactaacggtaacaacgtacgtagtacggtctacgacctactacttcg

SEQ ID NO: 49045 - DNA, 666 bp, Homo sapiens
  misc_feature: GYAE6OF02F3SU9.3.50.E06.1.454.CMB.1.raw
  modified_base (232)..(232): a, c, t, g, unknown or other
  misc_feature (232)..(232): n is a, c, g, or t
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatccctccctgtctgcatcgtggtacggggacaggacgtcaccatcacgttcggccgggnaacgtcgagagtattagctaggttaatttaaagttggtatacaagaacaaaaaccggagggaaaccgtacccttaaatttgacttacgtatgctagactactccgtagtttgacgtaaggtcgggtaccagtacgtaaggtactaaggtcggacgtagggtaggtacgtacgggtagggtaactacggttactttaccgacctaccgtaccgtaaccgtagtaccgacgtacctacgtacctacgacgtacgtagtaagtttactaccgtaacttaccgtactacgtacgtaactaacgtaacgttacttaaggttacgttcggtttaacgttacttaccgttaccgtcccgtaccggtacgtaacgtaacggtacgtaacgtaacgaaccgtaagtaaccgtggtactacgtactaacgttacgtcttaccgg

SEQ ID NO: 49046 - DNA, 654 bp, Homo sapiens
  misc_feature: GYAE6OF02FPZO5.3.50.E06.1.454.CMB.1.raw
  modified_base (229)..(229): a, c, t, g, unknown or other
  misc_feature (229)..(229): n is a, c, g, or t
  modified_base (260)..(260): a, c, t, g, unknown or other
  misc_feature (260)..(260): n is a, c, g, or t
  modified_base (278)..(278): a, c, t, g, unknown or other
  misc_feature (278)..(278): n is a, c, g, or t
  modified_base (648)..(648): a, c, t, g, unknown or other
  misc_feature (648)..(648): n is a, c, g, or t
tcagagacgcactccacgaccggtgctcgatttagatctactgacaacacacaaggggggagtcagtctcagtcaggacacagcatggacatgagggtccccgctcagctcctggggctcctgctactctggctccgaggtgccagatgtgacatccagatgacccagtctccatccctccctgtctgcatcgtgtaggggacagagtcacctatcacgttgccggganaagtcagatatagcagttaatttaatgtatnagacaaaacgaggaaacncccttaaattttgatctaatgactgtcactccgtagttttgacgtaaaggttcgggtacccattacgaaaggttcaaagtcggactaggtaggtatcgtaggggaactaggttacttttacgaccttacgtacctaacctataccgtacgacctaacgttaccctaaacgacgtaccctaggtaaacggttacgttttttaggaaccctttaaaccgtttaacttaccgttagtaacctaaacgtaagtacgtttaacgtaacgtttacgtttacgttaactttacggttaacgttcccggtaccgtaggaacctaagtcggaaactacgtaaacgtaacgtacgtcggttacggacctacgactacctnttaccg

SEQ ID NO: 49047 - DNA, 761 bp, Homo sapiens
  misc_feature: GYAE6OF02HD5BD.3.50.E06.1.454.CMB.1.raw
tcagagacgcactccacgaccggtgctcgatttagatctactgacaacacacaagggggagtcagtctcagtcaggacacagcatggacatgagggtccccgctcagctccgtggggctcctgctactctggctccgaggtgccagatgtgacatccagatcgaccctagtcctccatccctcccgtgtctgactatcgtaggtagggactagcgtccaacactcgtacttcggaccggacaagtcagtagtattacgtacgtggtcgtcgtaggtatcgagacagaacgaccgaagggtaaaccgtcccccttaaccgtccgtagtacttaccgttatacggtacgttccgtacccttaccgttaacgggttttcggaaccggtacggggttcccggggtaccctaagtaaccggttaaaggttccgacggtacggacgtagggtacggtacttcgggagggtaaccgtaagttaacgttacctacccggttacccacgtaacctacgtaccgacgtaccgtaccgtaccgtcgacgtaccgtccggtagtacgttacgttaacgttcgtaaaccttaactttacgtaaccgttccaaaccgttaaacgttaacgttaaaccgtaacccggttcccgtaacgggtttacgtaacccggttaccggaaccggttaaaccgggtaaccggtaggttaaccgaacgttaccgtaacgttaccggtaaccggttaacgttacggtaccggtcgtacgtaacccg

SEQ ID NO: 49048 - DNA, 723 bp, Homo sapiens
  misc_feature: GYAE6OF02GVPNL.3.50.E06.1.454.CMB.1.raw
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtcctcatcctccctgtctgcatctggtgggacagagtccaccatctacgttcggaccgggacaagtcgaagtagttattagacgtaaggttaactttaaagttggtactacaacgtaaccaaaaaccggagggaaaaccgtacccctttaaaagttttgaacttacgtatacgcgtacgacctagtaccttaggttcgaacgtaacggtccgggtaccagtacgaaggttacagtggagtaggtgtactcggtaggactagtactttcacgttaccaccgtaactacgtcgacgtcgtaacgtacctaacgtacggtacccgtaagttaacgtttacgttttaacgaacccttaagttaaccgttactacggtaaccttaaacgtacggtttaaacgttaacttaacggtttacgtttaccggtttaacttaccggtttaacccggtttcccgtacggttaccgggtaacgttaaccgggtacgtaaccgttaaccgttaaccgtaaacgttaccggttagggtacgttaccgaccgtacggtacctgttacccgg

SEQ ID NO: 49049 - DNA, 640 bp, Homo sapiens
  misc_feature: GYAE6OF02IT2G8.3.50.E06.1.454.CMB.1.raw
  modified_base (262)..(262): a, c, t, g, unknown or other
  misc_feature (262)..(262): n is a, c, g, or t
tcagagacgcactccacgaccggtgctcgatttagatctactgacaacacacaagggggagtcagtctcagtcaggacacagcatggacatgagggtcccgctcagctcctggggctcctgctactctggctccgaggtgccagatgtgacatccagatgacccagtctccactcctccctgtctgcatcgtgtaggggacagagtcacctatcacttgcccgggcaagtcagatattagctagttaatttaaagttgtatnaagacaaaacgagggaaacgccctaagctactgactctatgctgctactctaacgttaacgaaggtcgggtacctatacgtaaggttcgacgtggtacgagtgactacggtaggaacgtacgtactttcctacgttcccacgaacctatcgtagttaccgtactaaccgaactaacgtaattacgtttacgtaccgttaaccgttaacttaacgttcgtaaacaagtaagtaacgtttaacccgaacctttaccccgaccgttaccttaccgttacgtttacccgggacgggtaaccggaccggttaaggtacggtagtaacctaaaccaacggtaaccgttggacgtagtaccgacgtacccgttagtccgttaccg

SEQ ID NO: 49050 - DNA, 704 bp, Homo sapiens
  misc_feature: GYAE6OF02G1YRS.3.50.E06.1.454.CMB.1.raw
  modified_base (437)..(437): a, c, t, g, unknown or other
  misc_feature (437)..(437): n is a, c, g, or t
tcagagacgcactccacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtcctccatcctcctgtctgcatctggtaggggacagagtccaaccatctacgttggccgggacaaaggtcgaagtagtattaggacaggttaatttaaatggtatcagaacaaaaacgagggaactacccttaaatttgacttactatcgctagactacgtcctagtttcgaacgtaaaggtccggggtaccagtaacgtaaggttactaagtggacgtaggtggtaactcggtagggaactaggtactttaccacgttccactaacctntaccaacggcttaacgtacctaacgacgtaccgtaaggttaacttagttttacgaaaccctttaaccttacttaccgttagtaaccgtaaagttaacggttaaccttaacgttaacggtttaacgtttcgttttaacctttacctttaaccgggtttcccgggaaccggtttaacggggtaaacctaacggggttcgaaccttaaccggtaaacgaaacgttacggttacggtaccggtacgtacccgactaacccgtagtttaccg

SEQ ID NO: 49051 - DNA, 376 bp, Homo sapiens
  misc_feature: GYAE6OF01EEUUV.52.77.G11.1.454.CMB.1.raw
  modified_base (370)..(376): a, c, t, g, unknown or other
  misc_feature (370)..(376): n is a, c, g, or t
tcagcgcagtacgacacgaccggtgctcgatttagctagtcactcaagggaagggccgattcaccatttccagagacaactccaagaacacgctgtatttgcaaatgaacagcctgagagctgaggacacggctgtgtattactgtgcgaacttaatcacggaggacaacggtgaccccgtccgctcggtgcggacgtctggggccaagggaccacggtcagcgtctcctcagcctccaccaagggccactcggtcgttcccctcggcaccctcctccaacgagcacctctggggcgacagcggccctcggcgtgcctggtcaggactacttcctatacgatcgctgagcgggctggcaaggcgcatagnnnnnnn

SEQ ID NO: 49052 - DNA, 373 bp, Homo sapiens
  misc_feature: GYAE6OF01DB7CM.52.77.G11.1.454.CMB.1.raw
  modified_base (369)..(373): a, c, t, g, unknown or other
  misc_feature (369)..(373): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtccgctcggtgcggacgtctggggccaaggggaccacggtcagcgtctcctcagcctccaccaagggcccatcggtcttcccctggcaccctcctccaagagcacctctgggggcacagcggccctgggctgcctggtcaaggactacttcctatacgatcgctgagcggctggcaaggcgcatagnnnnn

SEQ ID NO: 49053 - DNA, 521 bp, Homo sapiens
  misc_feature: GYAE6OF01AVOIK.52.77.G11.1.454.CMB.1.raw
  modified_base (304)..(304): a, c, t, g, unknown or other
  misc_feature (304)..(304): n is a, c, g, or t
  modified_base (346)..(346): a, c, t, g, unknown or other
  misc_feature (346)..(346): n is a, c, g, or t
  modified_base (489)..(489): a, c, t, g, unknown or other
  misc_feature (489)..(489): n is a, c, g, or t
  modified_base (500)..(500): a, c, t, g, unknown or other
  misc_feature (500)..(500): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtggggggaggcgtggtccagcctgggaggtccctgagactctcctgtgcagcctctggattcaccttcagtgtctatgacatgcacgtgggtccnccaggcctccgaggcaaggggctgggagtgggtggcagttanatcatatgatggaagtagatatactatgacagactcgtagaagggccgattcactattccagacgacaactaccaagaacacgactgtatttgactaatgaactagcctagagagctgaggacacggctgtagtattctggtnacgtaacttanacgacggaggacgtaaccggg

SEQ ID NO: 49054 - DNA, 378 bp, Homo sapiens
  misc_feature: GYAE6OF01B9XJJ.52.77.G11.1.454.CMB.1.raw
  modified_base (371)..(378): a, c, t, g, unknown or other
  misc_feature (371)..(378): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtcgctcggtgcggacgtctggggccaagggaccacggtcagcgtcgtcctcagcctccaccaagggcccatccggtcttcccctggccaccctcctccaagagcacctctgggggcacagcggccctgggctgcctggtcaaggactacttcctcgtactgcgctgagcgggctggcaaggcgcatagnnnnnnnn

SEQ ID NO: 49055 - DNA, 518 bp, Homo sapiens
  misc_feature: GYAE6OF01AOKKP.52.77.G11.1.454.CMB.1.raw
  modified_base (263)..(263): a, c, t, g, unknown or other
  misc_feature (263)..(263): n is a, c, g, or t
  modified_base (276)..(276): a, c, t, g, unknown or other
  misc_feature (276)..(276): n is a, c, g, or t
  modified_base (303)..(303): a, c, t, g, unknown or other
  misc_feature (303)..(303): n is a, c, g, or t
  modified_base (493)..(493): a, c, t, g, unknown or other
  misc_feature (493)..(493): n is a, c, g, or t
tcagcgcagtacgacacgaccggtgctcgatttagctagtcactcaagggaaagggggagaggagcccagcactagaagtcggcggtgtttccattcggtgatcagcactgaacacagaggactcaccatggagtttgggctgagcgtggtttccgtcgttaggctctttaagaggtgtccagtgtcaggtgcagctggtggagtcgtgggggaggcgtggtccagccgtggggaggtccctgagactctcctgtgcagcctntggattcaccttnagtgtctatgacatgcacgtgggtccnccaggctccgaggcaaggggctgggagtgggtgtagttatatcatatgatggaaagtaagatatactatgcagactcgtgaaggcgattcactattccagagacaactccaagacacgctgtatttgacaaatgaacagcctagacgagctgaggacacggcgtagtcgtattactgtgacgtaacttanacgaaggaggaacgaacgggtcccg

SEQ ID NO: 49056 - DNA, 527 bp, Homo sapiens
  misc_feature: GYAE6OF01AUMQ5.52.77.G11.1.454.CMB.1.raw
  modified_base (305)..(305): a, c, t, g, unknown or other
  misc_feature (305)..(305): n is a, c, g, or t
  modified_base (467)..(467): a, c, t, g, unknown or other
  misc_feature (467)..(467): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggaggtccctgagactctcctgtgcagcctctggattcaccttcagtgtctatgacatgcacgtggggtcccnccaggcctccgagggcgaagggggctgggaggtggggtggcagttatatcatatgatggaagtaagatatactatgcagactcgtagaagggccgatcacctattccagagacaactaccaagaacacgctgtatttgacaaatagaacagacctagagagntgaggacacggcgtgtgtacttctgtgacgtaacttagtacgacggaggacgtaaccggg

SEQ ID NO: 49057 - DNA, 584 bp, Homo sapiens
  misc_feature: GYAE6OF01DNQLO.52.77.G11.1.454.CMB.1.raw
  modified_base (261)..(261): a, c, t, g, unknown or other
  misc_feature (261)..(261): n is a, c, g, or t
  modified_base (305)..(305): a, c, t, g, unknown or other
  misc_feature (305)..(305): n is a, c, g, or t
  modified_base (337)..(337): a, c, t, g, unknown or other
  misc_feature (337)..(337): n is a, c, g, or t
  modified_base (346)..(346): a, c, t, g, unknown or other
  misc_feature (346)..(346): n is a, c, g, or t
  modified_base (353)..(353): a, c, t, g, unknown or other
  misc_feature (353)..(353): n is a, c, g, or t
  modified_base (366)..(366): a, c, t, g, unknown or other
  misc_feature (366)..(366): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcgtggtttctcgttagctctttaagaggtgtccagtgtcaggtgcagctggtggagtcgtggggggaggcgtggtccagccgtgggaggtccctgagctctcctgtgcagcctntggattccaccttcagttgtctatgacatgcacgtggggtcccnccaggctccgaggcaaggggctgggagtgggngctagttanatcatangaatggaataagntatactatgactagactccgtaggacgggcgtattcactattccaagtacgacaactaccaagaacgacgtcttagtagtttagaactaaagtacgaaactagacctagagacgcgtagacggaccgacggtccgttaggtagttacgtttacgttaggtacgtaaccgtaaactttaacgtaccggtaaaccgggacggtaacccggtaaacccggg

SEQ ID NO: 49058 - DNA, 561 bp, Homo sapiens
  misc_feature: GYAE6OF01CMP0S.52.77.G11.1.454.CMB.1.raw
  modified_base (303)..(303): a, c, t, g, unknown or other
  misc_feature (303)..(303): n is a, c, g, or t
  modified_base (351)..(351): a, c, t, g, unknown or other
  misc_feature (351)..(351): n is a, c, g, or t
tcagcgcagtacgacacgaccggtgctcgatttagctagtcactcaagggaaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcctctggattcaccttcagtgtctatgacatgcacgtggggtcccnccaggcctcccgagggcaagggggctgggagtggggtggctaggttanagtcatatgaatggaaagtaagatatactatgacagactccgtagaagggcctattcacctatttccaagagacaactaccaaagaacacgctgtatttagacaaatagaacagcctagagacgctaggaacggaccgtacggcttggtagttacgttacgtgttagacgtaaactttaacgacgtaacgggaggaaccgtaaacccggg

SEQ ID NO: 49059 - DNA, 753 bp, Homo sapiens
  misc_feature: GYAE6OF01AS9WR.52.77.G11.1.454.CMB.1.raw
  modified_base (303)..(303): a, c, t, g, unknown or other
  misc_feature (303)..(303): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcctctggattcaccttcagtgtctatgacatgcacgtgggtcccnccgaggcctccggaggacggaacggggtcgtagggtagggttggggtcgacgttaagttactacgtacgtaagttagtagtaaggtaagggtaaagttaagtaacttaacgttaacgttagtcggtaacgtaacggtacccgttaccgggtaaggggtaacccgggtacccgttaacgttaaccccgtaaccctttaacgtttacccgaaaggtaaaccgtaaccctaaacccgtaaccgaaaccgaaccgtaccgttcgtttaagttaacgttacgaaactaaacgtacgaaaccgtacgtaccgtaggaacggtacgacggtaagggaaccggtaccgtaccgggttgttacggttagtttaacgttcggtaaggttacccggtaaaccgttaacgttaacggtaacccgggaaacggggtaaccgtaacccgggttaaacccccggg

SEQ ID NO: 49060 - DNA, 383 bp, Homo sapiens
  misc_feature: GYAE6OF01A1OV8.52.77.G11.1.454.CMB.1.raw
  modified_base (265)..(265): a, c, t, g, unknown or other
  misc_feature (265)..(265): n is a, c, g, or t
  modified_base (372)..(383): a, c, t, g, unknown or other
  misc_feature (372)..(383): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtcgctcggtgcggacgtctggggccaaggggaccacggtcagcgtctccgtcagcctccacaagggcccatcggtcttccccnggcaccctcctccaagacgcacctctgggggcacagcggccctgggctgccctggtcaaggactacgttccatacgatcgctgagcgggctggcaaggcgcatacgnnnnnnnnnnnn

SEQ ID NO: 49061 - DNA, 598 bp, Homo sapiens
  misc_feature: GYAE6OF01D4L1L.52.77.G11.1.454.CMB.1.raw
  modified_base (151)..(151): a, c, t, g, unknown or other
  misc_feature (151)..(151): n is a, c, g, or t
  modified_base (172)..(172): a, c, t, g, unknown or other
  misc_feature (172)..(172): n is a, c, g, or t
  modified_base (175)..(175): a, c, t, g, unknown or other
  misc_feature (175)..(175): n is a, c, g, or t
  modified_base (177)..(177): a, c, t, g, unknown or other
  misc_feature (177)..(177): n is a, c, g, or t
  modified_base (180)..(180): a, c, t, g, unknown or other
  misc_feature (180)..(180): n is a, c, g, or t
  modified_base (197)..(197): a, c, t, g, unknown or other
  misc_feature (197)..(197): n is a, c, g, or t
  modified_base (204)..(204): a, c, t, g, unknown or other
  misc_feature (204)..(204): n is a, c, g, or t
  modified_base (210)..(210): a, c, t, g, unknown or other
  misc_feature (210)..(210): n is a, c, g, or t
  modified_base (219)..(219): a, c, t, g, unknown or other
  misc_feature (219)..(219): n is a, c, g, or t
  modified_base (237)..(237): a, c, t, g, unknown or other
  misc_feature (237)..(237): n is a, c, g, or t
  modified_base (245)..(245): a, c, t, g, unknown or other
  misc_feature (245)..(245): n is a, c, g, or t
  modified_base (261)..(261): a, c, t, g, unknown or other
  misc_feature (261)..(261): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcggngttcggctaggcgcttatagncangnagncagctgcgatctgggancgtgcancgtggngcctgagcnctcctgtgcagctcctgntcactccngtgtctctgacatgcncgtcggtcgcgacgcgccgacgcgaacggggtgtggtaggtaggtacgtcgtacgtactactactagtagtagtagtaacgtaagtaagtaatactacgtacgtagtacgtacgtacgtacggtacggtacggtaccgtacgtacgtaccgtacgtacgtaacgaacgaacctaacctaaccgaaccgtaacgtaccgtacgttacgttacgttacgtaactaacgtacgtaaccgtacgtacgtacgtacgacgtacgacggacggacgtacggtacgtacgtagttacgttcgtacgtacgtacgtaacgtaacgtagacggacgacggtaccgg

SEQ ID NO: 49062 - DNA, 624 bp, Homo sapiens
  misc_feature: GYAE6OF01D5552.52.77.G11.1.454.CMB.1.raw
  modified_base (304)..(304): a, c, t, g, unknown or other
  misc_feature (304)..(304): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgacgactctcctgtgcagcctctggattcaccttcagtgtctatgacatgcacgtgggtccnccaggctccgaggcgaaggggctgggagtgggtgctagttatatcatatgatggaaagtaagatatactatgacagtaccgtcggtaggaacgggccgtaattacccaaccttactttaccgaagtaacgaacctaacctacccgaaagaaccacgtacttagttaactttacgaactaaaagtacgaaacgtacgtaccgttaggaacggtacgacgtaggaacgggaccgacgggtcgttaggttagttaagttaccgtggttacggaaccgttaaactttaacgaccggaacgggtaacggaaccgtaaacccgggg

SEQ ID NO: 49063 - DNA, 612 bp, Homo sapiens
  misc_feature: GYAE6OF01BL9L5.52.77.G11.1.454.CMB.1.raw
  modified_base (255)..(255): a, c, t, g, unknown or other
  misc_feature (255)..(255): n is a, c, g, or t
  modified_base (268)..(268): a, c, t, g, unknown or other
  misc_feature (268)..(268): n is a, c, g, or t
  modified_base (272)..(272): a, c, t, g, unknown or other
  misc_feature (272)..(272): n is a, c, g, or t
  modified_base (279)..(279): a, c, t, g, unknown or other
  misc_feature (279)..(279): n is a, c, g, or t
  modified_base (283)..(283): a, c, t, g, unknown or other
  misc_feature (283)..(283): n is a, c, g, or t
  modified_base (296)..(296): a, c, t, g, unknown or other
  misc_feature (296)..(296): n is a, c, g, or t
tcagcgcagtacgacacgaccggtgctcgatttagctagtcactcaagggaaaggggggagaggagcccagcactagaagtcggcggtgtttccattcggtgatcagcactgaacacagaggactcaccatggagtttgggctgagcggtggtttcgcgtaggcgtcttaagaggtgtccagtgtcaggtgcagctggtggagtcgtggggagcgtggtccagcctgggagtccctgagctctctgtgcagcctntggattcaccttnagtntactatnactntgctcgtcggccncgcggcctacgaggcggtacgggtgtgggtaggtgggtgcgtagttagtatatatagtagtagtaggtaagtaagtatatatatagacgacgtacgtacgtacggacggtacgtacgtactactacgttacgtaacgtacgaacgtaacctaacgaacgaacgtacgtacgtacgttattacgtaacgtaacgtacgtaacgtacgtacgtacgacgacgacgtacggacggacggtacggtacgtcggttagttacgttacgttacgtacgtacgtaacgttaacgtaacggtacggtacggtaaccggtaccgg

SEQ ID NO: 49064 - DNA, 509 bp, Homo sapiens
  misc_feature: GYAE6OF01BB3RW.52.77.G11.1.454.CMB.1.raw
  modified_base (361)..(361): a, c, t, g, unknown or other
  misc_feature (361)..(361): n is a, c, g, or t
tcagcgcagtacgacacgaccggtgctcgatttagctagtcactcaagggaaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtgtctatgacatgcactgggtccgccaggctccaggcaaggggctggagtgggtggcagttatatcatatgatggaaagtagatanactatgcagactccgtgaaggccgattcacctattccagagacaactccaaagaacacgctagtatttgacaaatgaacagcctgagagctgaggacacggctggtgttatctgtagacgtaacttaatcgacggagacgtaaccggg

SEQ ID NO: 49065 - DNA, 373 bp, Homo sapiens
  misc_feature: GYAE6OF01ARNUG.52.77.G11.1.454.CMB.1.raw
  modified_base (370)..(373): a, c, t, g, unknown or other
  misc_feature (370)..(373): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtccgctcggtgcggacgtctggggccaagggaccacggtcagcgtctcctcagcctccaccaagggcccatcggtcttccccctggccaccctcctccaagagcacctctgggggcacagcggccctgggctgcctggtcaaggactactactatacgatcgctgagcgggctggcaaggcgcatagnnnn

SEQ ID NO: 49066 - DNA, 583 bp, Homo sapiens
  misc_feature: GYAE6OF01DO47R.52.77.G11.1.454.CMB.1.raw
  modified_base (307)..(307): a, c, t, g, unknown or other
  misc_feature (307)..(307): n is a, c, g, or t
  modified_base (342)..(342): a, c, t, g, unknown or other
  misc_feature (342)..(342): n is a, c, g, or t
  modified_base (351)..(351): a, c, t, g, unknown or other
  misc_feature (351)..(351): n is a, c, g, or t
  modified_base (359)..(359): a, c, t, g, unknown or other
  misc_feature (359)..(359): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtggggggagcgtggtccagcctgggagtccctgagctctcctgtgcagcctctggacttccaccttcagttgtctatgacatgctacgtggggtcccncgaggcctccgaggcgaaggggctgggaggtgggngctagttanatcgatangataggaatagatatactatgacagtcctcgtagaacgggtccgtattcacctacttaccaagacgtacaactaccgaaagaaccacgtactagttatttacgactaaatagaacacgtacctggaacgagctaggacggaccacggtcgtaggttagttacgtttacgtagtacgaccgttaaacttaacgtaggaaccgggaagtaacccggtaaacccggg

SEQ ID NO: 49067 - DNA, 509 bp, Homo sapiens
  misc_feature: GYAE6OF01EXOJ0.52.77.G11.1.454.CMB.1.raw
  modified_base (397)..(397): a, c, t, g, unknown or other
  misc_feature (397)..(397): n is a, c, g, or t
  modified_base (485)..(485): a, c, t, g, unknown or other
  misc_feature (485)..(485): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtgtctatgacatgcactgggtccgccaggctccaggcaaggggctgggagtgggtgcagttatatcatatgatggaagtaagatatactatgcagactcgtagagggcatcacattcaganacactaccaagaacacgctagtattgacaaatgaacagcctgagagctagagacacggtcgtgtagtattactgtgactaacgttaanaccgaacgggtagacgtaaccggg

SEQ ID NO: 49068 - DNA, 716 bp, Homo sapiens
  misc_feature: GYAE6OF01DHZVG.52.77.G11.1.454.CMB.1.raw
  modified_base (174)..(174): a, c, t, g, unknown or other
  misc_feature (174)..(174): n is a, c, g, or t
  modified_base (251)..(251): a, c, t, g, unknown or other
  misc_feature (251)..(251): n is a, c, g, or t
  modified_base (262)..(262): a, c, t, g, unknown or other
  misc_feature (262)..(262): n is a, c, g, or t
  modified_base (275)..(275): a, c, t, g, unknown or other
  misc_feature (275)..(275): n is a, c, g, or t
  modified_base (360)..(360): a, c, t, g, unknown or other
  misc_feature (360)..(360): n is a, c, g, or t
tcagcgcagtacgacacgaccggtgctcgatttagctagtcactcaagggaaaggggggagaggagcccagcactagaagtcggcggtgtttccattcggtgatcagcactgaacacagaggactcaccatggagtttgggctgagctgggttttcctcgttgcttctttaagnggtgtccagtgtcaggtgcagctggtggagtcgtgggggagcgtggtccagccgtgggacgtccctgagactctccngtgcagcctcnggacttcaccttnagtcgtctaatgacagtgccacgtcgggtcccgacaggcctaccgagggcgaaggggctaggggagttgggaggctaaggtttanagtcaagtagtagaagtaggaaataagtaattactaactagtcgacgtaacggtacccgttaccggtaacgggtaacgggtaccgtacgttaccgtaacccgttaaccgttaacccgaaagtaaacgaaaccctaaaccgtaaaccgaaacgtaaaccgtaacgtacgttaagttaacgtttaacgtaacgtaaaacgtaacgaaaccgtaacggtacccgtagaacggtaacgtacggtacggaacgggaccgtaacgggtccgttaggttacgttaacgtttacgttaggttacgtaaaccgttaaacgttaacgtaaccgggaacgggtaaccggtaaacccggtaacccggg

SEQ ID NO: 49069 - DNA, 581 bp, Homo sapiens
  misc_feature: GYAE6OF01AMGHF.52.77.G11.1.454.CMB.1.raw
  modified_base (303)..(303): a, c, t, g, unknown or other
  misc_feature (303)..(303): n is a, c, g, or t
  modified_base (345)..(345): a, c, t, g, unknown or other
  misc_feature (345)..(345): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcctctggattcaccttcagtgtctatgacatgcacgtgggtcccnccaggcctccgaggcaaggggctgggagtgggtgctagttanatcatatgatggaagtaagatatactatgcagactccgtagacggcgtatcacctattaccagagacaactacaacgaacacgctagtatttcgactaaagtcgaaacgtagaccgtagaagacgacgtaggacggaaccgtaaccgggtcgttaggtacgttaagttaccgtggttacgtaccgtaaacgtttaacgtaccgaaaccggggtaaggaacccggtaaaccccgggg

SEQ ID NO: 49070 - DNA, 774 bp, Homo sapiens
  misc_feature: GYAE6OF01DTSPT.52.77.G11.1.454.CMB.1.raw
  modified_base (305)..(305): a, c, t, g, unknown or other
  misc_feature (305)..(305): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctgggtggagtcgtggggggagcgtggtccagcctgggagtccctgagactctcctgtgcagcctctggattcaccttcagtgtctatgacatgcacgtcggggtccnccgagggcctccgagggccgaagggggctggggaggtggggtggcctaaggtttactaagtcgtaattatggaattagggaaaaggtaagaataagttaactaatggaccaaggtaccgttacccggtagggaaacggggtcccgtaacgtttaccgtaacccttaacttttacccgaaaggtaaccggtaaacctaaacccgtaacccgaaaacggtaaacccgaacccgtacccgtttaagtttaacgtttttaacggaacccgtaaaaagttaccggaaaaccgtacggtaacccgttagggaaacggacggtaaccggttacgggtaaaccgggaacccggtaaccgggtcccgtttagggtttaacggtttaacgtttaaccgttcgggttaacggtaacccgttaaacgtttaaacgtaacccggtaaaccggggaaaccggtaacccggtaaacccccgggg

SEQ ID NO: 49071 - DNA, 576 bp, Homo sapiens
  misc_feature: GYAE6OF01EJ20E.52.77.G11.1.454.CMB.1.raw
  modified_base (301)..(301): a, c, t, g, unknown or other
  misc_feature (301)..(301): n is a, c, g, or t
  modified_base (341)..(341): a, c, t, g, unknown or other
  misc_feature (341)..(341): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctggggggaggcgtggtccagcctgggaggtccctgagactctcctgtgcagcctctggattcaccttcagtgtctatgacatgcactgggtccnccaggctccgaggcaaggggctggagtgggtggcagttanatcatatgatggaaagtaagatagtaactatgcagactccggtaggaacgggccgattcacctacttccaagacgacaactaccaagaaccacgcttagttatttgaacctaaagtcgaaacagtaccgtagagacgctaggaagtaccgaggtcttaggttagttaacgttacttaggtagtaaccggttaaacttaaacgtccggaaacgggtaggaacccgtaaacccgggg

SEQ ID NO: 49072 - DNA, 380 bp, Homo sapiens
  misc_feature: GYAE6OF01EX4BC.52.77.G11.1.454.CMB.1.raw
  modified_base (370)..(380): a, c, t, g, unknown or other
  misc_feature (370)..(380): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtccgctcggtgcggacgtctggggccaagggaccacggtcagcgtctcctcagcctccaccaagggcccatcggtcttccccctggccaccctcctccaagagcacctctgggggcacagcggccctgggctgcctggtcaaggactacttcctcgtactgcgctgagcggctggcaaggcgcatagnnnnnnnnnnn

SEQ ID NO: 49073 - DNA, 578 bp, Homo sapiens
  misc_feature: GYAE6OF01A7U6C.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagccgtgggaggtccctgagactctcctgtgcagcctctggattcaccttcagtgtctatgacatgcactggggtcccgcaggctccgaggccgaaggggctgggaggtgggtggcagttatatcatatgagtaggaaagtaagattaatactatacggcaagtactccggtagaacgggccgtattcaacctattccaagacacaactaccaagaacacgcttagttactttaggactaaagtcgaaacgtacgtcctaggagtacgtccgtaggaacgggaccgacggtcgtgttagtagttaccgtgtacgacgttaaacttacacgaacgggagtaccggtaaacccggg

SEQ ID NO: 49074 - DNA, 492 bp, Homo sapiens
  misc_feature: GYAE6OF01EML12.52.77.G11.1.454.CMB.1.raw
  modified_base (176)..(176): a, c, t, g, unknown or other
  misc_feature (176)..(176): n is a, c, g, or t
  modified_base (228)..(228): a, c, t, g, unknown or other
  misc_feature (228)..(228): n is a, c, g, or t
  modified_base (274)..(274): a, c, t, g, unknown or other
  misc_feature (274)..(274): n is a, c, g, or t
  modified_base (298)..(298): a, c, t, g, unknown or other
  misc_feature (298)..(298): n is a, c, g, or t
  modified_base (339)..(339): a, c, t, g, unknown or other
  misc_feature (339)..(339): n is a, c, g, or t
  modified_base (346)..(346): a, c, t, g, unknown or other
  misc_feature (346)..(346): n is a, c, g, or t
  modified_base (366)..(367): a, c, t, g, unknown or other
  misc_feature (366)..(367): n is a, c, g, or t
  modified_base (369)..(369): a, c, t, g, unknown or other
  misc_feature (369)..(369): n is a, c, g, or t
  modified_base (395)..(395): a, c, t, g, unknown or other
  misc_feature (395)..(395): n is a, c, g, or t
  modified_base (408)..(408): a, c, t, g, unknown or other
  misc_feature (408)..(408): n is a, c, g, or t
  modified_base (425)..(425): a, c, t, g, unknown or other
  misc_feature (425)..(425): n is a, c, g, or t
  modified_base (445)..(445): a, c, t, g, unknown or other
  misc_feature (445)..(445): n is a, c, g, or t
  modified_base (454)..(454): a, c, t, g, unknown or other
  misc_feature (454)..(454): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcgtggtttcgcgtagcgtcttaagaggtncagtgtcaggtgcagctggtgagtcgtgggggagcgtggtccagccgtgggnggtccctgagactcctctgtgcatcctctggacttcaccttcagtntctatgactatgctcgtgggtccnccaggctccgaggcgaagggctggagtgggtggcaggttanatcaatntgaagtgaagtagatatatnnanagactcgagacgctatcactatcganacacacacagacncgctatatgactaagtnactgtcagagagcagagacngtcgtgttntagtcgcgtgactaactacgagacggtagaccgtacgg

SEQ ID NO: 49075 - DNA, 577 bp, Homo sapiens
  misc_feature: GYAE6OF01BV01F.52.77.G11.1.454.CMB.1.raw
  modified_base (302)..(302): a, c, t, g, unknown or other
  misc_feature (302)..(302): n is a, c, g, or t
  modified_base (344)..(344): a, c, t, g, unknown or other
  misc_feature (344)..(344): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgcagcctctggattccaccttcagtgtctatgacatgcacgtggggtcccnccaggcctccgaggcgaaggggctgggagtgggtgcagttanatcatatgataggaaataagatatactatgacagactcgtaggaacggccgtattaccacctacttaccaagacgacctaacctaccaaagaaccacgtactagtattgaactaaagtacgaacgtacgcctagagacgtacgtaggaacggaccgtacggcgtgttagttaacttacgtgtacgtaccgtaaacttaacgtaccggaacgggtacggaaccggtaacccggg

SEQ ID NO: 49076 - DNA, 542 bp, Homo sapiens
  misc_feature: GYAE6OF01COD0K.52.77.G11.1.454.CMB.1.raw
  modified_base (306)..(306): a, c, t, g, unknown or other
  misc_feature (306)..(306): n is a, c, g, or t
  modified_base (352)..(352): a, c, t, g, unknown or other
  misc_feature (352)..(352): n is a, c, g, or t
  modified_base (466)..(466): a, c, t, g, unknown or other
  misc_feature (466)..(466): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggtccagccgtgggagtccctgagactctcctgtgcagcctctggatttcacctttcagttgtctatgacatgcacgtgggtcccncaggcctccgaggcgaaggggctgggagtgggtggactagttactntcaatagtgataggaataagactatactatgacagactcgtagacggcatcactattcagacgacaactacaacgaacacgactgtattgacaatagaactacgcctagaacgngactagacgacgacggtctggtagttattacgtgtacgtacgtaacttaagacgaacgggagaaccggtaaccggg

SEQ ID NO: 49077 - DNA, 632 bp, Homo sapiens
  misc_feature: GYAE6OF01BWVLI.52.77.G11.1.454.CMB.1.raw
  modified_base (178)..(178): a, c, t, g, unknown or other
  misc_feature (178)..(178): n is a, c, g, or t
  modified_base (209)..(209): a, c, t, g, unknown or other
  misc_feature (209)..(209): n is a, c, g, or t
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (259)..(259): a, c, t, g, unknown or other
  misc_feature (259)..(259): n is a, c, g, or t
  modified_base (273)..(273): a, c, t, g, unknown or other
  misc_feature (273)..(273): n is a, c, g, or t
  modified_base (277)..(277): a, c, t, g, unknown or other
  misc_feature (277)..(277): n is a, c, g, or t
  modified_base (288)..(288): a, c, t, g, unknown or other
  misc_feature (288)..(288): n is a, c, g, or t
  modified_base (331)..(331): a, c, t, g, unknown or other
  misc_feature (331)..(331): n is a, c, g, or t
  modified_base (336)..(336): a, c, t, g, unknown or other
  misc_feature (336)..(336): n is a, c, g, or t
  modified_base (343)..(343): a, c, t, g, unknown or other
  misc_feature (343)..(343): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatgggagttttgggctggagcggtgttcgctaggcgtcttaagaggtntcagtgtcagtgcagctggtgagtctggggngcgtggtccagccgtgggtacgtcctgacgacttcncctgtncgancctntaggcttcaccttnagtntctatcaactntgctcgttgggcccaacgtacggcctccgaggacgaacggggngtggnggtcggngtacgtagttacacgtataagtcgtaggtagtaaggaattaagtactacgtaagtagacgacgtacgtaccgtacggtaacggtacggtacgtacgtacgtacctacgttacgaacgtaaccgtacgtaacctacgtaacgtaacgtacgtacttagttaacttacgaactaacgtacgaacgtagacgtagacgtacgacgtagacggaccgtacggtacgtacgtagtacgttcggtacgtacgtaacgttaacttacgtaacggtacggtacggtaccggtaccgg

SEQ ID NO: 49078 - DNA, 523 bp, Homo sapiens
  misc_feature: GYAE6OF01EHO73.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggattcaccttcagtgtctatgacatgcacgtgggtcccgccaggcctccgaggccaaggggctgggagtgggtgctaggttatatcatatgatggaaagtaagatatactatgacagactcgtagaaggccgattcacattaccagacgacaactccaagacacgctagtattgactaatacgaacagactagagagctagaggacacggcgtgtagtattcgtgtagacgtaacttaatacgaacggagacgtaaccggg

SEQ ID NO: 49079 - DNA, 772 bp, Homo sapiens
  misc_feature: GYAE6OF01BM64O.52.77.G11.1.454.CMB.1.raw
  modified_base (242)..(242): a, c, t, g, unknown or other
  misc_feature (242)..(242): n is a, c, g, or t
  modified_base (305)..(305): a, c, t, g, unknown or other
  misc_feature (305)..(305): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcgtgggttttcctcgttgcttcttttaagaggtgtccagtgtcaggtgcagctggtggagtcgtgggggagcgtggtccagccgtgggacgtccngagctctcctgtgcagcctcgtggacttcaccttcagttgtctatgacatgcacgtgggcccncgaggcctcgaggaccgaaggggcgtgggacggtgggtgactaagttatactcaattagtaggaagttacgggaaaagttaagtaatttaacgtaaacgttagtacggaccgtaacggttacccgttaccggtaagggtaaaccggggtacccgttaacgtttaccccgtaaaccccgttaacgttttaccccgaaaacgggtaaccgtaaaccccgtaaaacccgttaaccccgaaaacggaaacccgttaacccggttaccgttttaacggtttaacttttaacggaaacgttaaaacgttacggaaaacccgtaccgtaacccgtaggtaacggacggtacgtaagggaaccggtaaccgtaccgggttacgttacggtttacgttaaccgtttggtacggttacggtaaccgttaaacgttaacgtaccggaaacgggtaacggtaaccggtaaacccccggg

SEQ ID NO: 49080 - DNA, 705 bp, Homo sapiens
  misc_feature: GYAE6OF01D5VV7.52.77.G11.1.454.CMB.1.raw
  modified_base (267)..(267): a, c, t, g, unknown or other
  misc_feature (267)..(267): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcgtggggagcgtggtccagccgtgggacgtccctgagacctctcctgtgccagccctntggacttcaccttcagtgtctatgacatgcctacgtcgggtcccgccgacggctaccgaggaccgaaggggcgtgggaggtgggtgactaggttatagtctaagttagtaggtagtacgggaaaagttaagtaagttaagtaacttagtacgacgaacggttacccgtaccgggtaggaaccgggtaccggtacttaccgaacccttaacgtttaccgaacgtaacgaaccctaaaccgttaacccgaaacgtaaccctaccggtaccttaagtttaacgtttagaaccgtaaaagtacggtaaactaaccggtaccgttaggaacgtacgacgtaacggtacggaacgaccggtacgtacggttagttaacttacgtacggtacgaaccgttaaacgttaacgtacggaaacggtacgtaacccggtaaaccccggg

SEQ ID NO: 49081 - DNA, 580 bp, Homo sapiens
  misc_feature: GYAE6OF01CTHMW.52.77.G11.1.454.CMB.1.raw
  modified_base (288)..(288): a, c, t, g, unknown or other
  misc_feature (288)..(288): n is a, c, g, or t
  modified_base (303)..(303): a, c, t, g, unknown or other
  misc_feature (303)..(303): n is a, c, g, or t
  modified_base (338)..(338): a, c, t, g, unknown or other
  misc_feature (338)..(338): n is a, c, g, or t
  modified_base (354)..(354): a, c, t, g, unknown or other
  misc_feature (354)..(354): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcctgggaggtccctgagactctcctgtgcagcctctggattcaccttcagtgtctatgacntgcacgtgggtcccnccgaggcctccgaggcgaaggggctgggagtgggngcagttatatcaatangatggaagtaagatatactatgacagtacctcggtagaacgggtccgtattccaccctactttaccgaacgacgaccaactaccaaacgaacacgtcgttagtatttagactaaagtacgaacgtacgaccgtagaacgacgacgtaggacggacgacggtcgtggttagttaacttcgttagtacgtacgtaacttaacgtacgaacggtaggaaccgtaaccgg

SEQ ID NO: 49082 - DNA, 753 bp, Homo sapiens
  misc_feature: GYAE6OF01EEBUO.52.77.G11.1.454.CMB.1.raw
  modified_base (276)..(276): a, c, t, g, unknown or other
  misc_feature (276)..(276): n is a, c, g, or t
  modified_base (309)..(309): a, c, t, g, unknown or other
  misc_feature (309)..(309): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaggtccctgagactctcctgtgcagcctctggacttcaccttnagtgtctatgactatcgctacgtcggggtcccncgacgggcctaccgaggaccgaagggggtctagggaggtggggtcgacgtaagtttatacgtcgtaattagtgagttagggtaaaagtaagtattaactaacgttagtcggacgtaacggtaccgttaccggttagggaaaccgggtccggtaactttaccgaacccgttacgtttacccgaaggtaaccgaacctaaaccgttaacccgaaaacggtaaccctaaccggtacgtttaacgtttaactttacggaaaccttaaaagtaccgaaaccgtacggtaccgttaggaacggtacgtaccggttaaggaaccgggtaccgtaacgggttaccgttagggttacggtttaacgtttacggttacgggttacggtaacccgttaaaaccgttaacggtacccgtaaacggggtaccggtaaacccggttaaacccccgggg

SEQ ID NO: 49083 - DNA, 619 bp, Homo sapiens
  misc_feature: GYAE6OF01APZPY.52.77.G11.1.454.CMB.1.raw
  modified_base (273)..(273): a, c, t, g, unknown or other
  misc_feature (273)..(273): n is a, c, g, or t
  modified_base (301)..(301): a, c, t, g, unknown or other
  misc_feature (301)..(301): n is a, c, g, or t
  modified_base (343)..(343): a, c, t, g, unknown or other
  misc_feature (343)..(343): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctctttaagaggtgtccagtgtcaggtgcagctggtggagtcgtgggggagcgtggtccagccgtgggagtccctgagactctcctgtgcagcctctggattcaccttnagtgtctatgacatgcacgtgggtcccncaggctccgaggcgaaggggctgggaggtgggtgctagttanagtcatagtgataggaagtaagataatactatgacaggtactccggtaggaacgggtcctaagttaccaacctacgtttccgaaggtaacgaaccaaaccgttacccgaaacgtaaaccaccggtacgttagttacgtttacgaactaaacgtacgtaaacgtacgtaccgttagaggtacgacgtaggacggtaccgacgggtcgtaggttacgttagttacgtggtaccgaacgtaaacttagaccgaacgggaacggtaccgtaaacccgggg

SEQ ID NO: 49084 - DNA, 699 bp, Homo sapiens
  misc_feature: GYAE6OF01BUDHJ.52.77.G11.1.454.CMB.1.raw
  modified_base (289)..(289): a, c, t, g, unknown or other
  misc_feature (289)..(289): n is a, c, g, or t
tcagcgcagtacgacacgaccggtgctcgatttagctagtcactcaagggaaagggggggagaggagcccagcactagaagtcggcggtgttccattcggtgatcagcactgaacacagaggactcaccatggagtttgggctgagcttgggttttcctcgttgcttcttttaagaggtgtccagtgtcaggtgcagcgtgggtggagtcgtgggggagcggtggtccagccgtgggacggtccctagacgacctctcctgtgcagcctgtggtacttcaccttcagtntctatgacatcgcacgtcgggtccgccaggcctacgaggccgaaggggcgtagggaggtgggtggctaagtttactagtctaagttataggaattacgggaaaagttaagaacttaatactaagtacgaccgtaaggtacctaccgggtacggtaaccgggtaccgtaactttaccctaaccttaacgtttaccaaacggtaacctaaaccgtaaacccgtaacccgaaaagtaacccgtaccggtcgttaagtttaactttaaggaacctaaaagtacggtaaacacggtacctagggaagacggtacgtaacggacggacgtacgggtcttaggttacgtagttacgtacggtagtaaccgtaaactttacggtaaccggacgggtaacggtaaccgtaaccccgggg

SEQ ID NO: 49085 - DNA, 436 bp, Homo sapiens
  misc_feature: GYAE6OF01ECNY0.52.77.G11.1.454.CMB.1.raw
  modified_base (424)..(436): a, c, t, g, unknown or other
  misc_feature (424)..(436): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtccgctcggtgcggacgtctggggccaagggaccacggtcagcgtctcctcacgcctccaccaagggcccatccggtccttcccccgtggccctacccctccctccaagacgcctacccgtccgtgggggccacgacggccggccccgtgggctcggccgttcgggtaccaacggtaccttacctttccgtattaccgatccgctaggacggccgggctcgggacgaagggccgacagtagnnnnnnnnnnnnn

SEQ ID NO: 49086 - DNA, 374 bp, Homo sapiens
  misc_feature: GYAE6OF01CCAHL.52.77.G11.1.454.CMB.1.raw
  modified_base (368)..(374): a, c, t, g, unknown or other
  misc_feature (368)..(374): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtccgctcggtgcggacgtctggggccaagggaccacgggtcagcgtctcctcagcctccaccaagggcccatcggtcttcccctggccaccctctccaagagcacctctgggggcacagcggccctgggctgcctggtcaaggctacttcctcgtagcactctgagcgggctggcaggcgcatagnnnnnnn

SEQ ID NO: 49087 - DNA, 595 bp, Homo sapiens
  misc_feature: GYAE6OF01DZI87.52.77.G11.1.454.CMB.1.raw
  modified_base (263)..(263): a, c, t, g, unknown or other
  misc_feature (263)..(263): n is a, c, g, or t
  modified_base (513)..(513): a, c, t, g, unknown or other
  misc_feature (513)..(513): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagacctctcctggtgcagcctntggattccaccttcagtgtctatgacatgctacgtcgggtcccgccgaggcctccgagggacgaagggggctgggagtggggtgctagttatatcaatagtgagtaggtaaagtagatatactatcgacagtaccgtccgtaggacgggtccgtattacacccttattaccgaagaacgacctaacctaccaaacgaacctacgtacttagttaatttgaactaatacgaaccgagtaccgtagagacgngtacggacgacgacggtcgtgttagttagttcgtagtacgaccgttaacttaacgtacggaacgggaggaacgtaacccggg

SEQ ID NO: 49088 - DNA, 611 bp, Homo sapiens
  misc_feature: GYAE6OF01CLA97.52.77.G11.1.454.CMB.1.raw
  modified_base (276)..(276): a, c, t, g, unknown or other
  misc_feature (276)..(276): n is a, c, g, or t
  modified_base (305)..(305): a, c, t, g, unknown or other
  misc_feature (305)..(305): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggccgtgggaggtccctgagctctcctgtgcagcctctggattcaccttnagtgtctatgacatcgcacgtgggtcccnccgaggcctccagggcgaaggggctgggaggtggggtggctaaggttatagtctaattagtacgatagggaaagttaagaatattactagtgacaagtactccggtagaacgggtccgaattccaacccttatttacccaagacgaacaactaccaaagaccaacgtctagttatttacgactaaacgtgaacgtacgtcctaggacgagtacgtggaacggtaccgacggtcgttggtagttacttacgtgtagtaacccgtaaatttaacgacccggtaacggtacggaaaccgtaaccccggg

SEQ ID NO: 49089 - DNA, 767 bp, Homo sapiens
  misc_feature: GYAE6OF01ENM7L.52.77.G11.1.454.CMB.1.raw
tcagcgcagtacgacacgaccggtgctcgatttagctagtcactcaagggaaagggggggagaggagcccagcactagaagtcggcggttgtttccagttcggtgatcagcactgaacacagaggactcaccagtggtagtttgggctggagtcgttgggtttttcctcgtttgcttacgtttttaaggaggttgtcctagtgtcgaggtgcagtcgtgggtggagtcggtggggggaggcgttcggtaccaggtccgtggggacggttccctaggacgtaccttctccgtggtcgcctacggtccttcgtaggtactttccgtaccctttcgagtttcgtactagtacgactagtcgacctaggttccggggtcccacgtacggcccttaccgagggaccggaaggggtcctaggggtacgggttggggtacggaccttaggtttaatacgtacgtaagttagtaggaagttagggaaagttaagatttaagtaccttagcgtacaacggtaccgttcggtaggaacgggtccgtacttaccgaccgtacgttacgaagtacgaacctaactaccgaaagtaccacgtcgttagtagttacgaactaagtacgaacgtacgtccgttaggacgtacgtaccgtagggaaccggtaccgacgggttcgttaggttacgtttaacgttcggtacggttaccggtaaaccgttaaacgtttacggtaaccggaacggggtaaaccggtaacccgggtaaacccccgggg

SEQ ID NO: 49090 - DNA, 662 bp, Homo sapiens
  misc_feature: GYAE6OF01DMCHC.52.77.G11.1.454.CMB.1.raw
  modified_base (167)..(167): a, c, t, g, unknown or other
  misc_feature (167)..(167): n is a, c, g, or t
  modified_base (258)..(258): a, c, t, g, unknown or other
  misc_feature (258)..(258): n is a, c, g, or t
  modified_base (323)..(323): a, c, t, g, unknown or other
  misc_feature (323)..(323): n is a, c, g, or t
  modified_base (448)..(448): a, c, t, g, unknown or other
  misc_feature (448)..(448): n is a, c, g, or t
tcagcgcagtacgacacgaccggtgctcgatttagctagtcactcaagggaaagggggggagaggagccagcactagaagtcggcggtgtttccattcggtgatcagcaactgaacacagaggactcacatggagtttgggctgagctgggttttcctcgttgcttnttttaagagtgtccagtgtcaggtgcagctggtggagtcgtggggggagcgtggtccagccgtggggacgtccctgagacctcgtccgtgngcaggcctagtggactttccaacctttcgagttcgtactatgaacatcggacacggttcgggccnccgaggcctaccgaggggacaagggggctagggaggtcggggtggactagttatatcaagttatgaattaggggaaaataagtaatagttacagttcgacaggaccgtacgtagacgggtacctnttaccaccttattacgaagacgtaacctaactacccgaaagaaccgtacgcgttagttacctttaggaaacctaaattaccggaaaataccggtacgtaaggacgacggtacgtacgggaaggaccggacggtacgttaggttaacgttacgttacgtagttaccgtaacgttaacgtaacggtaccgaacgggtaaccgtaacggtaacccgg

SEQ ID NO: 49091 - DNA, 699 bp, Homo sapiens
  misc_feature: GYAE6OF01B05KT.52.77.G11.1.454.CMB.1.raw
  modified_base (251)..(251): a, c, t, g, unknown or other
  misc_feature (251)..(251): n is a, c, g, or t
  modified_base (448)..(448): a, c, t, g, unknown or other
  misc_feature (448)..(448): n is a, c, g, or t
tcagcgcagtacgacacgaccggtgctcgatttagctagtcactcaagggaaagggggggagaggagcccagcactagaagtcggcggtgttccattcggtgatcagcactgaacacagagactcaccatgggagtttgggctgagcgttgggttttcctgttgccttatttaaaggcggtgtccgagtgtcgaggtgcaggcgtggtggcgtcggtgggggaggcgtggtccagccgtggggacggtccngacgctcgtccgtgtacgcgagtcctagtggtacttccgaccttgagttgtactaagtcgactacgtgacctacggtcggcccgaccaggccctacggacgggcggaaacggggctggggacggtggggtactacgtaagtttacagttacgaagttagtaggaagtaggaaacgttaagaattaactaccgttagngactaacggtaccgttccggtaaggaacgggtaccgaacgtttaccaactacgtttaaccgaaacgtaacgaacctaaaccgaacgaaaccgtaaccaacggtctaacggttaacgtttaacgaactaaacggtaaccgaaacgtaccggaccgtagaaccggagctaagggaccgacgacggtcgtaggttatagttccgagtaccgaacgtaacgttagaaccggaggtaacgtacggtaaaccccggg

SEQ ID NO: 49092 - DNA, 517 bp, Homo sapiens
  misc_feature: GYAE6OF01CLY3Z.52.77.G11.1.454.CMB.1.raw
  modified_base (490)..(517): a, c, t, g, unknown or other
  misc_feature (490)..(517): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctggaggacacggctgtgtattactgtgcgtaaacttaatcgacggagacaacggtcgacccccgtcgctcggtgcggacgtcgtggggaccaagggaccacggtcagccgtcctcccgtcacgccctccgaaccgaacggggccccaagttcccgggtcccttccccccgtggaccctacccccttccctacccgaaaggaccgtacccgtaacccgttcgggcgggggaccaccggaccgggcccggccccggttggggcctacggtcccgttggtaccgaaacggtcctttaaccgttccctaagtaccgtacttccggcgtacgggacggccgggtctacgggaacgaaggggcccgatagagcnnnnnnnnnnnnnnnnnnnnnnnnnnnn

SEQ ID NO: 49093 - DNA, 592 bp, Homo sapiens
  misc_feature: GYAE6OF01BV0RU.52.77.G11.1.454.CMB.1.raw
  modified_base (159)..(159): a, c, t, g, unknown or other
  misc_feature (159)..(159): n is a, c, g, or t
  modified_base (175)..(175): a, c, t, g, unknown or other
  misc_feature (175)..(175): n is a, c, g, or t
  modified_base (261)..(261): a, c, t, g, unknown or other
  misc_feature (261)..(261): n is a, c, g, or t
  modified_base (309)..(309): a, c, t, g, unknown or other
  misc_feature (309)..(309): n is a, c, g, or t
  modified_base (351)..(351): a, c, t, g, unknown or other
  misc_feature (351)..(351): n is a, c, g, or t
  modified_base (496)..(496): a, c, t, g, unknown or other
  misc_feature (496)..(496): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttccncgttgctcttttaagnggtgtccagtgtcaggtgcagctggtggagtcgtgggggagcgtggtccaggcctggggagtccctgagctctcctgtgcagcctntggacttccaccttcagttgtctatgactatcgctacgtcgggtcccncgaggcctcgaggcgaaggggctgggagtgggtgctagttanatcgaatagtagtatagggaaataagtatagtactagtcgacaggtactccggtaggaacggcctagttaccacctattccaagacaacaactacaagacacgtctagtattcgaactaaagtcgaacgtacgcgtgaagtacgntacgggagtaccgaacggttcgtaggttagttacgttacgtggtacgtaacgttaaacttaacgaccggaacgggtacggaaaccggtaacccggg

SEQ ID NO: 49094 - DNA, 590 bp, Homo sapiens
  misc_feature: GYAE6OF01EKQZL.52.77.G11.1.454.CMB.1.raw
  modified_base (316)..(316): a, c, t, g, unknown or other
  misc_feature (316)..(316): n is a, c, g, or t
  modified_base (544)..(544): a, c, t, g, unknown or other
  misc_feature (544)..(544): n is a, c, g, or t
tcagcgcagtacgacacgaccggtgctcgatttagctagtcactcaagggaaaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggtccaggccgtggggacgtccctgagacctctcctgtcgcagcctctggattccaccttgagtgtctatgactagtcgctacgtcggggtcccncgaggcctccgaggcggaaggggctgggagtgggtgctaggttatatcgaagtagtagagtaggaaagttaacgattatatagtcgactagacgtcgaggaacggctatccactattaccgaagacgaacaactaccaaagtacacgtcttagttattacgaactaagtacgaatacgtaccgtagaacgagcgtaggacgaccgtaggtcttaggtattacgttacnggtacgtaacgtaagttacgacgaacggtacgaaccggtacccggg

SEQ ID NO: 49095 - DNA, 648 bp, Homo sapiens
  misc_feature: GYAE6OF01A4H8A.52.77.G11.1.454.CMB.1.raw
  modified_base (277)..(277): a, c, t, g, unknown or other
  misc_feature (277)..(277): n is a, c, g, or t
  modified_base (309)..(309): a, c, t, g, unknown or other
  misc_feature (309)..(309): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggaggcgtggtccagcctggggagtccctgagactctcctgtgcagcctctggacttcaccttnagttgtctatgactatgctacgtggggtcccnccgaggcctccgaggcgaagggggctggggaggttggggtagacgtaggtttactatcgtaattataggatagggaaagttaagattaatactagtcgactaacgtccgtacggtaggaacgggtccgtacttaccaacctacgtttaccgaagaacgaacctaaccgtaccctaaagaaccacgtcttacgttaatttcgaactaattacgaacctacggaccctagaaggtacgacgtacggaagggaccgacggtcgttaggttagttacgttacgtaggttacgaacgttaaacgttacgtacggaacgggtaacggtaccggtaaaccccgggg

SEQ ID NO: 49096 - DNA, 745 bp, Homo sapiens
  misc_feature: GYAE6OF01BURIX.52.77.G11.1.454.CMB.1.raw
  modified_base (177)..(177): a, c, t, g, unknown or other
  misc_feature (177)..(177): n is a, c, g, or t
  modified_base (263)..(263): a, c, t, g, unknown or other
  misc_feature (263)..(263): n is a, c, g, or t
  modified_base (316)..(316): a, c, t, g, unknown or other
  misc_feature (316)..(316): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgcttcttttaagnggtgtccagtgtcaggtgcagctggtggagtcgtgggggaggcgtggtccagccgtgggacgtcctgacgctctctgtgcagcctntggacttccaccttcagttgtactagtcgactatcgcctacgtcggggtcccnccgaggccctaccgaggcggaagggggtctaggggagggttcggggtcggacgtaagtttaagtatacgtaagttagtaggtaagttacggggtaaaagttaaaggtaattaaacgttaacgttaagtacggaccgtaacggttaccgttacccgggtagggtaaaccggggtaccgttaacgtttacccgtaacccgttaacgtttacccgaaaggtaaccgtaaacctaaacccgtaacccgaaaacgaacccgtaaccgtacgttacgttaacgtttacgaacctaaagtacggaaccgtacggtaccgtagacggacgtacggtaggaacggaccgtacggtacgttaggttagttaacgttcgtagtacggtaaccgttaaacttacggaccggtaaccgggtaggtaacccggtaaacccggg

SEQ ID NO: 49097 - DNA, 743 bp, Homo sapiens
  misc_feature: GYAE6OF01BYDBW.52.77.G11.1.454.CMB.1.raw
  modified_base (179)..(179): a, c, t, g, unknown or other
  misc_feature (179)..(179): n is a, c, g, or t
  modified_base (347)..(347): a, c, t, g, unknown or other
  misc_feature (347)..(347): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtntccagtgtcaggtgcagctggtggagtcgtgggggaggcgtggtccagccgtgggaggtccctgagactctcctgtgcagcctctggtacttccaccttcagttgtactatgacatgcacgtcgggcccgccgaggcctccgaggcgaaggggtcgtgggaggtgggngctagtatatcatatgagtagggtaaataagacttaagtactagtcgactaacggtaccgtacccggtagggaaaccgggcccgtaacgtttaccccgtaacccgtttaaccgtttaccgaaacggtaaccgtaaacccgtaaacccgtaaccccgaaaacgtaaacccgtaccggttaacctttacggttaaacgttttaccgaaacgtaaacgttacggaaaaccgtacggtaccgttaacggaacggttacggaccggttaagggaaccggtacccggtaaccgggttccgttagggttacgttaacggtttaccgttacgtaacggtaaccgttaaaccgtttaacggtaacccggtaacggggtaaacggtaaccccgggtaaaccccggg

SEQ ID NO: 49098 - DNA, 599 bp, Homo sapiens
  misc_feature: GYAE6OF01AF4AN.52.77.G11.1.454.CMB.1.raw
  modified_base (175)..(175): a, c, t, g, unknown or other
  misc_feature (175)..(175): n is a, c, g, or t
  modified_base (177)..(177): a, c, t, g, unknown or other
  misc_feature (177)..(177): n is a, c, g, or t
  modified_base (180)..(180): a, c, t, g, unknown or other
  misc_feature (180)..(180): n is a, c, g, or t
  modified_base (182)..(182): a, c, t, g, unknown or other
  misc_feature (182)..(182): n is a, c, g, or t
  modified_base (185)..(185): a, c, t, g, unknown or other
  misc_feature (185)..(185): n is a, c, g, or t
  modified_base (187)..(187): a, c, t, g, unknown or other
  misc_feature (187)..(187): n is a, c, g, or t
  modified_base (192)..(192): a, c, t, g, unknown or other
  misc_feature (192)..(192): n is a, c, g, or t
  modified_base (198)..(198): a, c, t, g, unknown or other
  misc_feature (198)..(198): n is a, c, g, or t
  modified_base (206)..(206): a, c, t, g, unknown or other
  misc_feature (206)..(206): n is a, c, g, or t
  modified_base (226)..(226): a, c, t, g, unknown or other
  misc_feature (226)..(226): n is a, c, g, or t
  modified_base (264)..(264): a, c, t, g, unknown or other
  misc_feature (264)..(264): n is a, c, g, or t
  modified_base (272)..(272): a, c, t, g, unknown or other
  misc_feature (272)..(272): n is a, c, g, or t
  modified_base (281)..(281): a, c, t, g, unknown or other
  misc_feature (281)..(281): n is a, c, g, or t
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
  modified_base (303)..(303): a, c, t, g, unknown or other
  misc_feature (303)..(303): n is a, c, g, or t
  modified_base (312)..(312): a, c, t, g, unknown or other
  misc_feature (312)..(312): n is a, c, g, or t
  modified_base (333)..(333): a, c, t, g, unknown or other
  misc_feature (333)..(333): n is a, c, g, or t
  modified_base (447)..(447): a, c, t, g, unknown or other
  misc_feature (447)..(447): n is a, c, g, or t
  modified_base (457)..(457): a, c, t, g, unknown or other
  misc_feature (457)..(457): n is a, c, g, or t
tcagcgcagtacgacacgaccggtgctcgatttagctagtcactcaagggaaaggggggggagaggagcccagcactagaagtcggcggtgtttccattcggtgatcagcactgaacacagaggactcaccatggagtttgggctgagcggtgttcgctaggcgtcttagtagtncngtncngtncngctgngcgtgnggggacgngtgcagccgtggcgtccagnctctcctggcacgcgtcctacgtgtacttcacccttgngtgtcatnactgtcacncggtcggaccncncggtcncgnggcgagggntggaccggtggcgaatgttanactatatgagtagtagtaagtatacgtatagtgacgacgtcgtaccgacggtagaccggtctactaccgtacttcgtaacgacgacctaaccgactaacaacgtctacggttanacttaaccgngaacgtaacgtacgtaacgtacgtacgtagtacgtacgtacgtacggtacggacgtaccggtacgtacgttagttacgttacgtacgtacgtaacgttaacgtaacggtaaccggtaaccggtaccggtaaccggtacccgg

SEQ ID NO: 49099 - DNA, 630 bp, Homo sapiens
  misc_feature: GYAE6OF01BMGZB.52.77.G11.1.454.CMB.1.raw
  modified_base (309)..(309): a, c, t, g, unknown or other
  misc_feature (309)..(309): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggacggtccctggagacctctcctgtcgcagcctctggacttcaccttcagtgtctatgacatgcacgtgggtcccnccgaggctccagggcgaacggggctgggaggttcggggtggctaaggttatagtcaattgtaggagtagggaaagtaagattaattaacgtagtcgacgtaacgtaccgtaccggtaggaacgggaccgtacttaccctacctacgtttaccaagaaccgaacaaccgtaaccgaaacgaaccacgtactagttacttagacgtaaactacgaaacacgtacctaggaagacgacgtacggacgtacggacggtacgtgttaggttacttacgtgtacggacgtaaacgttacgtacggacggtaacggacgtaacccggg

SEQ ID NO: 49100 - DNA, 710 bp, Homo sapiens
  misc_feature: GYAE6OF01C4116.52.77.G11.1.454.CMB.1.raw
  modified_base (265)..(265): a, c, t, g, unknown or other
  misc_feature (265)..(265): n is a, c, g, or t
  modified_base (292)..(292): a, c, t, g, unknown or other
  misc_feature (292)..(292): n is a, c, g, or t
  modified_base (319)..(319): a, c, t, g, unknown or other
  misc_feature (319)..(319): n is a, c, g, or t
  modified_base (397)..(397): a, c, t, g, unknown or other
  misc_feature (397)..(397): n is a, c, g, or t
tcagcgcagtacgacacgaccggtgctcgatttagctagtcactcaagggaaagggggggagaggagcccagcactagaagtcggcggtgttccattcggtgatcagcactgaacacagaggactcaccatgggagtttgggctgagtcttgggttttcctcgttgcttcttttaagaggtgtccagtgtcaggtgcagctgggtggagtcgtgggggaggcgtggccagccgtgggacggtccctgacgctctccgtggtcgcncgcctcgtggacttccaccttcagttntctatgacatgcgtacgtcggggtccnccgaggcctaccggaggcggaacgggggctaggggaggttggggtacggactaaggtttaagtactacgtaattaagnggtaagtagggaaaacgttaagtaattacgtaacctagtacggacctaacggtccggttacccgggtaaggtaccggggtaaccgttaacttacccgaacctttacgtttaacccgaaacggtaaccgtaaccaaacccgtaacccgaaaacgtaaccgtaaccgtcgttattaagtttacggaactaaactacggaaactcggacgtacgagtcgacggtacggaacgaccggtcgtgttaggttagttacgttacggttcggtacgtacgtaaccgttaacgacggaacgggacggtaacgtaaccccggg

SEQ ID NO: 49101 - DNA, 775 bp, Homo sapiens
  misc_feature: GYAE6OF01D2IK0.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcgttgggtttttcctcgttgcttactttttaagaggttgtccagtgtcaggtgcagctggtggagtcgtgggggagcgtggtccagccgtgggacgtcctgagacctctcctgtcgcagcctcgtggacttccaccttcgagttgtactagtgactatgactacggtcgggtcccgccgacggcctccgagggaccggaacggggtctaggggaggttcggggtacgggtctaaggtttaatactctaagttaagtaggtaagtagggtaaaagtaaggtaatattacgtagtcgactaacgtaccgtccggtagggaacgggtacccgtaacttacccgaacccttacgtttacccgaagtaaccggaaccctaaaccgttaacccgaaacgaaacccgtaccggttacctttaaggtttaactttaggaaacctaaaagttacggaaacgtacgtacccgtagggaacggtacgtacggtaacgggaacggtaacccgtaccgggttcgtttaacggttagggttttaacgtttaccggttacggttacggttaaacccggttaaacgtttaaaccggttaccgggaaaaccggggtaacgggtaaccccggttaaaccccggggg

SEQ ID NO: 49102 - DNA, 672 bp, Homo sapiens
  misc_feature: GYAE6OF01CP4W1.52.77.G11.1.454.CMB.1.raw
  modified_base (300)..(300): a, c, t, g, unknown or other
  misc_feature (300)..(300): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggattcaccttcagtgtctatgacatgcacgtgggtccncaggcctccgaggtccaaggggctgggagttggggtggctagttatactacaatagtgagtgggaaaagtaagatagttaactagtcgacagtaccgtccgtaggaacgggtaccgtattaccaacctatttaccgaagacgaacaaccgtaccaaacgaaccacgtacttagttaactttagaactaaagtacgaaaccgtaggtacccttaggaacgtacgtacgtacggaacgggtaccgtaccgggtacgttacgggttaggtttaacgttttaaccggttacggttaaccggtaaccggttaaaaccgtttaaaccgttaaccggtaaaccggggtaaccggggtaaaccccgtaaaccccgggggg

SEQ ID NO: 49103 - DNA, 382 bp, Homo sapiens
  misc_feature: GYAE6OF01BT39N.52.77.G11.1.454.CMB.1.raw
  modified_base (366)..(366): a, c, t, g, unknown or other
  misc_feature (366)..(366): n is a, c, g, or t
  modified_base (371)..(382): a, c, t, g, unknown or other
  misc_feature (371)..(382): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtccgctcggtgcggacgtctggggccaagggaccacggtcagcgtctcctcagcctccaccagggcccatcggtccttccccctggccaccctcctccaagacgcacctctgggggcacacgcggccctgggctgcctggtcaaggctacttcctatacgatcgctgagcgggctggcaggcgnatagnnnnnnnnnnnn

SEQ ID NO: 49104 - DNA, 909 bp, Homo sapiens
  misc_feature: GYAE6OF01E5SHF.52.77.G11.1.454.CMB.1.raw
  modified_base (175)..(175): a, c, t, g, unknown or other
  misc_feature (175)..(175): n is a, c, g, or t
  modified_base (179)..(179): a, c, t, g, unknown or other
  misc_feature (179)..(179): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagnggtntccagtgtcaggtgcagctgggtggagtcgtgggggagcgtggtccagccgtggggacgtccctgacgaccttcctccgtggtcgcctacggtccccttcgtagggtaactttccccgtaaccgtttcgaaggttcgttacctaagtcggaacctagttccgacctaccggttcgggggtccccaccgtacggccctacccggaggggaccggtaacgggggtcttaggggaagggttcgggggtacgacgttaaggtttaataacgtcaagttagtaggtaaggttagggtaaaagttaaacggtatttaaacgtaaaccgtttagacccggtaaccgtaacgggttacccgttacccgggtaacggggtaaacccgggtacccgttaacgtttaccccgtaaacgtttaacccgtttaacccggaaacggtaaaacccgtaaaccccgtaaaccgttaaaccccgaaaacgggtaaacccgtaacccggttacggtttaacggtttaaacgtttaaccggaaacgtaaaacggtacggaaaccgtaacggtacccgttaagggaacgggtacgtacggtaaggggaaccggaccggtaaccggtggtttacggttaacggtttaaacgttccggttagggttaacccgtaaacccggtttaaaccgttaaacggtaaccccgggtaaccgggggtaaaccggtaaaccccggttaaaccccccggggg

SEQ ID NO: 49105 - DNA, 750 bp, Homo sapiens
  misc_feature: GYAE6OF01DZC0F.52.77.G11.1.454.CMB.1.raw
  modified_base (193)..(193): a, c, t, g, unknown or other
  misc_feature (193)..(193): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgctcttttaagagtgtccagtgtcaggtncagctggtggagtcgtgggggaggcgtggtccagccgtgggacgtccctgagacctctcctgtgcagcctctggattccaccttcagttgtctatgacatgcacgtcgggtcccgccgaggcctcgaggccgaaggggctgggagtggggtagctagttatactctaatagtgaagtaggtaaaacgtagaatagtactagtcgactagtccgtaccgtagggaacgggtacctacttaccgaaccttacgttaaccgaagtaaccgtaacctaaaccgtaacccgaaaacgaacctaccggtacgttaacggtttaacgtttacgaaacttaaaagtaacggtaaaccgtaccggtaccgttacggaacggtacggtaaccgttacgggaaaaccggggtacccggtaccgggttacgtttacgggttaacgttttaacggttttaacccggttagggttaaccccggtaaaaccgggtttaaaccgtttaaaacggtacccgggggtaaaacggtaaaccccgggggtaaacccggttaaacccccccggggggg

SEQ ID NO: 49106 - DNA, 537 bp, Homo sapiens
  misc_feature: GYAE6OF01D9M2X.52.77.G11.1.454.CMB.1.raw
  modified_base (312)..(312): a, c, t, g, unknown or other
  misc_feature (312)..(312): n is a, c, g, or t
  modified_base (357)..(357): a, c, t, g, unknown or other
  misc_feature (357)..(357): n is a, c, g, or t
  modified_base (363)..(363): a, c, t, g, unknown or other
  misc_feature (363)..(363): n is a, c, g, or t
  modified_base (378)..(378): a, c, t, g, unknown or other
  misc_feature (378)..(378): n is a, c, g, or t
  modified_base (384)..(384): a, c, t, g, unknown or other
  misc_feature (384)..(384): n is a, c, g, or t
  modified_base (451)..(451): a, c, t, g, unknown or other
  misc_feature (451)..(451): n is a, c, g, or t
  modified_base (462)..(462): a, c, t, g, unknown or other
  misc_feature (462)..(462): n is a, c, g, or t
  modified_base (481)..(481): a, c, t, g, unknown or other
  misc_feature (481)..(481): n is a, c, g, or t
  modified_base (484)..(484): a, c, t, g, unknown or other
  misc_feature (484)..(484): n is a, c, g, or t
  modified_base (486)..(486): a, c, t, g, unknown or other
  misc_feature (486)..(486): n is a, c, g, or t
  modified_base (495)..(495): a, c, t, g, unknown or other
  misc_feature (495)..(495): n is a, c, g, or t
  modified_base (499)..(499): a, c, t, g, unknown or other
  misc_feature (499)..(499): n is a, c, g, or t
  modified_base (510)..(510): a, c, t, g, unknown or other
  misc_feature (510)..(510): n is a, c, g, or t
  modified_base (522)..(522): a, c, t, g, unknown or other
  misc_feature (522)..(522): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagtctggtggagtcgtggggggagcgtggtccagcctgggaggtccctgagactctcctgtgcagcctctggacttccacctttcgagttgtctatgacattgcctacgtggggtccnccgaggctaccggaggcgaagggctggaggtgggtgctagttatnctaatntggataggaagtaanacttanactaatgacaagtcttacgaggtaacggacgtattacgaactagtccaagacgacaactcaaagacncgctgttattnaacaagtagactagctagnagngngtaaggacncggntgtattatcgngtcagacttaancgaggagctaaccgg

SEQ ID NO: 49107 - DNA, 623 bp, Homo sapiens
  misc_feature: GYAE6OF01EDM8P.52.77.G11.1.454.CMB.1.raw
  modified_base (277)..(277): a, c, t, g, unknown or other
  misc_feature (277)..(277): n is a, c, g, or t
  modified_base (306)..(306): a, c, t, g, unknown or other
  misc_feature (306)..(306): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtggggacgtccctgagactctcctgtgcagcctctggattccaccttnagtgtctatgacatgccacgtggggcccncgagggcctccgaggtccgaaggggtctagggagtggggtcgcgtagttatatcatatgataggaaagtaagattaatactagtgacaagtaccgtccgtaggaacgggtccgtattaccaacctatttaccgaagaacgtaaccaaccgttacccaaagaaccaaccgtcttagttatttacggaactaaaacgtagaaaccgtacgtacccgtaggagacgtcgtacggaacggtacacgggcgttggtagttacgttacgtggtacgaacgttaaacgttaacgtacggaacgggtaggaaccgtaaccccggg

SEQ ID NO: 49108 - DNA, 574 bp, Homo sapiens
  misc_feature: GYAE6OF01D9ZGK.52.77.G11.1.454.CMB.1.raw
  modified_base (308)..(308): a, c, t, g, unknown or other
  misc_feature (308)..(308): n is a, c, g, or t
  modified_base (381)..(381): a, c, t, g, unknown or other
  misc_feature (381)..(381): n is a, c, g, or t
tcagcgcagtacgacacgaccggtgctcgatttagctagtcactcaagggaaaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggattccacctttcagttcgtctaatgacatgcacgtggggtcccnccgaggcctccgaggcaaggggctgggagtgggtgctagttatatcgatatgataggaaataagatatactangctaagtacctcgtagaacgggacctattaccactattaccaagacgacaactacaagaacacgcttagtattagaactaaagtagaacagtcctaggaacagcgtaggagtaccgacggtatcggttagtaattacgtgtacgaaccgtaaacgtttaacgaccggaaccggaggtaacgtaaaccccgggg

SEQ ID NO: 49109 - DNA, 608 bp, Homo sapiens
  misc_feature: GYAE6OF01B5B7O.52.77.G11.1.454.CMB.1.raw
  modified_base (311)..(311): a, c, t, g, unknown or other
  misc_feature (311)..(311): n is a, c, g, or t
  modified_base (345)..(345): a, c, t, g, unknown or other
  misc_feature (345)..(345): n is a, c, g, or t
  modified_base (364)..(364): a, c, t, g, unknown or other
  misc_feature (364)..(364): n is a, c, g, or t
tcagcgcagtacgacacgaccggtgctcgatttagctagtcactcaagggaaaggggggggagaggagcccagcacctagaagtcggcggtgtttccattcggtgatcagcactgaacacagaggactcaccatggagtttgggctgagcgtgggttttcctcgttgctcttttaagaggtgtccagtgtcaggtgcagctggtggagtcgtgggggagcgtggtccaggccgtgggaggtccctgagactctcctgtgcacgcctcgtggacttcaccttcagtgtctatgacagtgcactcggggtccnccgaggcctcgaggcgaaggggctggaggtgggngactagttactatcatagngagtaggaataagatatactatgacagtactacggtaggaacggccgtattaccacctaattaccgaagacgaacctaactaccaaagaaccacgtacttagtacttcgactaaatacgaaactacgactaggtagacggacgtaggtaacgacgtaccggtgttacggtagttaacgtttcgtagtacgtaaccgtaaacgttaaacgtaccggaacgggtaacggaccggttaaaccccggg

SEQ ID NO: 49110 - DNA, 887 bp, Homo sapiens
  misc_feature: GYAE6OF01CP2YE.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagtcttgggttttcctcgttgcttcttttaagaggtgtccagtgtcgaggtgcaggtcgtggtggtagtcggtgggggagcgtggtccaggccgtggggacgtccctgaacgtcctcttccgtggtcgcacggtcctcgtaggtacttcacttccttacgaggttcggttaccttaagtacggaacctaagttcggaccgtaacggttccggggtcccgacccgtaaggtccctaccggaagggtacccgggaaagggggtccgtaggggtaacgggttgggggtaccggacgttaagggtttaactaacgttaactaaagttaaggttagggtaaaaccgttaaagggggtaaaacggttaaaataaaccgttaatttaaaccggtttaagccgggtaactaaacgggtaaccccgttaccggggttaaacgggaaccccgggggtaaccttaaacgtttaccccggtaaacccttaaaccgtttaaccccggaaaacggtaaaccggttaaaccccaaaacccgttaaacccgaaaaaacgaacccggtaacccggttacgtttaacggtttaacgtttaaccgaaacgtaaaacgttacggaaaccgtacgtaccgtaggaagtacggtacgtacggaacggtaccgtacggtacgttacggtagttaaccgtttacggtagtaacggtaaaccgttaaacgttaacgtaccggaaaggggtaaccgtaaaaccccggg

SEQ ID NO: 49111 - DNA, 532 bp, Homo sapiens
  misc_feature: GYAE6OF01B95SC.52.77.G11.1.454.CMB.1.raw
  modified_base (263)..(263): a, c, t, g, unknown or other
  misc_feature (263)..(263): n is a, c, g, or t
  modified_base (276)..(276): a, c, t, g, unknown or other
  misc_feature (276)..(276): n is a, c, g, or t
  modified_base (289)..(289): a, c, t, g, unknown or other
  misc_feature (289)..(289): n is a, c, g, or t
  modified_base (303)..(303): a, c, t, g, unknown or other
  misc_feature (303)..(303): n is a, c, g, or t
  modified_base (343)..(343): a, c, t, g, unknown or other
  misc_feature (343)..(343): n is a, c, g, or t
  modified_base (349)..(349): a, c, t, g, unknown or other
  misc_feature (349)..(349): n is a, c, g, or t
  modified_base (411)..(411): a, c, t, g, unknown or other
  misc_feature (411)..(411): n is a, c, g, or t
  modified_base (445)..(445): a, c, t, g, unknown or other
  misc_feature (445)..(445): n is a, c, g, or t
  modified_base (467)..(467): a, c, t, g, unknown or other
  misc_feature (467)..(467): n is a, c, g, or t
tcagcgcagtacgacacgaccggtgctcgatttagctagtcactcaagggaaaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcctggggagtccctgagactctcctgtgcagcctntggattcaccttnagtgtctatgacntgcacgtgggtccncaggcctcgaggcaggggctgggagtgggtgctagttacntcatangataggaatagatatactagtgactagacgtcgtaggaacgggcacttacacctacttccanacgaccaacaccaacgaacacgctatattacganaatacgaacagcctagagacgngtagagacgacgtcgtgtgtattcgtgtacgacgtaacttagacgaacggtaggacgtaaccggg

SEQ ID NO: 49112 - DNA, 393 bp, Homo sapiens
  misc_feature: GYAE6OF01A4C54.52.77.G11.1.454.CMB.1.raw
  modified_base (304)..(304): a, c, t, g, unknown or other
  misc_feature (304)..(304): n is a, c, g, or t
  modified_base (382)..(393): a, c, t, g, unknown or other
  misc_feature (382)..(393): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtccgctcggtgcggacgtctggggccaagggaccacggtcagcgtctcctcagcctccaccaagggcccatcggtccttccccctggccaccctcctccaagacgcacctcgtgggggcacncgaacggccctgggctcgccgtggtcaacggactacttcctatacgatcgctgacgcgggctcggcaaggcgcatagnnnnnnnnnnnn

SEQ ID NO: 49113 - DNA, 383 bp, Homo sapiens
  misc_feature: GYAE6OF01ENNMI.52.77.G11.1.454.CMB.1.raw
  modified_base (265)..(265): a, c, t, g, unknown or other
  misc_feature (265)..(265): n is a, c, g, or t
  modified_base (367)..(383): a, c, t, g, unknown or other
  misc_feature (367)..(383): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtcgctcggtgcggacgtctgggccaagggccacggtcagcgtctcctcagcctccaccaacgggcccatccggtcttcccccngccaccctcctccaagagccacctctgggggcacagcggccctggctgcctggtcaggctactcctatacgatcgctgagcggcgtcggcaaggcgcatagnnnnnnnnnnnnnnnnn

SEQ ID NO: 49114 - DNA, 760 bp, Homo sapiens
  misc_feature: GYAE6OF01CTC3G.52.77.G11.1.454.CMB.1.raw
  modified_base (180)..(180): a, c, t, g, unknown or other
  misc_feature (180)..(180): n is a, c, g, or t
  modified_base (330)..(330): a, c, t, g, unknown or other
  misc_feature (330)..(330): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagtcttgggttttcctcgttgcttacgttttaagnggttgtccagtgtcaggtgcagtctggtggagtcgtgggggagtcgtggtccagccgtgggacgtccctgagctctccgtgtgcacgcctctggtacttccactttcagttcgtactatacgactagttcgcgtaccggttcgggtcccnccgtacggtcctacccggaagggcggaaacgggggtcctagggacgggttcggggtcggtaccttaaggtttaactattaccgaagtttagtaggtaagttaagggaaagttaaagtattaagtaacgttaagtcggtaactaacgttacccgtaccggtagggaaccgggtacccgttaacgttaccctaacccgttaactttacccgaaaagtaccggaaccctaaccgtaacccgaaaagaacccgtaaccgttccgttaagtttaacgtttacgaaacgtaaacgttacgaaccgtacgtaccgtaggaacgaggaccttagggaccggtaccgacggtacgttacggtacgtttaacgttacgttcggttaacgacgttaaaacgtttacgaccgtaacgggaacggtaacccggtaaacccggg

SEQ ID NO: 49115 - DNA, 623 bp, Homo sapiens
  misc_feature: GYAE6OF01AF7TR.52.77.G11.1.454.CMB.1.raw
  modified_base (263)..(263): a, c, t, g, unknown or other
  misc_feature (263)..(263): n is a, c, g, or t
  modified_base (308)..(308): a, c, t, g, unknown or other
  misc_feature (308)..(308): n is a, c, g, or t
  modified_base (344)..(344): a, c, t, g, unknown or other
  misc_feature (344)..(344): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaggtccctgagactctcctgtcgcagcctntggattcaccttcagttgtctatgactagtgcacgtcgggtcccnccgtaggcctcgaggcggaagggctgggaggtgggngtctagttatatcatagtgagtaggaagtaagtatatacgtagtcgacgtacgtaccgtcgtaggaacgggtcctaattccactacttaccgaacgaacgaacctaactaccgaaagaaccgtaccgtacgtttacgtaatttcgaactaaacgagtaaacgtacgcgtaaggacgagtcggtacggacgaacgtcggtacgtggttagttacttcgtagtacggtaaccgttaaacgttaacgtaccggaacgggtacgggtaacccgtaaacccggg

SEQ ID NO: 49116 - DNA, 1093 bp, Homo sapiens
  misc_feature: GYAE6OF01AWVJR.52.77.G11.1.454.CMB.1.raw
  modified_base (180)..(180): a, c, t, g, unknown or other
  misc_feature (180)..(180): n is a, c, g, or t
tcagcgcagtacgacacgaccggtgctcgatttagctagtcactcaaggggaaaggggggggagaggagcccagcactagaagtcggcggtgtttccattcggtgatcagcactgaacacagaggactcaccatgggagtttgggctgagcttgggttttcctcgttgcttcttttaagnggtgtccagtgtcagggtgcagcgtgggtggagtcggtggggggaggcggtggtccaggccgtgggggacggtccctggacgtaccttctccgtggtcgccaggtcccttcgtgggtactttccaaccctttcgaaggttgttaccttaattcgggaacctagttcggaccgtaaccgggtttccgggggggtaccccacccggtaacgggggtcccttacccgggaagggggtacccgggtaaaacgggggggggtcctttaggggggggaaacgggttttcggggggggttaacggggtacccttaaagggtttttaaacgtaacgttaccgtaaaaggtttaacggtttaggggtaaaaggtttaacggggggtaaaaaaggtttaaaacgggtaaattttaaacggtttaaaacccgtttaaaggttaccgggtaacccgtaaaacggggttaaccccggtttaccccggggttaaacgggggtaaaaacccggggggttcccccggtttaaaacgttttacccccggtaaaacccccgttttaaaccggtttttaacccccggaaaacggggttaaaacccggtaaaaccccttaaaaccccgttaaaccccggaaaaaccggtaaaacccgtaaccccggtttacggttttaacgggttttaacgtttttaaccggaaaccgtttaaaaacgttaacggaaaaacccgttaccgggtaacccgttaagggtaaaccggtaacggtacggttaaccggggaaaccgggtaaacccggtaaccggggtaccgtttacgggttaagtttaaacggtttacggttaacgggttaaccggtaaaccgtttaaaacgtttacggaaccgggtaaaccgggggtaacgggtaaacccggttaacccccgggggg

SEQ ID NO: 49117 - DNA, 369 bp, Homo sapiens
  misc_feature: GYAE6OF01DRF31.52.77.G11.1.454.CMB.1.raw
  modified_base (359)..(359): a, c, t, g, unknown or other
  misc_feature (359)..(359): n is a, c, g, or t
  modified_base (365)..(369): a, c, t, g, unknown or other
  misc_feature (365)..(369): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtcgctcggtgcggacgtctggggccaagggaccacggtcagcgtctcctcagcctccaccaagggcccatcggtcttcccctggcaccctcctccaagagcacctctggggcacagcggccctgggctgcctggtcaaggactacgttcatacgatcgctgagcggctggcaaggcncatagnnnnn

SEQ ID NO: 49118 - DNA, 830 bp, Homo sapiens
  misc_feature: GYAE6OF01E5EPT.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagtctgggttttcctcgttgctcttttaagaggtgtccagtgtcaggtgcagcgtggtggagtcgtgggggagcgtggtccaggccgtgggagtccctgacgacctctcctgtcgacaggtcccttgtggtaacttccaccttcgagtgtcctatcgaactagtcgccgtacggtcgggtcccaccgtacggccctccggagggtaccgaaagggggtccgttaggggtagggtcggggtacggacgtaagtttaagtaataccgtaagttaagttaggaacgtttaagggaaaagttaaaggaactttaaacgtaacgtttaagtaccggtaaacgaaccgggtaacccggttcccgggtaaggggtaaacccgggtcccgttaaaccgttacccctaaacccgttaaaccgtttaccgaaacggtaaaccgtaacccgtaaacccgtaacccgtaaaacgtaaaccccggtacgttacccgtttaacggttttaacgttaacggtaaacgtaaacgttacggaaacccgtaggtaaccccgtagtaacgggacgtccggtaagggaaccggtaccggtaccggtgtttaggtaacgttaacgttacgttcggaacggttaaacccgtaaacgtttaacggaccggtaaaccggggaaccggtaacccgggttaacccccgggg

SEQ ID NO: 49119 - DNA, 739 bp, Homo sapiens
  misc_feature: GYAE6OF01AYIU3.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatgggagtttgggctgagtcttgggttttcctcgttgcttcgttttaagaggtgtccagtgtcaggtgcagcgtggtgagtcgtgggggagcgtggtaccagcgtgggacgtcctgacgctctcgtgtgcagtcctgtggactttccaccttgagttgtaccttatcgactagtcgtaccgtcgttcgggtacccgaccgtacgggccttaccggaaggtccggtaaaggggtccgtggggtaacggttgggggtacgaccgttaaggtttacgtacttacgaaagtttagacggtaagtttaacggaaaggttaataacgtacttaacgtagtacgtcgtaacgtaaccgtccgggtagaaccgggtcctagttaacacctacgtttaccgaagaccgtaaccgaaaccgtccgaaagtaccgacgttaccgtaatttaacttacgaacgtaaatacggtaactcgtaaccgtaggaacgttaggaccgtaagggaaccgacccggtaggtacgttaggtttaagttaacctttcggacgttaacggaaacgtttaaaccgttaacgtaccggaacggggtaaaccggaaccgggtttaaaccccggg

SEQ ID NO: 49120 - DNA, 573 bp, Homo sapiens
  misc_feature: GYAE6OF01BXFMO.52.77.G11.1.454.CMB.1.raw
  modified_base (260)..(260): a, c, t, g, unknown or other
  misc_feature (260)..(260): n is a, c, g, or t
  modified_base (302)..(302): a, c, t, g, unknown or other
  misc_feature (302)..(302): n is a, c, g, or t
  modified_base (346)..(346): a, c, t, g, unknown or other
  misc_feature (346)..(346): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcctntggattcaccttcagtgtctatgacatgcacgtggggtcccnccaggcctccgaggcaaggggctgggagtgggtggctaggttanatcatatgatgggaaagtaagatagtactagtgacagacctcgtagaacgggccgtattccacctatttccaagacgacaactaccaagaacacgctagtatttgactaagtcgaacgtacgcctagagacgcgtaggacggacgacgggtcctggttagttattacgtcgtacggtacgtaaaccttaagtaccgtaaccgggaaggtaacccggtaaacccgggg

SEQ ID NO: 49121 - DNA, 637 bp, Homo sapiens
  misc_feature: GYAE6OF01CI6K8.52.77.G11.1.454.CMB.1.raw
  modified_base (176)..(176): a, c, t, g, unknown or other
  misc_feature (176)..(176): n is a, c, g, or t
  modified_base (266)..(266): a, c, t, g, unknown or other
  misc_feature (266)..(266): n is a, c, g, or t
  modified_base (272)..(272): a, c, t, g, unknown or other
  misc_feature (272)..(272): n is a, c, g, or t
tcagcgcagtacgacacgaccggtgctcgatttagctagtcactcaagggaaagggggggagaggagcccagcactagaagtcggcggtgtttccattcggttatcagcactgaacacagaggactcaccatggagtttgggctgagctgggttttcctcgttgcttcttttaagnggtgtccagtgtcaggtgcagctgggtggagtcgtggggggagcggtggtccagccgtggggacggtccctggacgactcctcctgtgcncgcctntggattccaccttcagtgtctatgacatgcacgtggggtccgccaggcctccgaggcgaaggggctgggaggtgggtggactagttatatcattagtagagtaggaagtaagattatactatcgacagtacgtccgtaggtaacgggccgtaacgttaccaaccctactttaccgaagaacgtaaccaacctaccgaaacgaacacgtactagttactttagaactaaacgtcgaacgtacgtacctaggaacgacgtacgtaggaacggacgtacgggtacttaggttgttaagttacgttggtaccgaacgttaacttaacgtaccgaacgggtaacggaaccggtaaccgggtacccccggg

SEQ ID NO: 49122 - DNA, 630 bp, Homo sapiens
  misc_feature: GYAE6OF01AHTQW.52.77.G11.1.454.CMB.1.raw
  modified_base (311)..(311): a, c, t, g, unknown or other
  misc_feature (311)..(311): n is a, c, g, or t
  modified_base (353)..(353): a, c, t, g, unknown or other
  misc_feature (353)..(353): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcgtggtttcgcgttagctctttaagaggtgtccagtgtcaggtgcagctggtggagtcgtgggggaggcgtgggtcccaggccgtggggacggtccctgagactctcctgtgcagcctctggatttcaccttcagttgtctatgacagtgctacgtcgggtccncgaggcctccgaggcgaagggctggagtggggtgctagttanatcatatggaagtggaaagtagtacgtatacgtatgacgtagaccgttccggaggacgggtccgtacttacgtaccctatttacccgagtaacgaccgaacctaccgaaacgtaacaccgtcgttaggttactttagaaccttaaagacgaacgtacgaccgttagaacgtagacgtgggacggtaaccgacggtacgttcgttggtaacgttcgttacggtcggtaacgtaaaccgtttaacgaccgggaaacggtacggaaccggtaaccccggg

SEQ ID NO: 49123 - DNA, 651 bp, Homo sapiens
  misc_feature: GYAE6OF01BVP6V.52.77.G11.1.454.CMB.1.raw
  modified_base (193)..(193): a, c, t, g, unknown or other
  misc_feature (193)..(193): n is a, c, g, or t
  modified_base (319)..(319): a, c, t, g, unknown or other
  misc_feature (319)..(319): n is a, c, g, or t
  modified_base (360)..(360): a, c, t, g, unknown or other
  misc_feature (360)..(360): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatgggagtttgggctgagctgggttttcctcgttgctctttaagaggtgtccagtgtcaggtncagctggtggagtcgtgggggagcgtggtccagcctgggacgtccctgagactctcctgtagcagcctctggactttccaccttcgagttgtaccttatcgacatcggactacgtcggggtacccnccaggtcctaccggaggcgaaggggcctgggaggttcgggngcgtagtttacagtcaagttatacggattagggaaataagtattaatacgtagtcgacagtacccgtcggtaggaacgggtcctaatttccgaacgttaacttccgaaagtacgactaacctacgaaacggtacacgtcttagttaattcgaacgtaaagtcgaaacgtacgtacctaggacgtaacgtcgtaggaacggataaaccgggtcttaagggtgttaactttcgggagtaacggttacgtaaacttaagtaccggaaacggttacgggaccctaaaacccgggg

SEQ ID NO: 49124 - DNA, 751 bp, Homo sapiens
  misc_feature: GYAE6OF01EIXFS.52.77.G11.1.454.CMB.1.raw
  modified_base (281)..(281): a, c, t, g, unknown or other
  misc_feature (281)..(281): n is a, c, g, or t
  modified_base (305)..(305): a, c, t, g, unknown or other
  misc_feature (305)..(305): n is a, c, g, or t
  modified_base (359)..(359): a, c, t, g, unknown or other
  misc_feature (359)..(359): n is a, c, g, or t
  modified_base (389)..(389): a, c, t, g, unknown or other
  misc_feature (389)..(389): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaggtccctgacgactctcctgtgcagcctctgacttccaccttcagtntctatgacatgcacgtcgggtccnccgaggctccgaggcggaaggggctgggaggtgggtggactagttatatcaatntagagtaggaacgtaagattaagtacttancggactaacggtaaccgttccggtaaggaaccggggtaccgtaatttaccccgaaccgttaacgtttaacccgaacggtaaacgtaaccctaaacccgttaaccgaaaaccggtaaaaccctaaccggtactttaacgtttaacgttttaacggaacctaaaaggttaaccggaaacgtaaccggttacccgttaaggaacggtaaccggtacgttaaccggggaaacgggtaacccgaaccggggttccgtttaagggtttacgtttaaacggtttaccgtacgggttaacgaaccggttaaaaccgttttaaccgtaccgggtaaaccgggaacgggtaaacccggtaaacccccggggg

SEQ ID NO: 49125 - DNA, 677 bp, Homo sapiens
  misc_feature: GYAE6OF01BSCBM.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggtttcctcgttgcttctttaagaggtgtccagtgtcgaggtgcagtctgggtggtagtcggtggggggaggtcggtggtccagccgtggggacggtccctgagacctctcctggtgcagcctcgtggtacttccaccttcagttcgtctagtgactatcgacgtacgttcggggtcccgtccgaaggtcctaccggagggcgaacgggggctgggaggttggggtgcgtaagttatatcatatgagtaggtaaagtaagattaatacgtagtgacctagtaccgtacggtaggtaacgggccgtacttacgtaacctacgtttaccgaacgtaacgtaaccaaccgtaccgaaacgtaaccgtacgtacgttacgttacgttacgaactaaagtacgaactacggactaggaagtacgacgtacgggacgaccggtacggtacgttcgttagttacgttacgtcgttacgtaacgttaacgttaacgtaaccggaacgggtaacgtaacccggtaacccccgggg

SEQ ID NO: 49126 - DNA, 935 bp, Homo sapiens
  misc_feature: GYAE6OF01EG5U6.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgcttcttttaaggaggtgtccagtgtcaggtgcagctggtggagtcgtgggggagtcgtggtccaggccgtggggacggtccctggacgtaccttcctccgtggtcggcctacggcccttacgtggtaacttttcccgaaccctttcgaaggttcgttaccttaagtggaacctagttcggacccgtaccggttcgggggtcccccgaccgaacggggtcccttaccccggaaggggacccggtaaaagggggggtccttaggggggaacgggtttcggggggtagggtaccttaagggttttactaacgttccgtaaagttaagttggaaaggtttaaggggtaaaagtttaaacggaatttaaacgtaacgttaggtcggaaccgtaacgggtacccgttacccggggtaacgggtaaaccggggtaccggtaacgtttacccgtaaacccgttaaccgttttaacccggaaacggttaaaccggtaaacccgttaaacccgttaaacccgtaaaaaccggtaaacccgtaaccggttaccgtttaacggtttaacgtttacggtaaaccgttaaacgttaaccggtaaaccgtaaccggtaccggtaacggtaacggtaacgtacggtaacgggtaaaccgggtaacccggtaaccgggttacggttacggtttagtttaacgttaccggttaggtaaccggtaaaccgttaaaccgttaacggtaaccggtaaacggggtaaccggtaaacccggtaaaccccgggg

SEQ ID NO: 49127 - DNA, 504 bp, Homo sapiens
  misc_feature: GYAE6OF01DPCCE.52.77.G11.1.454.CMB.1.raw
  modified_base (301)..(301): a, c, t, g, unknown or other
  misc_feature (301)..(301): n is a, c, g, or t
  modified_base (469)..(469): a, c, t, g, unknown or other
  misc_feature (469)..(469): n is a, c, g, or t
  modified_base (484)..(484): a, c, t, g, unknown or other
  misc_feature (484)..(484): n is a, c, g, or t
  modified_base (491)..(491): a, c, t, g, unknown or other
  misc_feature (491)..(491): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctggggggaggcgtggtccagcctgggaggtccctgagactctcctgtgcagcctctggattcaccttcagtgtctatgacatgcactgggtccnccaggctccaggcaaggggctgggagtgggtggcagttatatcatatgatggaagtaagatatactatgcagactcgtgagggccgattcacattccagagacactccaagacacgctgtatttgacaatgaacagcctgagagcgtgaggacacggctgtgtattcngtgacgtaacttaancgacggnggacgtaaccggg

SEQ ID NO: 49128 - DNA, 691 bp, Homo sapiens
  misc_feature: GYAE6OF01B6RV9.52.77.G11.1.454.CMB.1.raw
  modified_base (221)..(221): a, c, t, g, unknown or other
  misc_feature (221)..(221): n is a, c, g, or t
  modified_base (258)..(258): a, c, t, g, unknown or other
  misc_feature (258)..(258): n is a, c, g, or t
  modified_base (282)..(282): a, c, t, g, unknown or other
  misc_feature (282)..(282): n is a, c, g, or t
  modified_base (295)..(295): a, c, t, g, unknown or other
  misc_feature (295)..(295): n is a, c, g, or t
  modified_base (365)..(365): a, c, t, g, unknown or other
  misc_feature (365)..(365): n is a, c, g, or t
tcagcgcagtacgacacgaccggtgctcgatttagctagtcactcaagggaaagggggggagaggagcccagcactagaagtcggcggtgttccattcggtgatcagcactgaacacagaggactcaccatgggagtttgggctgagtcttgggttttcctcgttgcttcgttttaaggaggtgtccagtgtcaggtgcagcgtggtggagtcgtgggggngcgtggtccagccgtgggacgtcctgagctctcctgngcagtcctctggacttcgaccttnagtgtctatgacntgcacgtggtccccagtaggcctcgaaggtcggaagggtctgggaggtgggtagctaaggttactacgtnaagtagtaggagtaagggtaaactaagatttaacgactaatcgacgtaacggtccgtaccggtaggtacggcctaacgttccaaacctacgtttaccgaaagtacgaacctaaaccgtacccgaaaacggtaacctacgtccgttaaggttaactttaggaacctaaaggtaccgaaacgtcggaaccttaaggacggtaacgtcggtaacggaaggaacccgtacccgggttagtacggttaacggtttagtaccgttgggaccgtaaacgtttaaaccgtacggtaaccgtaaccggggaaggtaaaccccgttaaccccgggg

SEQ ID NO: 49129 - DNA, 641 bp, Homo sapiens
  misc_feature: GYAE6OF01C7X2H.52.77.G11.1.454.CMB.1.raw
  modified_base (384)..(384): a, c, t, g, unknown or other
  misc_feature (384)..(384): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgcttcttttaaggaggtgtccagtgtcaggtgcagctggtggagtcgtgggggagcgtgtccagccgtgggacgtccctgagcctctcctgtgcacgcctcgtggacttccacctttcagttgtacctagtgacatcggctacggtcgggtacccgccagggcctaccgagggccgaaggggctgggaggttggggacgactagttaatatacaattagngtagtagggtaaataagacttatacgtatggaccagtaccgtacgtaggaacgggacgtattaccacgtactttacaacgacgaaccaactaccaaacgaacgacgtacttagttactttacgaactaaagtacgtaacgtacgtaccgtaggaagacgacggtaggaaacgtaccgtacggtcgtacgttacgttagttacgtagttacgtacgtaaacttaacgaccgtaacgggaccggaaccgtaacccgggg

SEQ ID NO: 49130 - DNA, 754 bp, Homo sapiens
  misc_feature: GYAE6OF01CEYAW.52.77.G11.1.454.CMB.1.raw
  modified_base (254)..(254): a, c, t, g, unknown or other
  misc_feature (254)..(254): n is a, c, g, or t
  modified_base (320)..(320): a, c, t, g, unknown or other
  misc_feature (320)..(320): n is a, c, g, or t
tcagcgcagtacgacacgaccggtgctcgatttagctagtcactcaagggaaagggggggagaggagcccagcactagaagtcggcggtgttccattcggtgatcagcactgaacacagaggactcaccatggagtttgggctgagcttgggttttcctcgttgcttcgttttaagaggtgtccagtgtcaggtgcagctggtggagtcgtggggggagcgtggtccaggccgtgggagtccctgagctctccngtgcagcctcgagtacttccaccttcaggttctcctatggacctagtgtactacggtcgggtcccncgtaacgggcctcgagggcgaacgggggcttaggggacgggttggggtacgacgttaagtttaacggtattacggtaattatgggtaagttaggggaaaaattaacggtaattaacgttaacgtacgttgacgtaagggtacccgttacccggttaagggaacgggtaccgttacgttaccctaaccgttaactttaccgaaagtaacggaacctaaaccgtaaccgaaacgtaacctaccggtctacgttaattcgaaccgtaaaattcggaaacctacgtaccgtaggaacgtacggtaccgtagggtaaccggaccgtaacggtaccgttagggtaaccgtttaacgttcgggtacggttaacggtacccgttaaaacgtttaaccggaccggttaaacgggaacggggtaaccccgttaaaacccggggg

SEQ ID NO: 49131 - DNA, 649 bp, Homo sapiens
  misc_feature: GYAE6OF01B2EXQ.52.77.G11.1.454.CMB.1.raw
  modified_base (198)..(198): a, c, t, g, unknown or other
  misc_feature (198)..(198): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcggntggtggagtcgtgggggaggcgtggtccagccgtgggaggtccctgagactctcctgtgcacgcctcgtggtattcctaccttcagtgtctatgacatgcacgtcggggtcccgccgacggcctccgagggccgaaggggctgggaggtgggtggctaggttatagtcaagtatgtaagtaggaagtaagtaatatactatgacagtactacgtaggacggaccgtattcgaacctacgttaccaagaacgaccaacgtaccaaacgaaccacgtacttagttactttacgaactaaagtacgaaacgagtacccgtaggaacgtaacgtcgtagggaacggaccgtacggtacgttgttaacggtttattaaccggttggtacgtaaccggttaaaacttaacgtaccggaacggggtaacgtaaacccggtaaccgggttaccccccgg

SEQ ID NO: 49132 - DNA, 381 bp, Homo sapiens
  misc_feature: GYAE6OF01EZ1ET.52.77.G11.1.454.CMB.1.raw
  modified_base (371)..(381): a, c, t, g, unknown or other
  misc_feature (371)..(381): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtccgctcggtgcggacgtctggggccaagggccacggtcagcgtctcctcagcctccaccaagggcccatccggtcttccccctggccaccctcctccaagagcacctctgggggcacagcggccctgggctgcctggtcaaggacctacttcctcgtactgcgctgagcggctggcaaggcgcatagnnnnnnnnnnn

SEQ ID NO: 49133 - DNA, 612 bp, Homo sapiens
  misc_feature: GYAE6OF01CL0AG.52.77.G11.1.454.CMB.1.raw
  modified_base (218)..(218): a, c, t, g, unknown or other
  misc_feature (218)..(218): n is a, c, g, or t
  modified_base (251)..(251): a, c, t, g, unknown or other
  misc_feature (251)..(251): n is a, c, g, or t
  modified_base (299)..(299): a, c, t, g, unknown or other
  misc_feature (299)..(299): n is a, c, g, or t
  modified_base (312)..(312): a, c, t, g, unknown or other
  misc_feature (312)..(312): n is a, c, g, or t
  modified_base (322)..(322): a, c, t, g, unknown or other
  misc_feature (322)..(322): n is a, c, g, or t
  modified_base (349)..(349): a, c, t, g, unknown or other
  misc_feature (349)..(349): n is a, c, g, or t
  modified_base (354)..(354): a, c, t, g, unknown or other
  misc_feature (354)..(354): n is a, c, g, or t
  modified_base (358)..(358): a, c, t, g, unknown or other
  misc_feature (358)..(358): n is a, c, g, or t
  modified_base (361)..(361): a, c, t, g, unknown or other
  misc_feature (361)..(361): n is a, c, g, or t
  modified_base (380)..(380): a, c, t, g, unknown or other
  misc_feature (380)..(380): n is a, c, g, or t
  modified_base (386)..(387): a, c, t, g, unknown or other
  misc_feature (386)..(387): n is a, c, g, or t
  modified_base (393)..(393): a, c, t, g, unknown or other
  misc_feature (393)..(393): n is a, c, g, or t
  modified_base (424)..(424): a, c, t, g, unknown or other
  misc_feature (424)..(424): n is a, c, g, or t
tcagcgcagtacgacacgaccggtgctcgatttagctagtcactcaagggaaaggggggggagaggagcccagcactagaagtcggcggtgtttccattcggtgatcagcactgaacacagaggactcaccatggagtttgggctgagcggtcggtttcgcgtaggcgtctttaagaggtgtcagtgtcaggtgcagcgtggtggagtcgtagggggnggcgtcggtccagccgtggggcgtcccaggacnctctcctagtgcagctcgtggattctcttcaggtctctaatcgatatncgcgtcggtcccncgacggtccnccgaggcggaaggcctgggagtggcgntagtntacntangtgagtaggaatactatanaattgnngtaacncgtacgaggacgtctactacactactacganaacactaacgtaaccaactactaacgtcgttacgttatagtaacaacgtaacgaacgtgaacgtacgtaagtacgtacggaacgtacggaccggtacgtacggttgttaacgttaaggtacgtcggtaaaccggaacgttaaaccggtaggtacccggaaacggttaaccgggaaccccggttcccgg

SEQ ID NO: 49134 - DNA, 730 bp, Homo sapiens
  misc_feature: GYAE6OF01COQ6W.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcccgtggggacggtccctgacgactctccgtgtgcacgtcctcgtaggacttcaccttcagttgtactatgacatgacacgtgggtcccgcaggcctccgaggcgaaggggctgggacggtgggtggacgtagttatagttactagttatagtagtaagggtaaagtaaagtaactagttaaaccgttagtcgtaccgaaggtacccgttacccggttacggaaccgggggtaccgtaacgtttcccgaacccgttaacgttttacccgaagtaaccggaacctaacccgtaacccgaaaacgtaacccgtaaccggttacgttagtttaactttaacgtaacgaaacgttacgaaacgtacgtaccgttaggtaacggagtaccggtacggaacgggaccgtacgggtacgttgggttaggttaaccgttacggtaggttacgtaacggttaaacgtttacgtaacccggaaccgggtaccggaaccgggttaaccccggg

SEQ ID NO: 49135 - DNA, 648 bp, Homo sapiens
  misc_feature: GYAE6OF01BM1PQ.52.77.G11.1.454.CMB.1.raw
  modified_base (176)..(176): a, c, t, g, unknown or other
  misc_feature (176)..(176): n is a, c, g, or t
  modified_base (321)..(321): a, c, t, g, unknown or other
  misc_feature (321)..(321): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgctcttttaagnggtgtccagtgtcaggtgcagctggtggagtcgtgggggagcgtggtccagcctggggacgtccctggagactctcctgtgccagcccttcgtggacttccacctttcgagttgtctatcgactatgcctacggtcggggtcccncgaggcctaccggaggccgaaggggtctagggacggtggggtgctaagttatatcgaattacgtagagtaagggtaaagtaagtataagtacctagtcgacaaggtccgtaccggtagaacgggaccgtacgttaccaaccgtaactttaccgaaggtaactaaccaaccgttaacccgaagaacccgacgtacttagtactttacgaactaagtacgaactacgtacctaggacgtagtccgtaggacgacgtacggcgttagtacgtaagttccgtagtacgaacgtaacgttactaggaacgggtagtaacccggtaacccggg

SEQ ID NO: 49136 - DNA, 695 bp, Homo sapiens
  misc_feature: GYAE6OF01CE7BV.52.77.G11.1.454.CMB.1.raw
  modified_base (286)..(286): a, c, t, g, unknown or other
  misc_feature (286)..(286): n is a, c, g, or t
  modified_base (298)..(298): a, c, t, g, unknown or other
  misc_feature (298)..(298): n is a, c, g, or t
  modified_base (376)..(376): a, c, t, g, unknown or other
  misc_feature (376)..(376): n is a, c, g, or t
tcagcgcagtacgacacgaccggtgctcgatttagctagtcactcaaggggaaagggggggagaggagcccagcactagaagtcggcggtgtttccattcggtgatcagcactgaacacagaggactcaccatggagtttgggctgagcgtgggtttcctcgttgctctttaagaggtgtccagtgtcaggtgcagtcgtgggtggagtcggtgggggaggcgtggtccagtccgtggggacgtcctgagctctcctagcgcagccttcgtggtattcctaccttnagttcgtctaangactatgccacggtcggtccgccaggtcctccgagggacgaaggggctgggaggtgggtggacctaggttatacgtanaagttataggaattaagggaaattaaaggatttaactacttagtcgacgtacgacgttaccgggtacggaagggtcccggtattaccgaacccttaacgtttacgaacgtaacaccgtaaaccgtaaccgaaaacggttaaccaacgttaccttaaggtttaacttcggtaaacgtaacgttaggaaaaccgtccgtaaccgtaggaacggtacgttcggtaacggacggaccggtacgtacgttacggtagttacttgtacggttaggaaccgtaactttaacgaccggaacggtaaccgggtacggtaaaccccggg

SEQ ID NO: 49137 - DNA, 873 bp, Homo sapiens
  misc_feature: GYAE6OF01CIVJL.52.77.G11.1.454.CMB.1.raw
  modified_base (260)..(260): a, c, t, g, unknown or other
  misc_feature (260)..(260): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggaggcgtggtccaggccgtgggacggtccctgagctcctccgtgngcacgcctgtcggatttccacctttgagttcgtacttagtcgactagtcgacctacggtcggggtccccgccgtacgggtccctacccggaggggaccggaaaggggggtccgttagggggagggttcgggggtaggtacctaaggtttacttaagtaccgtaagttaggtacggtaaggtttaagggaaaggtaaaggttaaacttaagttaaccgttaagttacgggaccgtaacggtaacccggtttaccggtagggtaaaccggggtacccgttaacgtttacccgtaaccccttaactttacccggaacggtaaaccgtaaacccgtaaacccgttaaacccgaaaccggtaaacccgtaaccggtaccgtttaacggtttaacgtttaacgaaaccgtaaagtaaccggtaaaaccgtaccggtacccggtaaacgggtaacggtacggtaccggttaacgggaaccgggtaaccggtaacccgggttacgttacgggtttaaggtttaaccgtttaacgggttacgggttaccgtaacccggttaaaacgtttaaccggtaaccgggtaaccgggtaaacggggtaaaccccggtaaaccccgggg

SEQ ID NO: 49138 - DNA, 647 bp, Homo sapiens
  misc_feature: GYAE6OF01EDHN6.52.77.G11.1.454.CMB.1.raw
  modified_base (263)..(263): a, c, t, g, unknown or other
  misc_feature (263)..(263): n is a, c, g, or t
  modified_base (291)..(291): a, c, t, g, unknown or other
  misc_feature (291)..(291): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgacgactctcctgtgcagcctntggattccaccttcagttgtctatgacntcgctacgtcggggtcccgccgaggcctacccgaggcgaaggggctagggagtgggtgctagttatatcaatagtgataggaaagttaagattaatacgtatcgactaagtacgtccggtaggaacgggccgtacttaccgaaccttacttaccgaagaacgaacctaacgtaccaaagaacacgtcttagttactttagaactaatacgaacgtacgtacctaggaagtacgcgttaggaacggtaccgacgggttcgtaacggtttgttaactttaccggtaggtacggtaaacccgttaaacgtttaaacgtacccggaaacggggtaccggaacccggttaaaccccggggg

SEQ ID NO: 49139 - DNA, 747 bp, Homo sapiens
  misc_feature: GYAE6OF01C52GT.52.77.G11.1.454.CMB.1.raw
  modified_base (185)..(185): a, c, t, g, unknown or other
  misc_feature (185)..(185): n is a, c, g, or t
  modified_base (359)..(359): a, c, t, g, unknown or other
  misc_feature (359)..(359): n is a, c, g, or t
  modified_base (385)..(385): a, c, t, g, unknown or other
  misc_feature (385)..(385): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggtagtttgggctgagtcgttggggttttcctcgttgtcttacgttttaaggnggttgtccagttgtcgaggtgcagtcgtggggtaggacggttcgggtggggggacgtccgggtcggtcccgaggtcccggttggggacggttcccgtaggacgtaccttccgtccgtggcgaccgacgtcctaccgtggtacttccgtactttccgagttcgtactagttcganagtcgaccgtacgttcggggtacccncgacggtccgtaccgaggacggacgggtcgtagggtacgggttgggacgtacgtaagttctacgtactaaggttagtacggtaagtaagggtaaacgtaagaagtttactaacgtatcggaacgtacggtaccggttaccggaacggaacgggtaccgtaacttaccgtaaccgttaacttacgaaacgaaccgaaccgtaaccttaaccgaaacgtaacccgtacgtactttagtaacgttagaacctaagaccgtaacgtacgtaccgtaagacgagacgtaggaccgacgtacgtgttagtgttattcgacggtacgtaacgtaactaacgacggaacggtacggtaacgtaccccggg

SEQ ID NO: 49140 - DNA, 1086 bp, Homo sapiens
  misc_feature: GYAE6OF01BIZKF.52.77.G11.1.454.CMB.1.raw
tcagcgcagtacgacacgaccggtgctcgatttagctagtcactcaagggaaaggggggggagaggagcccagcactagaagtcggcggtgtttccattcggtgatcagcactgaacacagaggactcaccatgggagtttgggctgagtcttgggttttcctcgttgtcttcgttttaaggaggttgtccaggttgtcagggtgcgaggtcgttggggtggaggttcgggtgggggggaggtcggttcgggtaccaggtcccggtagggggacggttccccgtggacgtaccttccgtccgttggtacgcctacggtcccttcgttacgggtaactttcctaacccgttttgaacggtttcgttaccttagttacggacctagtcggtacctaaccgggttccggggggttccccaccggtaacgggtccccgttacccgggaacggggtaccgggtaacgggggggtccgttaggggggaacggggttcggggggttacggtaccggtttaaggtttaacgttacgttaacgtaaagtttacgggttaaggtaagggtttaaagggtaaaaggttaaacggtaagtttaacgtttaaaccgtaaggttaccggaacggtaaaccggttaccccgttaaccggggttacgggtaaaaccgggggttaccccttaaaccgttttaacccgtaaacccgttttaaccgtttaacccggaaacggtaaacccgttaaacccctaaaacccgttaacccggaaaaccgtaaaccggtaaccggtttacgtttaacggtttaaacgttttaaccggaaaccgttaaaagtacccgggttaaaaccgtacccggggttaacccggttaagggaaaccgggtaaccggttaccgggaaaaccggggtaaacccggggtaaccggttacccgggttaaccggttttagggtttaaccggttttaaaccggtttacccgggttaagggttaaacccggttaaacccgggttttaaaaccgtttaaacccggggtaaacccggggttaaacgggggaaacccggggttaaaccccccgggttaaaccccgggggg

SEQ ID NO: 49141 - DNA, 709 bp, Homo sapiens
  misc_feature: GYAE6OF01C0Q6V.52.77.G11.1.454.CMB.1.raw
  modified_base (305)..(305): a, c, t, g, unknown or other
  misc_feature (305)..(305): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggccgtgggagtccctggagactctcctgtgcagcctctggattccacttcagtgtctatgacatggcacgtcgggtccnccaggcctccgaggcgaaggggctgggacggtggggtgctagttatagtcatatgataggaaagtaagatatactagtgacaagtaccgtaccggtaggaacgggccgtaagttaccacccttacgtttaccgaacgtacgaacctaaacctacccgtaaacgaacctaaccgtcgtaacgttaacgttttaggaaaccgtaaagttaacggtaaacgtacggtacccgttagggaaaggcggtaaccggtaggtaaaccggggaccgtaaccggggtaccgttacgggtttagggtttaacgttttaacccggttacgggttaacggtaaccggttaaaccgtttaaacgttacccgggtaaaaccggggtaaccggggtaaacccggtaaaacccccggggg

SEQ ID NO: 49142 - DNA, 756 bp, Homo sapiens
  misc_feature: GYAE6OF01C4678.52.77.G11.1.454.CMB.1.raw
tcagcgcagtacgacacgaccggtgctcgatttagctagtcactcaagggaaagggggggagaggagcccagcactagaagtcggcggtgttccattcggtgatcagcactgaacacagaggactcaccatgggtagtttgggctgagtcttgggttttcctcgttgcttacttttaaggaggtgtccaggtgtcgagggtgcaggtcgtgggtggaggtcggtgggggggacgtcggtggtccgaggtcccgtaggggacgtccctggacgtaccttcgtccgtggtacgccgtacggtcccttggtcggtaactttccccgtaaccgttttcgaaggttcttactaagtcgaacctagttcggccgtaaccgggttcggggtaccccaccgtagggtccctacccgggaaggggtaccggaagggggtcttaggggacggttggggtacgacttaggttacatacgtaagtgtaggagtaagggaaagtaatactagtactagtcggacctaggtacccgtcggtagggaaccggtctacgttaccacgttacttacgaagaacgacctaactaaccgaaacgaccgtacgtacgttagttacttagaacgttaaagtacgaacgtcgacgtgaacgtacgacgtacgggaacgtaccgtcgggtacttaggtaagtttaactacggtacggtaacgtacggttaaaacttaccggacggtaaaccgggtaccggtaaaccccggttacccggg

SEQ ID NO: 49143 - DNA, 589 bp, Homo sapiens
  misc_feature: GYAE6OF01BBS5W.52.77.G11.1.454.CMB.1.raw
  modified_base (330)..(330): a, c, t, g, unknown or other
  misc_feature (330)..(330): n is a, c, g, or t
  modified_base (374)..(374): a, c, t, g, unknown or other
  misc_feature (374)..(374): n is a, c, g, or t
  modified_base (381)..(381): a, c, t, g, unknown or other
  misc_feature (381)..(381): n is a, c, g, or t
  modified_base (442)..(442): a, c, t, g, unknown or other
  misc_feature (442)..(442): n is a, c, g, or t
  modified_base (467)..(467): a, c, t, g, unknown or other
  misc_feature (467)..(467): n is a, c, g, or t
  modified_base (472)..(472): a, c, t, g, unknown or other
  misc_feature (472)..(472): n is a, c, g, or t
  modified_base (510)..(510): a, c, t, g, unknown or other
  misc_feature (510)..(510): n is a, c, g, or t
  modified_base (528)..(528): a, c, t, g, unknown or other
  misc_feature (528)..(528): n is a, c, g, or t
  modified_base (562)..(562): a, c, t, g, unknown or other
  misc_feature (562)..(562): n is a, c, g, or t
tcagcgcagtacgacacgaccggtgctcgatttagctagtcactcaagggaaaggggggggagagtagcccagcactagaagtcggcggtgtttccattcggtgatcagcactgaacacagaggactcaccatggagtttgggctgagcttgggttttcctcgttgcttacttttaaggaggtgtccagttgtcaggtgcagcgtgggtggagtcgtgggggagcgtggtccagccgtgggacgtccctggacgtactcctctggtagcagtcctgtggactttccacctttcagttcgtctatgacctatcgacacggtcgggtccccncgacggcctccgagggcaaggggctgggaggtggtagctaggtnatcatangtagtagggaaataagatatacagtcgactagtaccgtcgaggaacggcctattcaacctntacgaagacaccaactaccaagacncgttntagtacttgaactaagtcgaactacgcgtagaagacgngtaggacgacgtcgggtntagttagttactcggttagaccgaacttaaacgngtacgacggaacgcggtaaaccccggg

SEQ ID NO: 49144 - DNA, 731 bp, Homo sapiens
  misc_feature: GYAE6OF01DZLX3.52.77.G11.1.454.CMB.1.raw
  modified_base (297)..(297): a, c, t, g, unknown or other
  misc_feature (297)..(297): n is a, c, g, or t
tcagcgcagtacgacacgaccggtgctcgatttagctagtcactcaaggggaaagggggggagaggagcccagcactagaagtcggcggtgtttccattcggtgatcagcactgaacacagaggactcaccatgggagtttgggctgagcttgggttttcctcgttgcttacttttaaggaggtgtccagtgtcaggtgcagctgggtggagtcgtggggggagcggtggtccaggccgtggggacgtccctagacgtactcctccgtgtgcagccttcgtggtattccgtaccttnaggtttgtaccttatcggaactagttcggacctaccgggttcggggtccccgaccgtagggtcccctaccggaaggggtaccggaacggggggtccttaagggggagggtttcggggggtagtacgtaaggttttaactacgtactaagttagtaggagtaagggtaaaagtaagtattacgttactagtgactaacgtacgtacggtacggacgggtactacttacctacttacgttaccgaagtacactaacctaccgaaacgaacctacgtacttacggttaattacgtaactaagtacgtaaacacgtacgtacggagtaccggtgtacggaggtaccgtacggtacgttcggttaagttattacggtaggttacgtaacgttaaacttaacggacggtaaccgggtacggtaaccggtaaaccccgggg

SEQ ID NO: 49145 - DNA, 655 bp, Homo sapiens
  misc_feature: GYAE6OF01B7372.52.77.G11.1.454.CMB.1.raw
  modified_base (263)..(263): a, c, t, g, unknown or other
  misc_feature (263)..(263): n is a, c, g, or t
  modified_base (303)..(303): a, c, t, g, unknown or other
  misc_feature (303)..(303): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggaggcgtggtccagcctggggagtccctgagactctcctgtgcagcctntggattcaccttcagtgtctatgacatgcacgtgggtccnccgaggcctaccgagggacgaacgggggctagggacggtggggtggactaggtttactatcaattatgataggaagtaagatatactatgcaagtactccgtaggaacgggccgtattccaacctaactttaccgaagtacgaaccaaactaccaaagaaccaccgtacttagttatttacgaactaaatacggaaactacgaccgttaagacggtacgacggtacggaacgggtaccgaacgggtaccgttaggttaggttaactttaccggttaggttaacggtacccgttaaaacgtttaacgtaacccggtaaccgggtaacgggtaaacccggttaaacccccgggg

SEQ ID NO: 49146 - DNA, 675 bp, Homo sapiens
  misc_feature: GYAE6OF01EDGDK.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatgggagtttgggctggagtcgttgggttttcctcgttgcttcgttttaagaggttgtccagtgtcaggtgcagcgtgggtggaggtcggtggggggagtcggtggtccaggccgtggggacggttccctggacgtaccgtcctccgtggtcgccgtacgtcccttcgttaggactttcctaccttcgagttgtactatcgactatcgcacggttcgggcccaccgaggccgtccgagggcggaaggggtcgtgggaggttgggcgctaagtttacatctaagtgaggtagtagggtaaatagtaatatactagtgacgtaggtaccgtcggaggtaaccggaccgttataccctaccttattaccgaaggtaacaacctaaccgtaaccgaaagaccgtaccgttgttaagtttagtaacaacgaaagttaccgaaacgtacgtacctagggactaggcggtaggacgtaccgcgtgttaggttagtacttcgtagtacggaaccttaacgtacgaaccggaggtaaccggtaccgtacccggg

SEQ ID NO: 49147 - DNA, 727 bp, Homo sapiens
  misc_feature: GYAE6OF01B1QXH.52.77.G11.1.454.CMB.1.raw
  modified_base (180)..(180): a, c, t, g, unknown or other
  misc_feature (180)..(180): n is a, c, g, or t
  modified_base (266)..(266): a, c, t, g, unknown or other
  misc_feature (266)..(266): n is a, c, g, or t
  modified_base (428)..(428): a, c, t, g, unknown or other
  misc_feature (428)..(428): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcgtggttttcctcgttagctcttttaagaggtntccagtgtcaggtgcagctgggtggagtcgtgggggagtcgtggtccagcctgggagtccctgagacctctcctgtgcagcctcgnggtattcaccttcagttgtctatcgacattgcctacgtcgggtccccgcgtaggccctaccgaggaccggtaacgggggtcctaggggtaggttcggggtacgacgtaacggtttatacgtacctagtacgtgaattagggaaacttagaattactacttanggtactacgaccgttaccggaggaaccgggtccgtaattacccaacgttacgtttacccgaaggaaccaacctaaccgaaccgtaaacgaaaccgtaccggtacttacggtaactttaacggactaaaacgtgtaaaccgacgtccgttaaggaacgttcggacgttaaacggacgggtaaaccgtacgggtacgttcgggttacgtttaaacgtttccgaacggttacggtaacccgttaaaccgtttaaccgttaacgggaacccggggtaaacgtaacccggtaaacccccggggg

SEQ ID NO: 49148 - DNA, 640 bp, Homo sapiens
  misc_feature: GYAE6OF01ECX8T.52.77.G11.1.454.CMB.1.raw
  modified_base (178)..(178): a, c, t, g, unknown or other
  misc_feature (178)..(178): n is a, c, g, or t
  modified_base (290)..(290): a, c, t, g, unknown or other
  misc_feature (290)..(290): n is a, c, g, or t
  modified_base (294)..(294): a, c, t, g, unknown or other
  misc_feature (294)..(294): n is a, c, g, or t
  modified_base (309)..(309): a, c, t, g, unknown or other
  misc_feature (309)..(309): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgcttacttttaagnggtgtccagtgtcaggtgcagctgggtggagtcgtgggggagcgtggtccagcctggggacgtccctgagacctctctgtgcagcctcgtggattccaccttgagtgtctangacntgccagtcgggcccncgaggtcctccgaggccgaaggggtctagggagtggggtcgactagttatatactaatagtggaagtagggaaattaagattaatacgtagtgactaggtaccgtccgtaggaacggcctattaccactacgttacgaagaacgaaccaacctaccaaacgaacacgtcttagttacttagaacctaaagtacgaaacgtacgtacctaggaacgacgtacgtaggtaacgaccgtacggtacgttacgttacgttaacgttccgttaggtaccgttaaacgtaaacctttaacggaccggtaacgggtaaccggaaccgtaaacccgggg

SEQ ID NO: 49149 - DNA, 659 bp, Homo sapiens
  misc_feature: GYAE6OF01B5231.52.77.G11.1.454.CMB.1.raw
  modified_base (160)..(160): a, c, t, g, unknown or other
  misc_feature (160)..(160): n is a, c, g, or t
  modified_base (174)..(174): a, c, t, g, unknown or other
  misc_feature (174)..(174): n is a, c, g, or t
  modified_base (178)..(178): a, c, t, g, unknown or other
  misc_feature (178)..(178): n is a, c, g, or t
  modified_base (187)..(187): a, c, t, g, unknown or other
  misc_feature (187)..(187): n is a, c, g, or t
  modified_base (191)..(191): a, c, t, g, unknown or other
  misc_feature (191)..(191): n is a, c, g, or t
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (236)..(236): a, c, t, g, unknown or other
  misc_feature (236)..(236): n is a, c, g, or t
  modified_base (262)..(262): a, c, t, g, unknown or other
  misc_feature (262)..(262): n is a, c, g, or t
  modified_base (272)..(272): a, c, t, g, unknown or other
  misc_feature (272)..(272): n is a, c, g, or t
  modified_base (278)..(278): a, c, t, g, unknown or other
  misc_feature (278)..(278): n is a, c, g, or t
  modified_base (285)..(285): a, c, t, g, unknown or other
  misc_feature (285)..(285): n is a, c, g, or t
  modified_base (290)..(290): a, c, t, g, unknown or other
  misc_feature (290)..(290): n is a, c, g, or t
  modified_base (305)..(305): a, c, t, g, unknown or other
  misc_feature (305)..(305): n is a, c, g, or t
  modified_base (310)..(310): a, c, t, g, unknown or other
  misc_feature (310)..(310): n is a, c, g, or t
  modified_base (342)..(342): a, c, t, g, unknown or other
  misc_feature (342)..(342): n is a, c, g, or t
  modified_base (483)..(483): a, c, t, g, unknown or other
  misc_feature (483)..(483): n is a, c, g, or t
  modified_base (494)..(494): a, c, t, g, unknown or other
  misc_feature (494)..(494): n is a, c, g, or t
  modified_base (514)..(514): a, c, t, g, unknown or other
  misc_feature (514)..(514): n is a, c, g, or t
tcagcgcagtacgacacgaccggtgctcgatttagctagtcactcaaggggaaaggggggggagaggagcccagcactagaagtcggcggtgtttccattcggtgatcagcactgaacacagaggactcaccatgggagtttgggctgagcgtggtttcncgtagctcttaagnggtntcagtgtcnggtncagntgggtggcgnggtggggagcgtggccagcgtgggacgtccngacgctctctgcgcagtcctcgtggnttccaccttntgtgtntatgatntcgcnggttcgggccaccgnggccnccgaggcgaaggggcgtgggagggtgggagtnaaggttatctatattagaggtaagtaagggtaaattaaatagtaaaccctttaatggtaacgactaacgggtaccgtaccggttaagccggtacgtacttactaccgtacttacgaacgaagaaccaacaactaaaccganaccgtacgttnttaacgttaacaaacgtaanacaacggacctacggtaaggcgaacgcgtaaggaccggtaacgaccggttcgtacggtttagtaacgtttaccgacggttaacgttaacgttaaattaaccggttaaaccggaacgggtaagggtaaaccccggtaaccccgggg

SEQ ID NO: 49150 - DNA, 704 bp, Homo sapiens
  misc_feature: GYAE6OF01ETJ7J.52.77.G11.1.454.CMB.1.raw
  modified_base (303)..(303): a, c, t, g, unknown or other
  misc_feature (303)..(303): n is a, c, g, or t
  modified_base (448)..(448): a, c, t, g, unknown or other
  misc_feature (448)..(448): n is a, c, g, or t
  modified_base (686)..(686): a, c, t, g, unknown or other
  misc_feature (686)..(686): n is a, c, g, or t
tcagcgcagtacgacacgaccggtgctcgattttagctagtcactcaaggggaaaggggggagaaggacgcccagtccactagaaagtcggccggtggtttccattcggtgatcagcactgaacgacaggaggacgtcaccattgggagtttggggctggagcgttgggtttttcctcggttgtccttactttttaagaggttgtccgagtgtcagggtgcagtcgtgggtggtaggtcggtgggggagcgtggtccgagtccggtgggacggttccctgagacctcgtcctgtgcacgcctnagtatttcgtaccttcagttcgtcgtatcgactagtcgtacgacgtggggtccctcgaggctacggaggacggaagggctgggacggttggtggactaagttagatcgaatagtagtagtaggaaagtaagatttaagacttagngacgtacgtaacggtacgtaggaaaccggtcgtaacttaccgtaacgttacgttaccggaagtaaccggaacctaacgtaacccgaaagtaaccgtacgtatttaaggttactaaggaaccaaagtaccggaaatcggtaccgtaaggagacgtcggaaggaccgtaagggacggttggttcggttagttacgtacgttggtaacggtaacgtaaaccgttaaggacggtaaacgggngtaaccggttaacccggg

SEQ ID NO: 49151 - DNA, 819 bp, Homo sapiens
  misc_feature: GYAE6OF01D1RY6.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggaggtcgtgggggagtcgtggtccagccgtggggacgtcccctggacgaccttccgtccgttggtcgccacgtcccttcgtaggtactttacccgtaacccgtttcgaaggtttcgttaccttaagttacggacctaagttcggtaccgtaaccggtttccgggggtccccgaccgtaaccgggtcccgttacccggaacggggaccggaaacggggggtccgttgggggtaagggttcgggggtggaaccgttttaaggtttacttaacgttacgtaaagtttagtaggttaagttaaggggaaaagtttaaaggtaacttaaagttaaccgttagtcggaactaacggtaccgttaccggtaagggaaaccgggtcccgtaactttacccgaaacctttacgttaccgaaagtaaccgaaacctaacctaccgaaacgtaccacggttctagtttacgttacgaacttaaacgacgtaaaccgacgtaccgtaagacggtacgtaccggtaggaaccggaccgtaacggttccgttaaggttacgttaacgttcgtaggtacgtaacgttaaacttaacggtacgaacgggtaccgaacggttaacccccggg

SEQ ID NO: 49152 - DNA, 739 bp, Homo sapiens
  misc_feature: GYAE6OF01A8AU6.52.77.G11.1.454.CMB.1.raw
  modified_base (316)..(316): a, c, t, g, unknown or other
  misc_feature (316)..(316): n is a, c, g, or t
  modified_base (411)..(411): a, c, t, g, unknown or other
  misc_feature (411)..(411): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcgtgggggaggcgtggtccagccgtggggagtccctgacgtactctcctgtgcacgtcctctggacttccaccttcagttgtctatgactagtgcacgtcgggtccnccgaggcctccgaggcgaaggggtcgtgggaggtgggtggactaggttatatactagtatggaagttagggaaagtaagtaacgttataaacgtntacggactaacgtacccgttccggtaacgggtaacgggtcccggtaactttacccgtaaacccgttacgtttaccgaaacggtaacgaaccctaaaccgtaaccgaaaccggtaaaccgaccgtacgtttaacggttaagttttaccgaaacgttaaacgtacggtaaaccgtaccggtacccgttaagggacggtacggtaaccggtacggtaaccgggaccgtaaccgggtcgttacggttagttacggtttacgtacggttacgtaaaccgttaaacgttaacgtaaccggtaacgggtaaacggtaacccggtaacccccgggg

SEQ ID NO: 49153 - DNA, 696 bp, Homo sapiens
  misc_feature: GYAE6OF01DSYZK.52.77.G11.1.454.CMB.1.raw
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (342)..(342): a, c, t, g, unknown or other
  misc_feature (342)..(342): n is a, c, g, or t
  modified_base (383)..(383): a, c, t, g, unknown or other
  misc_feature (383)..(383): n is a, c, g, or t
  modified_base (448)..(448): a, c, t, g, unknown or other
  misc_feature (448)..(448): n is a, c, g, or t
tcagcgcagtacgacacgaccggtgctcgatttagctagtcactcgaagggaaagggggggagaggagcccagcactagaagtcggcggtgttccagttcggtgatcagcactgaacacagagactcaccatggagttggctggagtcgttggtttcctcgttgcttacgtttaagaggtcgtccagtcgtcgaggtcgcgagcgtggtcggagtccgggtaggggnggtccgtggtccgngtccggtgggacggtccctaggactaccgttctccgtggtgcctaacgtccgttcgtacggtacttcctaccgttgacgttcgttactaagtcgaacctgnggtacctggccggttacccgcgtacggcctaccggaagggngtacgggcgtagggtggtcggagtactagtacgtgacgatagtaggataagggaactagtactanacgtaatcgacgtagtaaccgtcggacgacggtaccgttaccgtaccgtaacttacgttaccaacggttacgaaaccgtaccgtaaacggaactaacgtacgtacgttagtacgttaacggaactaagtacgaacgtaaccgtagaagacgacgtagtacggaaccgaccgtaaggtctggttaagtaccgtagttacgtagaacccggttaattacggacggtaacgacggtaacccggtacccggg

SEQ ID NO: 49154 - DNA, 752 bp, Homo sapiens
  misc_feature: GYAE6OF01CQRG7.52.77.G11.1.454.CMB.1.raw
  modified_base (183)..(183): a, c, t, g, unknown or other
  misc_feature (183)..(183): n is a, c, g, or t
  modified_base (309)..(309): a, c, t, g, unknown or other
  misc_feature (309)..(309): n is a, c, g, or t
  modified_base (330)..(330): a, c, t, g, unknown or other
  misc_feature (330)..(330): n is a, c, g, or t
tcagcgcagtacgacacgaccggtgctcgatttagctagtcactcaaggggaaagggggggagaggagcccagcactagaagtcggcggtgtttccattcggtgatcagcactgaacacagaggactcaccatggagtttgggctgagcgttgggttttcctcgttgcttacgttttaaaggnggtgtccagtgtcaggtgcagctgggtggagtcgtgggggagcgtggtccagccgtggggacgtccctgacgtctctcctgcgcacgtcctgtaggacttccgacctttgagttctctatcgaacngtcgactcggtcggggtcccncgacggcctaccgaagggtcggaaggggtctaggggtagggtcgggtcggtactaaggtttactactacgaagttaggtaggtaagtaagggtaaagttaacgtaattaacgttaacgttaacggtcgtaacccgtaaggttacccggttacgggtaacgggtaaccgggtaccgttaacgttacctaaacccgttacgtttaaccgaaacgtaaccgtaaccgtaaaccgtaaccgaaacgtaaccgtaacgttacgttaagttacgtttacgaactaaacgtacgaaacgacgtacgtaagacggacgtacggtacggacggtacgtacggtcgttacggttagttaacttacggtacgttaacggtaacgttaaaccgttaacgtacggtaacgggaacggtaacccggtaaccccggg

SEQ ID NO: 49155 - DNA, 737 bp, Homo sapiens
  misc_feature: GYAE6OF01AZ4PF.52.77.G11.1.454.CMB.1.raw
  modified_base (308)..(308): a, c, t, g, unknown or other
  misc_feature (308)..(308): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggacgtccctgagctctctgtgcagcctgtgattccaccttgagttgtactatgactgtcgctacgtcgggtcccnccgtaggcctaccgaggacggaacggggctagggaggttggggtcgacgtaagtttacatcgtaagttagtaggaagttagggaaagttaataagttaagttaccgtaagtcggaactaacggtacccgtaccggtaacgggaacgggtaccgtaacgttccctaaacccgttacgtttaccgaacgtaacgtaacctaaccgttaaccgaaacgtaacgtaccggttacgttagtttaacgttacgtaacgtaaacgttacggaacctaacggtaccgttaaggaacggtagtaccggtaaggaaccggtaccgaacgggttcgttacggttaacgtttaacgttccggtaggtttaaccggtaaaccgtttaaacgttaacggtacccgggtaaacgggtaaccggtaacccggttaaaccccgggg

SEQ ID NO: 49156 - DNA, 832 bp, Homo sapiens
  misc_feature: GYAE6OF01E1CWD.52.77.G11.1.454.CMB.1.raw
  modified_base (178)..(178): a, c, t, g, unknown or other
  misc_feature (178)..(178): n is a, c, g, or t
tcagcgcagtacgacacgaccggtgctcgatttagctagtcactcaagggaaaggggggggagaggagcccagcactagaagtcggcggtgtttccattcggtgatcagcactgaacacagaggactcaccatggagtttgggctgagcttgggttttcctcgttgcttcttttaagnggtgtccagtgtcaggtgcagcgtgggtgagtcgtgggggagcgtggtccaggccgtggggacggtccctgacgtccttcctccgtggtacgccacgcccttcgtcggtactttccaccgtttctaggttgttacctaagtgaacctattcggcctaccggttcgggggtcccccaccggtaacgggtccctacccggaaggggacggtaaacggggggcgttagggggacggggttcgggggtacggaccgttaagtttaaacgtactacgtaaagtttagtaggtaaacgtaggggtaaaaagtaaagtaactttaacgttaacgttaaactggtaaacctacgggttaaccgttaccgggtaacgggtaaacccggggtactaacctttccgaaacccgtttaccttaacgaaaccgaaacgtaaccctaaacccgtaaccggaaaacgtaaccgtaaccgtcgttttaacgttacgtttaacgaaacttaaagtaccggtaaacgtaacggtccgtaacggaacggtacggaacgttaaaccgggacggtacccgggtacggttaccgttggtacgtttacttaggttggtaacgtacgttaaaacgtttaggaaccggtacgggtaaaccggtacccggtaaacccggg

SEQ ID NO: 49157 - DNA, 717 bp, Homo sapiens
  misc_feature: GYAE6OF01CS6TR.52.77.G11.1.454.CMB.1.raw
  modified_base (206)..(206): a, c, t, g, unknown or other
  misc_feature (206)..(206): n is a, c, g, or t
  modified_base (310)..(310): a, c, t, g, unknown or other
  misc_feature (310)..(310): n is a, c, g, or t
  modified_base (315)..(315): a, c, t, g, unknown or other
  misc_feature (315)..(315): n is a, c, g, or t
tcagcgcagtacgacacgaccggtgctcgatttagctagtcactcaagggaaagggggggagaggagcccagcactagaagtcggcggtgttccattcggtgatcagcactgaacacagaggactcaccatgggagtttgggctgagtcttggggtttttccctcgttgcttacgtttttaagaggttgtccagttgtcgagggtncgagtcgtgggtggagtcggtggggggagcgtggtccaggtccgtgggacggtccctggagtcctctcgtgtgcacgcctgtggacttccacttcagtgtctangaacngtcgctacggtcgggtcccgccagggtccctaccggaggggtacgaacgggggtctaggggaggttcgggggtagctaaggtttagtatcgtaaagtgtaggaagtaggggaaaatagtaattacgtaaactagtcgacaacggtccgtaccggtaggaaccgggtccgtaactttaccgaacccgtttagtttacccaaaggtaccgtaaccaaaccgtacccgaaacgaaccgtaccgtacttagttactttgaaactaaacgtacgaacgtacgtccgttagaacggtgaccgttagggaccggacgtacgggcgttaaggttcttaaaggtttacgtggtaacgtaacgttaaaccttaacgaccggaacgggaaggtaaccccggtaaaccccgggg

SEQ ID NO: 49158 - DNA, 634 bp, Homo sapiens
  misc_feature: GYAE6OF01AJWZC.52.77.G11.1.454.CMB.1.raw
  modified_base (397)..(397): a, c, t, g, unknown or other
  misc_feature (397)..(397): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccaggccgtggggacgtccctgacgtacctctccgtgtcgcagcctgtggacttcacctttcagttgtcctatgacctagtcgccgtacgttcggggtccccaccgaggccctcccggaagggccgaacgggggtctggggaggttggggtgcctagtttatactcaattacgngatagggtaaataagtatatactatgcgagtaccgtacggtaggaacgggccgtattaccaacctactttaccgaagtaacgaacctaacctaccgaaacgaacgaccgtacgtagttattacgaactaaacgtacgaactacgtactagaacgtcgacgtaggagaccgacgtcgtagtacgttagttcgtagtacgacgtaacgttaactacgacggtaacggacgtaacccggg

SEQ ID NO: 49159 - DNA, 420 bp, Homo sapiens
  misc_feature: GYAE6OF01DT6AI.52.77.G11.1.454.CMB.1.raw
  modified_base (394)..(420): a, c, t, g, unknown or other
  misc_feature (394)..(420): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtccgctcggtgcggacgtctggggccaagggaccacggtcagcgtctcctcagcctccaccaagggcccatcggtcctcccccgtggccaccctcctaccaagagcaccctcgtgggggccacgaggcggcccctgggctgccgtggtacaaggactacttcctagtacgatcgctgacggcgggtctgggcaaacggtcgccaagtacggnnnnnnnnnnnnnnnnnnnnnnnnnnn

SEQ ID NO: 49160 - DNA, 799 bp, Homo sapiens
  misc_feature: GYAE6OF01DQUOZ.52.77.G11.1.454.CMB.1.raw
tcagcgcagtacgacacgaccggtgctcgatttagctagtcactcaaagggaaagggggggagaggagcccagcactagaagtcggcggtgtttccattcggtgatcagcactgaacacagaggactcaccatgggagtttgggctggagtcttgggttttcctcgtttgcttacgttttaaggaggttcgtccgaggttgtcaagggttcgcgtagtcgtgggtaggacggttcggtgggggggaggcgttggtcccgaggtcccggtagggggaccgttcccctaggaacgtccttccgtccgttggtcgaccgacggtccttacgtggtaaccttccgtaacccttcgagtttcgtacctagcggaactagtcggacctaggttccgggcccgaccgtagggtccctaccggaggggaacccggtagggggtccttgggggtaacgggttggggtacggaccgttaagtttaacgtagtaactagttagcggtaaggttaagggaaaacgtaatatacgttaacttagtcggaactacggtaccgtacggtacggtaacgggtacctacttaccgactacgttaccgaagtaaccgaacaaccgtaaccgtaaacgaccgtactacgttacgttaacgttacaacgtaatacgaacgtacgtacgtacgaagtcgtaacggtacggacggtaacgtcggtacgttcggtagtttaacgttaccgttacggtacggttaaaccggttaaacgtaacggtacgggaaaccgggtaacggtaacccggtaaaccccggg

SEQ ID NO: 49161 - DNA, 679 bp, Homo sapiens
  misc_feature: GYAE6OF01BBI44.52.77.G11.1.454.CMB.1.raw
  modified_base (280)..(280): a, c, t, g, unknown or other
  misc_feature (280)..(280): n is a, c, g, or t
  modified_base (313)..(313): a, c, t, g, unknown or other
  misc_feature (313)..(313): n is a, c, g, or t
  modified_base (338)..(338): a, c, t, g, unknown or other
  misc_feature (338)..(338): n is a, c, g, or t
tcagcgcagtacgacacgaccggtgctcgatttagctagtcactcaagggaaaggggggggagaggagcccagcactagaagtcggcggtgtttccattcggtgatcagcactgaacacagaggactcaccatggagtttgggctgagtcgttgggttttcctcgtttgcttactttttaaaggaggttcgtaccaggtgtcgagggtgcagtcgtgggtggagtcgtgggggagcgtgtccgagccgtgggacggtccctgacgtacctctcctggtcncacgcctgtaggtacttcaccttcgagttcgtntatgacatcgctacgttcgggcccncgacggcctcgaaggccgaagggctaagggcggtgggacgacgtaagttatacgtactaatgtaggagtaagggtaaataacgaattaactactagtacgacacggtacgtacgtacggaacggacctacttaccgtaacctacgttaccgaagtaacaactacctaacgaaacgaactacgtacttagtatttagaaacgtaacacgaacgtaccgacgtagaacgtacgacgtaacgacggaccgtaaccggtgtacggttagttaacgttcgtaacggtacgtaacgttaaacgttacgtaaccggaacggtaaccgggtaaccggtaaacccccggg

SEQ ID NO: 49162 - DNA, 829 bp, Homo sapiens
  misc_feature: GYAE6OF01CET3U.52.77.G11.1.454.CMB.1.raw
  modified_base (175)..(175): a, c, t, g, unknown or other
  misc_feature (175)..(175): n is a, c, g, or t
  modified_base (193)..(193): a, c, t, g, unknown or other
  misc_feature (193)..(193): n is a, c, g, or t
tcagcgcagtacgacacgaccggtgctcgatttagctagtcactcaagggaaaggggggagaggagcccagcactagaagtcggcggtgtttccattcggtgatcagcactgaacacagaggactcaccatggagtttgggctgagcttgggttttcctcgttgctcttttaagnggtgtccagtgtcaggtncagcgtggtggagtcgtgggggagcgtggtccaggccgtggggacgttccctggacgaccttcctcctggtcgcacggtcccttcgtggtactttccgacccttttccgaagtttcgtaccttaacgtggaacctagttcggaccgtaaccggttccgggggtccccacccggtaagggtccccgttacccggaacggggccgtaaacgggggggtccttagggggaaggggttcgggggttacggtaccgttaaaggttttactaacgttccgaaagtttaagttaggtaaacggttagggtaaaacggttaaaaggtaatttaacgtaaccgttaagtccggaaccgtaacggtacccgttaccgggttaaccggaacgggtacccgtaacgttaccgtaaacccgttaacgtttaccgaaacggtaaccgaacctaaaccgtaacccgaaacgtaaacctaaccgtacgttacgtttacgttacgaacgtaacgtacgaaaccgtacgtaccgtaggtaacggacgtcggtaggacgggaaccgtacggtacgttaggttagttaacgttacgttagtacggtaaccgttaacttaacgacggaaccgggtaacggtaacccggtaacccggg

SEQ ID NO: 49163 - DNA, 685 bp, Homo sapiens
  misc_feature: GYAE6OF01EVJHY.52.77.G11.1.454.CMB.1.raw
  modified_base (297)..(297): a, c, t, g, unknown or other
  misc_feature (297)..(297): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctggagcttgggttttcctcgttgcttcgttttaagaggtgtccagtgtcaggtgcagctggtggagtcgtgggggagcgtggtccagccgtgggacgtccctgacgtctctcctgtgccagtcctcgtggtacttcaccttcgagttgtctaangacatcgctacgtcgggccgcgacggctaccggagggaccgaagggggtctaggggaggttcggggtagtctaagttacatacgaatgtagaagtaggaaaatagaattacgtacgtagtcgtaccgaagtaccgtccgtaagggtaacggtaccgtattacccgtaaccttacgttaccgaacgaacgaacctaaaccgtacccgaaaagtaacccgtaaccgtaccgttagttacgtttaacgaacgtaaagtacgaaaccgtacgtaccgtagacgacgtacgtaggaacggtaccgacggtacgttgttaaggttaacgttcgttagtaccgtaacgttaaacttacggaccgtaacggggtaacgaacccggtaaacccgggg

SEQ ID NO: 49164 - DNA, 810 bp, Homo sapiens
  misc_feature: GYAE6OF01D27NA.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgcttcttttaagaggttgtccagtgtcaggtgcagctggtgagtcgtgggggagcgtgtccagccgtgggagtccctgagactctcgtgtgcagtcctcgtggtacttccacctttcgagttgtctatgactatgactacgtcgggtcccaccgaggtcctaccgagggaccgaagggggtctagggaggtggggtcgacgttaaggttatacgtactagttagtaggtaagtagggtaaaatagtaattacgtaaccgtagtacggacctaaaggtacccgttaccgggtaacgggtaaaccggggtacccgttaactttacccgtaaaccccgtttacgtttaacccgaaaggtaaacccgtaaccctaaacccgtaaccccggaaaacgtaaacccgaacccggttacgtttaacggttttaacgtttaacggaaaccttaaacggttaaccggtaaacccgtaacgggtaacccctaagggtaacggtacggtaccggttaacgggaaacgggtacccggtaacgggttcgtttacgggttaacgttttaacgtttaccggtaggtttaaccggtaaaccggttaaaccgtttaaagacccgggtaaacggggtaaccgggtaacccggttaaacccccgggg

SEQ ID NO: 49165 - DNA, 751 bp, Homo sapiens
  misc_feature: GYAE6OF01DJEHA.52.77.G11.1.454.CMB.1.raw
tcagcgcagtacgacacgaccggtgctcgatttagctagtcactcaagggaaaggggggagaggagcccagcactagaagtcggcggtgttccagttcggtgatcagcactgaacacagaggactcaccagtgggtagtttgggctggagtcgttgggttttccctcgttgtctttacgttttaaaggaggttcgtccgtaggttcgtacgaggtgcgagtcgtgggtgggtaggtcgggtagggggacggtcggtcggtcccaggccggtggggaccgtcccgtaggtacgtccttcctccgtggtacgccacgtcctcgtacggtacttccgtacttcgtagtgttactagtcgtacgtactcgaccgtacggtcggtcccacgacggtcccgtaccggagggaccggaacgggtcggtaggggtagggttacgggtggtactaaggttactacgtataacgtagtagtaaggtaagtaaaagtaagtaatacgtacgtagtacggacgttacgaccggttacggaagggaccggtccgtatttaccccgaattagtacccgaagtaactaacccggtaacacccggaaagtacctcgttacgttaattacgtaacgacgtaaaagccgtaaacgtccgtacgtaggaccgtaaggtcccgtagggtaccagttaccgggttctaggttacctaagttccgagttaagacccgtaaagttcgaaacgggtacgagtacccggtaccccg

SEQ ID NO: 49166 - DNA, 449 bp, Homo sapiens
  misc_feature: GYAE6OF01BEN6P.52.77.G11.1.454.CMB.1.raw
  modified_base (410)..(411): a, c, t, g, unknown or other
  misc_feature (410)..(411): n is a, c, g, or t
  modified_base (414)..(449): a, c, t, g, unknown or other
  misc_feature (414)..(449): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtcgacccccgtcgctcggtgcggacgtcgtcggggccaagggccacgggtcaggccgtctcctcgacgccctccaccgaacgggcccctacgtcggtcccttcccccgtggcccaccctccctccaacgacgccacctcgtcgggggcacaggccggccgtgggctgcccgtggtccaggtcctacttcctatacgactccgctggacgcgggtctcggcaacgggcgcatagctgnncgnnnnnnnnnnnnnnnnnnnnnnnnnnnnnnnnnnnn

SEQ ID NO: 49167 - DNA, 853 bp, Homo sapiens
  misc_feature: GYAE6OF01AI65R.52.77.G11.1.454.CMB.1.raw
  modified_base (188)..(188): a, c, t, g, unknown or other
  misc_feature (188)..(188): n is a, c, g, or t
  modified_base (377)..(377): a, c, t, g, unknown or other
  misc_feature (377)..(377): n is a, c, g, or t
  modified_base (736)..(736): a, c, t, g, unknown or other
  misc_feature (736)..(736): n is a, c, g, or t
tcagcgcagtacgacacgaccggtgctcgatttagctagtcactcaagggaaaggggggagaggagcccagcactagaagtcggcggtgttccattcggtgatcagcactgaacacagaggactcaccatggagttgggctgagtctgggtttcctcgttgctctttaagagtgtccagtgtcaggtncagcgtgggtggagtcgtggggggagcggttaggtcctaggtccgttgggggacggttcccctagacgtacctccgttcccgtggttccgactacgtcccgttacgtagggtaacctttcctaacccgtttcgaaggtttcgttacctaagttcgacctaagtcggtaccgacggttcgggggtccccnccgtaagggtccccttaccgggaacggggtaccgaaacgggggggtcctagggggtacgggttacgggggtcgtaaccggttaagggtttagtaacttacggtaagttaacggtacgggtaaacgtttaacggggtaaaaagggttaataagtttaaacccgtaaagtttaacggacgtacccgaaaccgggtttacccggttaacccggggtaagggtaacccgggttaacccgtacgttaacccgtaacccttaacgtttaccgaaacggtaacgaacctaaacccgtacgaaaccgtaaccgcgtaccgtttaagtacgtttacgaactaaagtacgaaccgtacggtaacagganacggtactacgggaacgacgaaccgggttcttacggtaagttacgttcggtacggtacccgtaacggttaaactaacggtaccccggtaagggtaccggtaaacccgtaaccccggg

SEQ ID NO: 49168 - DNA, 707 bp, Homo sapiens
  misc_feature: GYAE6OF01C5ZXC.52.77.G11.1.454.CMB.1.raw
  modified_base (311)..(311): a, c, t, g, unknown or other
  misc_feature (311)..(311): n is a, c, g, or t
  modified_base (316)..(316): a, c, t, g, unknown or other
  misc_feature (316)..(316): n is a, c, g, or t
  modified_base (324)..(324): a, c, t, g, unknown or other
  misc_feature (324)..(324): n is a, c, g, or t
  modified_base (328)..(328): a, c, t, g, unknown or other
  misc_feature (328)..(328): n is a, c, g, or t
  modified_base (345)..(345): a, c, t, g, unknown or other
  misc_feature (345)..(345): n is a, c, g, or t
  modified_base (355)..(355): a, c, t, g, unknown or other
  misc_feature (355)..(355): n is a, c, g, or t
  modified_base (436)..(436): a, c, t, g, unknown or other
  misc_feature (436)..(436): n is a, c, g, or t
  modified_base (448)..(448): a, c, t, g, unknown or other
  misc_feature (448)..(448): n is a, c, g, or t
  modified_base (535)..(535): a, c, t, g, unknown or other
  misc_feature (535)..(535): n is a, c, g, or t
  modified_base (562)..(562): a, c, t, g, unknown or other
  misc_feature (562)..(562): n is a, c, g, or t
tcagcgcagtacgacacgaccggtgctcgatttagctagtcactcaaagggaaaggggggggagaggagcccagcactagaagtcggcggtgttccattcggtgatcagcactgaacacagaggactcaccagtgggtagtttgggctgagtcgttgggttttcctcgtttgcttacttttaaggaggttgtccagtgtcgaggtgcgagtcgtgggtggagttcggtggggggagcgttggccaggccgtggggacggtcctaggacgtcttccgtcgtgtcgcacgtccttcgtggtacttccaccttnggttntactagtnaacngtcgctacggtcggccncgacggtccncggacgggcgaggggtcgttaggggacggttggggcgactaaggttactacgatagttagaggtagtaagggaacgttaanattacttaacgnggtacacgacgttacggtacggtaagggacggaccttctaaccgtaccttacgttaccgaaggtaacaaccctaacgtaaccgaaanaaccgtgtacgtttaagttacgttaanaaccgtaaagtaccgaacgtcgtaacgtgtacgagtaaccggtaggcggtaaaccgtcggtagttcggtaatttacggttccgtaggtaccctaaggttaaacgttacgacgggaaacggttaaccggaacccggttaacccggg

SEQ ID NO: 49169 - DNA, 801 bp, Homo sapiens
  misc_feature: GYAE6OF01BF2DR.52.77.G11.1.454.CMB.1.raw
  modified_base (371)..(371): a, c, t, g, unknown or other
  misc_feature (371)..(371): n is a, c, g, or t
tcagcgcagtacgacacgaccggtgctcgatttagctagtcactcaaagggaaaggggggggagaggagcccagcactagaagtcggcggtgtttccattcggtgatcagcactgaacacagaggactcaccatggagtttgggctgagtcttgggttttcctcgttgcttacgttttaaaggaggttgtccaggttgtcgaggtgcagcgtgggtggagtcggtggggggagtcgtggtccaggtcccgtggggacggttccctaggacgtaccttccgtccgtggtcgccacggtccctgtgggtaactttccacccgtttgacggttcgtaccttagtcgaactatcggccgtacggtcggggtcccnccgaggtccctaccggaagggcggaaacggggggtcctagggggtagggttcgggggtaggaccgttaaggtttactaacgttactaagttagtaggaaggttaagggtaaaagtaagtattaacgtacttagtcgacgtacggtaccgtcggtaggtaacggtccgttactacccgtaacctacgttaccgaaggtaaccgtaaccgtaaccgtaaccgaaacgtaacccgtacgtcccgtttagttacgttacgaacgtaaagtaccggaaaccgtcggtaaccgttaggaaccggtacggtacggtaagggaaccggtaacggtaccggttcgttaggttagttacggtttacggtaggtaaccggtaaaccgttaaacgttacggtaacccgggaaccgggtaacggtaacccgggtaaccccggg

SEQ ID NO: 49170 - DNA, 690 bp, Homo sapiens
  misc_feature: GYAE6OF01D5WYQ.52.77.G11.1.454.CMB.1.raw
  modified_base (159)..(159): a, c, t, g, unknown or other
  misc_feature (159)..(159): n is a, c, g, or t
  modified_base (318)..(318): a, c, t, g, unknown or other
  misc_feature (318)..(318): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatgggagtttgggctgagcgtggtttccncgtgctctttaagaggtgtccagtgtcaggtgcagctggtggagtcgtgggggagcgtggtccagccgtggggagtcccgtgacgactctccgtgtgcagtcctcgtggtacttcacccttgagttcgtactatgactagtcgacacgtcggggtcccncgtacgggctacgagggacgaaggggtctagggaggtcggggtagctaagttatagtctaatagtgaaggttagggaaaagttaagatttaagtaccttagtcgaacgtacggtaccgtcggtaggaacgggccgtacgttacaacccgtacttaccgaagtaacgtaacctaacctaccgaaagtacccgaacgtcgttagttaacgttacgaacgtaaaacgttcgaaacgtacggtaccgttagggaacgaacggtcgtaacgggaacggaccgtacgggttacgtacgggttatttacgttaacgttcggtagtaacggttaaactttacggaaccggtaacggaacgggtaaccgtaaaccccgggg

SEQ ID NO: 49171 - DNA, 966 bp, Homo sapiens
  misc_feature: GYAE6OF01DXZS2.52.77.G11.1.454.CMB.1.raw
  modified_base (208)..(208): a, c, t, g, unknown or other
  misc_feature (208)..(208): n is a, c, g, or t
  modified_base (844)..(844): a, c, t, g, unknown or other
  misc_feature (844)..(844): n is a, c, g, or t
  modified_base (932)..(932): a, c, t, g, unknown or other
  misc_feature (932)..(932): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcacatggtagtttggctgagtcgttggttttcctgttgtctttacgttttaagaggttctacctaggttcgtcgtagggtcncgtaggtcgttgggtgggtacggtcgggtggggggacgtccggttcgggtaccgacggtcccgggttaggggtaaccgttcccgtaggtaccgtaccgtttccgtccggtacggtcgaccgtaccgttccgttaccggtacgggttaacctttcccgtaacccttttcggaacggtttcgttaccgttaagtacggtaacctcggttacggtacccgttaaccgggttcccggggttaccccgaaccggtaccggacccggttaccgggaaacggggtacccgggtaaaggggggtccgtttaaggggtaacggggttacggggttaacggtaccgttttaaaggtttacgtaacgttaccgtaaaggtttaacgggaagtttaaacgggttaaacgggttaaaaaacggttaattaaaaccggtttactaaacggttaacggtcgttaaacgtaccgggtaaccgggtttacggtaaaccgggacgggtttaaccccttaaccgtttacccgtaaaccccggtttattaaaccccgggaggtaaaacccttaacccgtaaacccgtaacgaaaacccgggtaaccctcccggtttaatttacggttactaacggtaactaaaggtccgtaaacgnttacgtacggacgtaggcgtaaacggcgtaccggtacgtacggttagttattaacggttcgaagttaggttaaaccctaggttaaacnccggggaaacgtacggaaccccgttaccccgggg

SEQ ID NO: 49172 - DNA, 379 bp, Homo sapiens
  misc_feature: GYAE6OF01EOCMQ.52.77.G11.1.454.CMB.1.raw
  modified_base (191)..(191): a, c, t, g, unknown or other
  misc_feature (191)..(191): n is a, c, g, or t
  modified_base (280)..(280): a, c, t, g, unknown or other
  misc_feature (280)..(280): n is a, c, g, or t
  modified_base (303)..(303): a, c, t, g, unknown or other
  misc_feature (303)..(303): n is a, c, g, or t
  modified_base (360)..(360): a, c, t, g, unknown or other
  misc_feature (360)..(360): n is a, c, g, or t
  modified_base (365)..(379): a, c, t, g, unknown or other
  misc_feature (365)..(379): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggagacaacggtgacccccgtcgctcggtncggacgtctggggccaagggccacggtcagcgtctcctcagcctccaccaagggcccatcggtcttccccctggcaccctcctccaagncacctctgggggcacagcgcccngggctgcctggtccaaggctactcctcgtgcactctgagcggcctggcaaggcgtanctagnnnnnnnnnnnnnnn

SEQ ID NO: 49173 - DNA, 765 bp, Homo sapiens
  misc_feature: GYAE6OF01EPMMA.52.77.G11.1.454.CMB.1.raw
  modified_base (320)..(320): a, c, t, g, unknown or other
  misc_feature (320)..(320): n is a, c, g, or t
  modified_base (437)..(437): a, c, t, g, unknown or other
  misc_feature (437)..(437): n is a, c, g, or t
tcagcgcagtacgacacgaccggtgctcgatttagctagtcactcaagggaaagggggggagaggagcccagcactagaagtcggcggtgtttccattcggtgatcagcactgaacacagtaggacctcaaccatgggagttttggggctgagtccgttgggtttttcctcgtttgccgttcgtttttaaaggaggttcgtccaggttgtcagggtcgcagtcgtagggtagggagtccgtggggggacggtcgtcggtccaggccgtggggaggtcccctgacgtaccttcgtcctggtacgcctaacggtcccttcgnggtaacttccgaccttcgtacggtctgttacgctacgtgtaccgacggtacggtcccgttccggacgtccgcggaccggtagggcggtgggtgtagggtgggtagagtagttaactntacgtagtacgaggtaaggtaaaggtaacgtattaagtacgtatacggtactacgtacggtaccgtacgtagttaccgggacttaccgtaaccgtaaccgttaacgttaacgaacgtaacgtaaccgtaacgtaccgtaaagtaacgtcgtttagtaacgtttaacgtagtaacgtaacggtaacgtacggacgttaccggagtaacggtaccgtacgggtaacggttaacgcggttaactgttaacggttcgttaacgtaacgtcctacgacttaacgtacggtaacccggaggtacccggtaaccggtcccgggtaaccccccggg

SEQ ID NO: 49174 - DNA, 785 bp, Homo sapiens
  misc_feature: GYAE6OF01AC4PT.52.77.G11.1.454.CMB.1.raw
  modified_base (157)..(157): a, c, t, g, unknown or other
  misc_feature (157)..(157): n is a, c, g, or t
  modified_base (173)..(173): a, c, t, g, unknown or other
  misc_feature (173)..(173): n is a, c, g, or t
  modified_base (191)..(191): a, c, t, g, unknown or other
  misc_feature (191)..(191): n is a, c, g, or t
  modified_base (324)..(324): a, c, t, g, unknown or other
  misc_feature (324)..(324): n is a, c, g, or t
tcagcgcagtacgacacgaccggtgctcgatttagctagtcactcaagggaaagggggggagaggagcccagcactagaagtcggcggtgttccattcggtgatcagcactgaacacagaggactcaccatggagtttgggctgagcgtggtttccngttgcttactttaagngtcgtccagtgtcaggtncagctggtggagtcggtgggggacgcgtcggtccagtccgtggggaccgtccctagacgacctcctccgtgtcgcacgtcctcgtaggtacttccgaccttgacgttcggtacttagtcgactagtcgaccgnggttccggggccaccggtacgcccgtaccggacgggacggacggggtcgtaggggtcgggtgggtcgtacgtaaggtttactactcgtaatgtaggtagtaaggtaaagtaagtattacttaacgtgtcgaacgtaggttacccggtacggtaacgggtaaccggtaccgttaacttcccgtaaacttacgttaccgaaacgtaaccgtaacccgtaaacccgtaaaccgaaaccggtaaccgtccgttacgtttagtaaccgttttaacggaactaaaggtacgtaaaccgtaccgtacggtaagtacggtacgaacggtaacgggaccggtaacccgggtacggttacggttacgtttaacgggttacgtttaccggtacgggttaaccgtaacgttaaaccggttacggtaaacccggggaacggtaacccggggtaaacccgtaacccccccggggg

SEQ ID NO: 49175 - DNA, 675 bp, Homo sapiens
  misc_feature: GYAE6OF01CXB6Q.52.77.G11.1.454.CMB.1.raw
  modified_base (263)..(263): a, c, t, g, unknown or other
  misc_feature (263)..(263): n is a, c, g, or t
  modified_base (286)..(286): a, c, t, g, unknown or other
  misc_feature (286)..(286): n is a, c, g, or t
  modified_base (290)..(290): a, c, t, g, unknown or other
  misc_feature (290)..(290): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagtcttgggttttcctcgttgcttcttttaagaggtgtccagtgtcaggtgcagtctggtggagtcgtgggggagcgtggtccagcctgggacgtccctgagctctcctgtgcagctntggattcacttcagtcgtactangacntcgctacgtcggtcccgccgtaggcctccggaggacggaaggggcgtaggggtaggtggggtacggcgtaaggtttacacgttacgtattaggtggaagtagggtaaacgtaagtattacgtaacgtagtgacgtacgtaccgttaccggtacggacgggtacctaacgttaccgaaccttaacgtttaccgaaagtaacgaacctaaccgttaacccgaaacgtaaccgtaaccgtacttagtttaacgtttacgtaaactaaacgtacgaaccgtaacgtaccgtagtaacgagacgtaggacggaccgtacggtcgtagtagttacgtacgtagttacgtacgtaaacttagacggtaacgggacgtaaccggtaacccggg

SEQ ID NO: 49176 - DNA, 604 bp, Homo sapiens
  misc_feature: GYAE6OF01ESORF.52.77.G11.1.454.CMB.1.raw
  modified_base (176)..(176): a, c, t, g, unknown or other
  misc_feature (176)..(176): n is a, c, g, or t
  modified_base (312)..(312): a, c, t, g, unknown or other
  misc_feature (312)..(312): n is a, c, g, or t
  modified_base (339)..(339): a, c, t, g, unknown or other
  misc_feature (339)..(339): n is a, c, g, or t
  modified_base (345)..(345): a, c, t, g, unknown or other
  misc_feature (345)..(345): n is a, c, g, or t
  modified_base (382)..(382): a, c, t, g, unknown or other
  misc_feature (382)..(382): n is a, c, g, or t
  modified_base (451)..(451): a, c, t, g, unknown or other
  misc_feature (451)..(451): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgctcttttaagnggtgtccagtgtcaggtgcagctggtggagtcgtgggggagcgtggtccagccgtgggagtccctgacgactctcctgtgccagtcctcgtggacttccaccttcagttgtctatgacatcgcacgtcggggtccncgacggctccgaggcgaagggctgggngtgggngctagtatatcatatgataggaataagattaacatangacgacgtacgtcgtaggacggccgtattaccacctacttaccgagtaacgaacctaacctaccgaaanaaacccgtacgtacttacgttaacgtttacgaacctaaagttacgaactacggacctaggaacgacgacgtaggaacgtacgacggtcgtgttagttaacttacggtgtacgaacgtaacttaacgacgaacgggtacggacgtaaacccggg

SEQ ID NO: 49177 - DNA, 644 bp, Homo sapiens
  misc_feature: GYAE6OF01E0XEG.52.77.G11.1.454.CMB.1.raw
  modified_base (354)..(354): a, c, t, g, unknown or other
  misc_feature (354)..(354): n is a, c, g, or t
  modified_base (369)..(369): a, c, t, g, unknown or other
  misc_feature (369)..(369): n is a, c, g, or t
  modified_base (371)..(371): a, c, t, g, unknown or other
  misc_feature (371)..(371): n is a, c, g, or t
  modified_base (391)..(391): a, c, t, g, unknown or other
  misc_feature (391)..(391): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgctacttttaagaggtgtccagtgtcaggtgcagctggtgagtcgtgggggagcgtggtccagccgtggggacggtccctggacgacctctcctggtcgccacggtcctcgtggactttccgacctttcgagtgtactatgacatcgctacgtcgggtcccgcgaggcctccgaggcgaagggctagggngtgggtgctagttanancatgtgagtaggaaataagnttaactatatgacagtaccgtcgtaggaacggcgtacttacaaccctacttaccgaagaacgactaactaccgaaacgaacacgtcttacgtatttacgaactaagtacgaacgtacgtactaggacgtagcgtaggacggtaaccgtacggtacgtttaggttagttaaacgttacgttacggttaccgtaacgttaaaaccgtttacggaacccggtaaacgggtaacgggtaaccccgtaaaccccgggg

SEQ ID NO: 49178 - DNA, 751 bp, Homo sapiens
  misc_feature: GYAE6OF01EPX2Q.52.77.G11.1.454.CMB.1.raw
  modified_base (193)..(193): a, c, t, g, unknown or other
  misc_feature (193)..(193): n is a, c, g, or t
  modified_base (269)..(269): a, c, t, g, unknown or other
  misc_feature (269)..(269): n is a, c, g, or t
  modified_base (653)..(653): a, c, t, g, unknown or other
  misc_feature (653)..(653): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcacatggagtttgggctgagcttgggttttcctgttgcttcttttaagaggtgtccagtgtcaggtncagtcgtgggtcggagtcggtggggggacggtcgtggtccagccgtagggtacgtcctgactacctctccgtggtntacgacgtccttcgtggtactttacctaccctttagtacgttgttaccttaagttcggaacctagtccggacccgtacgggttccgggggtacccccgaccgaacgggtcccgtaccggaagggtaccgggaagggggtccgttaggggacgggtttggggtcggtactaaggttactaagtcgtaagttagtagacggtaaggaaaagttaagtaacttaagtaaccgtgtacgaacgtaagttacccggttacgggtaacggtaacgggtcctaacttacccgtaaccttaacgttaccggaaagtaaccaaacctaaccgtaacccgaaacgtaacaccgttcgttaacgtagttacgaataacgtacaacgtagtaccgngaacgacgcgtaggaccgtacgcggttgtaggttactaacgttcgtagtagtaaccggtaaacgttactaagggaccgggtagaaccgtaaccccggg

SEQ ID NO: 49179 - DNA, 644 bp, Homo sapiens
  misc_feature: GYAE6OF01EVKBJ.52.77.G11.1.454.CMB.1.raw
  modified_base (326)..(326): a, c, t, g, unknown or other
  misc_feature (326)..(326): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtggggggagcgtggtccaggcctggggacggtcccctggacgtacctctcctggtcgccagtcccttgtggtacttccacctttcaggttgtctatgacatcgcacgtggggtcccnccgaggcctccgaggccgaagggggctagggaggtggggtcggacctaggttatatcaatatgagtaggaaacgtaagaattatactatgacctaagaccgtccggtaggtaacgggccgtaacgttacctaacctactttaccgaaggtacgaacctaacctaaccaaagaaccacgtacgttagttattacgaactaatacgaactacgtacgtagagacgtagtacggacgaacgacggtacgttgttagttagttacgtaggtacgtacggtaaacttaacgtaacggacggtaaacggacccggtaacccggg

SEQ ID NO: 49180 - DNA, 777 bp, Homo sapiens
  misc_feature: GYAE6OF01ECM8P.52.77.G11.1.454.CMB.1.raw
  modified_base (226)..(226): a, c, t, g, unknown or other
  misc_feature (226)..(226): n is a, c, g, or t
tcagcgcagtacgacacgaccggtgctcgatttagctagtcactcaaagggaaagggggggagaggagcccagcactagaagtcggcggtgtttccattcggtgatcagcactgaacacagaggactcacagtgggtagtttgggctggagtcgttgggttttcctcgttgtcttcgtttaaggaggtgtcctagtgtcgaggtgcgagtcgtgggtggagtcggngggggagtcgtggtccgaggtccggtggggtacgttccctaggacgtaccttccgtccgtggtcgccgtacgtccttgtcggtaactttcctaccttcgagttcgtacttagtcgactagtcggtaccgtacggtcggggtccccacggtacggcccttaccgggacggtaccgggaaacggggtccgtagggtacgggttggggtacggtacgttaagtttactacgttacgtaagtaggtagtaacgtaagggtaaaacgttataatttaacgtacgttagtcgtacgtaacggtaccgtaccggtaagggaacggtacctacgttaaccaacctttacgttaaccgaaggtaaacccgtaacctaaaccgttaaccgaaacgtacgtaccgttacgtttaagttacgttaacgaacgtaaacgtacgaacctaggtacccgtaagacgtagaccgtagggaccgtacgtaaggttcgtacgttagttactcgttacgtaacgtaaacgttaactacgtaccggaacggtcgtaaccggtaaccccggg

SEQ ID NO: 49181 - DNA, 723 bp, Homo sapiens
  misc_feature: GYAE6OF01CHRBK.52.77.G11.1.454.CMB.1.raw
  modified_base (202)..(202): a, c, t, g, unknown or other
  misc_feature (202)..(202): n is a, c, g, or t
  modified_base (274)..(274): a, c, t, g, unknown or other
  misc_feature (274)..(274): n is a, c, g, or t
  modified_base (361)..(361): a, c, t, g, unknown or other
  misc_feature (361)..(361): n is a, c, g, or t
  modified_base (371)..(371): a, c, t, g, unknown or other
  misc_feature (371)..(371): n is a, c, g, or t
  modified_base (592)..(592): a, c, t, g, unknown or other
  misc_feature (592)..(592): n is a, c, g, or t
  modified_base (644)..(644): a, c, t, g, unknown or other
  misc_feature (644)..(644): n is a, c, g, or t
tcagcgcagtacgacacgaccggtgctcgatttagctagtcactcgaaagggaaaggggggagaggagcccagcactagaagtcggcggtgttccattcggtgatcagcactgaacacagagactcaccagtggagttggctgagtcgttggttttcctcgttgcttacgttttaaggaggtgtaccaggtcgtacgaggtnacgagtcgtggtaggtcgtggtggggagtcgtggccaggtccgtgggacgtcctgacgcctctcgtgtcgcncgtactcgtgtacttacgtaccttgtaggttctcgtaatgacctagtcgaccgtacggttcgggacccgcgtacgccgtacgacggnggaacggtgngggaggttcggagtacgtagttacagttacgtaagtgtaaggtaacgtaggaaaactaagtattaactagtacggtagaccgaacggttcgtaaccggtaaggtacggaccttaacttacccgaaccgtttacgtaacgaacgtaagaacccgtaaaccgtaacctaacgaacgaaccgtttaccgtaaggtttaccgttaaaacgagtaaaaccgttaanaaacccgggtacgttaccggtaagaacggctaacgggacggtaacgtaccgngggttactagggttaacttaggtcgagttaggaaccccttaaagttacggacgaaacgtccgggaaacccgtaaccggg

SEQ ID NO: 49182 - DNA, 680 bp, Homo sapiens
  misc_feature: GYAE6OF01BVM3V.52.77.G11.1.454.CMB.1.raw
  modified_base (159)..(159): a, c, t, g, unknown or other
  misc_feature (159)..(159): n is a, c, g, or t
  modified_base (177)..(177): a, c, t, g, unknown or other
  misc_feature (177)..(177): n is a, c, g, or t
  modified_base (301)..(301): a, c, t, g, unknown or other
  misc_feature (301)..(301): n is a, c, g, or t
  modified_base (306)..(306): a, c, t, g, unknown or other
  misc_feature (306)..(306): n is a, c, g, or t
  modified_base (400)..(400): a, c, t, g, unknown or other
  misc_feature (400)..(400): n is a, c, g, or t
  modified_base (406)..(406): a, c, t, g, unknown or other
  misc_feature (406)..(406): n is a, c, g, or t
  modified_base (458)..(458): a, c, t, g, unknown or other
  misc_feature (458)..(458): n is a, c, g, or t
tcagcgcagtacgacacgaccggtgctcgatttagctagtcactcaaggggaaagggggggagaggagcccagcactagaagtcggcggtgtttccattcggtgatcagcactgaacacagaggactcaccatgggagtttgggctgagcgtggtttcngtagctctttaagaggtntcagtgtcaggtgcagcgtgggtggagtcggtgggggacgcggttggtccacggtccgtggggtaccgtccctggacgtcctctccgtagtcgctacggccttcgtggtacttcctacccttgnggttnttaccagttacgatcgtgacccgtcggtcgggcccgaccgaggcccgtacggacggaccggaggggtctgggagggtgggacgtagtaagttanacggtntaagtagtcgtaattagggaaagtaactagtaatacctggtacgacggtaanccgtacggtaggtaccggtaccgtagtacccgtacgtaacttaccgaagaaccgtaccaacgtaaaccgaacgtaacctacgtacgttacgttaacgtacaattaacgacgaacgtacgtccgaagtacgcgtaccggagaccgtacgccggttagtaggtacttaagtccgtaagcgttaacgtaacgtacgaacgggtacgaacgtaaccggtacccggg

SEQ ID NO: 49183 - DNA, 845 bp, Homo sapiens
  misc_feature: GYAE6OF01CZD13.52.77.G11.1.454.CMB.1.raw
  modified_base (183)..(183): a, c, t, g, unknown or other
  misc_feature (183)..(183): n is a, c, g, or t
  modified_base (305)..(305): a, c, t, g, unknown or other
  misc_feature (305)..(305): n is a, c, g, or t
  modified_base (351)..(351): a, c, t, g, unknown or other
  misc_feature (351)..(351): n is a, c, g, or t
  modified_base (494)..(494): a, c, t, g, unknown or other
  misc_feature (494)..(494): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccagtggagtttgggctgagcgttgggttttcctcgttgcttcgtttaagaggtntccagttgtcgaggtgcagtcgtggtgacgtcgtggggggagcgttgggccaaggccgttggggacgttccgtaggacgcctctcctggtcgacacgcctcgtaggacttccgaaccttcgntcggttacagttacgactacttcggcctaacgttccggggaacccnccgtaagggacccctccggaaggtacccgggtaaagggggccgttaggggtaacgggtcggggttaccgacgtaaaggttttctaagtactaagttaacgtaggaaggtaacggttaaagtaaaggtactaattaccgttaanaggacctaaggttaccggtaccggtacggtaacgggaccgtaccttacgtaaacccgttacgtttacgaaacggtaactaaaccgtaaccttaacccggtaaaacggaacccttaacgttaccgttaaggtttaacgtttaacggtaaaccgtaaaaaccggtttaggaaaaccccgttaaggtaaaccccgttaggaaaccgggtacgtaacgttacgggaaacggtacccggtaaacgggtcgttttaacggggattttaaacccggtagggtaccggtaaacgtttacccggtaaacttttacgggaccggttaaccggggaacgtaaccccgggttaaaccccgggg

SEQ ID NO: 49184 - DNA, 697 bp, Homo sapiens
  misc_feature: GYAE6OF01ASFF1.52.77.G11.1.454.CMB.1.raw
  modified_base (240)..(240): a, c, t, g, unknown or other
  misc_feature (240)..(240): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctgttgctcttttaagaggtgtccagtgtcaggtgcagctggtggagtcgtgggggaggcgtggtccagcctggggagtcccngacgactctccgtgtcgcagtcctcgtggtacttccaccctttcgaggttcgttacctagtgaaccattgccacggttcggggtcccgccgagggcctaccggagggtacgaacggggggtcctagggggaggtggggtacggcgtaaggtttataattcgaagttagtaggtagtaagggaaagttaaaggtaattaatacgttaatgacagtaccgtaccggtaggaacgggtccgtacttaccgaacccttacgtttaccgaacgtacgaacctaacctaaccgaaacgaaacgaccgtacttagtaacgtttacgaacgtaaagtacgaaacgtacgtaccgtaggaacgacgacgtaggacggaacgtacgggtacgtcggttagttacgttagttcgtacggtacgttaaaccttaacgtacccgaacgggtacggtaacggtaacccggg

SEQ ID NO: 49185 - DNA, 704 bp, Homo sapiens
  misc_feature: GYAE6OF01DS5HA.52.77.G11.1.454.CMB.1.raw
  modified_base (178)..(178): a, c, t, g, unknown or other
  misc_feature (178)..(178): n is a, c, g, or t
  modified_base (182)..(182): a, c, t, g, unknown or other
  misc_feature (182)..(182): n is a, c, g, or t
  modified_base (198)..(198): a, c, t, g, unknown or other
  misc_feature (198)..(198): n is a, c, g, or t
  modified_base (349)..(349): a, c, t, g, unknown or other
  misc_feature (349)..(349): n is a, c, g, or t
  modified_base (398)..(398): a, c, t, g, unknown or other
  misc_feature (398)..(398): n is a, c, g, or t
  modified_base (412)..(412): a, c, t, g, unknown or other
  misc_feature (412)..(412): n is a, c, g, or t
  modified_base (523)..(523): a, c, t, g, unknown or other
  misc_feature (523)..(523): n is a, c, g, or t
  modified_base (531)..(531): a, c, t, g, unknown or other
  misc_feature (531)..(531): n is a, c, g, or t
tcagcgcagtacgacacgaccggtgctcgatttagctagtcactcaaaggggaaagggggggagaggagcccagcactagaagtcggcggtgttccattcggtgatcagcactgaacacagaggactcaccatggagtttgggctgagtcttgggttttcctcgttgcttctttaagnggtntcctagtgtcagggtncgagcgtggtcggtaggtcggtaggggggcgccggtggtcccgaggtccgtggggacgtcctgacgtcctcgtctggtcgcacgccttcgtcggtaactttccgacctttgtagtcgtactacgtgactatcggacctcggtccggtcccncgaggccctacggacggtacgaacggggtcgtagggagggtcgggtcgngtaagtttacgtanctaataggtagtagaacggttaaatagtaatagtactagtccgataccgtacgtcgaggtacggtctacgtacctaacgtacgttacgaacgactaacgtaccaaccgaanaaaccgtntacgttaattaggtactaaccgaagtaaccgtaagaccggtaactaggtacgaacggtacggtaacgaaccggggtactaacggtccggttaagtttaggtacttaagggttagtaccgttaaacgttacgtaacgtaacccggaacggggaacttaacccgggggaacccgg

SEQ ID NO: 49186 - DNA, 828 bp, Homo sapiens
  misc_feature: GYAE6OF01DT135.52.77.G11.1.454.CMB.1.raw
  modified_base (195)..(195): a, c, t, g, unknown or other
  misc_feature (195)..(195): n is a, c, g, or t
  modified_base (254)..(254): a, c, t, g, unknown or other
  misc_feature (254)..(254): n is a, c, g, or t
  modified_base (260)..(260): a, c, t, g, unknown or other
  misc_feature (260)..(260): n is a, c, g, or t
  modified_base (313)..(313): a, c, t, g, unknown or other
  misc_feature (313)..(313): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgcttcttttaagaggtgtccagttgtcaggtncagctggtggagtcgtgggggagcgtggtccagccgtgggagtccctgagctctctgtncagctntggacttccacttcagttcgtactatgactatcggactacgttcggggtcccncgacgggcctacccgagggaccgtaagggggtcttggggacgggttgggggtacggtaccgtaggttttaataacgttacgaagtttagtaggtaagttaaaggggtaaaagttaagtaatttaacgttaaacgttaaagttaccggtaacgtaaccggtaaccggttacccggttaacgggaaaccggggtaccgttaacgtttacccgtaacccttaaccgttttacccgaaacgtaacgtaaccctaaaccttaacccgaaacgtaaaccgtaaccgtacgttacgtttaacgtttacgtaaccgtaaacgttaacgtaaaccgtaacgttaaccggtaaggtaacggaacggttaccggtacggtaacgggtaaccggtaaccgggtaacggttacggtttacggtttaaagttttaccggtttaacggttaaccggtaaaccggtttaaacggtttaaacgtaacccggtaaaccggggtaaacgggtaaaccggttaaaacccccgggg

SEQ ID NO: 49187 - DNA, 741 bp, Homo sapiens
  misc_feature: GYAE6OF01DADXE.52.77.G11.1.454.CMB.1.raw
  modified_base (200)..(200): a, c, t, g, unknown or other
  misc_feature (200)..(200): n is a, c, g, or t
  modified_base (262)..(262): a, c, t, g, unknown or other
  misc_feature (262)..(262): n is a, c, g, or t
  modified_base (271)..(271): a, c, t, g, unknown or other
  misc_feature (271)..(271): n is a, c, g, or t
  modified_base (278)..(278): a, c, t, g, unknown or other
  misc_feature (278)..(278): n is a, c, g, or t
tcagcgcagtacgacacgaccggtgctcgatttagctagtcactcaagggaaagggggggagaggagcccagcactagaagtcggcggtgtttccattcggtgatcagcactgaaacacagaggactcaccatggagtttgggctgagtcgttgggttttcctcgttgcttcttttaaggaggttgtccagtgtcaggtncagcgtggtggaggtcggtggggggaggtcgtggtccagtccgtgggacgtcctgacgctcncgtgcgacncgtcctntggtacttccacgtttcagttcgtctatcgacatcgctacggtcggtcccgacgtacggcctcggacggcggaagggtcgtgggaggtgggtggactagttagtactataagttagtaggaagtacggaaaggttaagtacttagtaacttaggtcgaactaacgtccgtaaccggttacgaacggggtaccctacgttaacccgtaacgttaaccgtttacccgaaaaggtaccgtaaacccgttaaacccgtaaccgtaaaaccgtaaacctaaccggtttaccgttaaagtttaacgtttaacggtaaactaacgtaaacgtaaaccgtaccgtaaccggtaaggaacggtacgtacggttaacggaccgacgtacgggtacgttacggttaacgttagttcgtacggttaacgacgttaacgttacgacgggtaacaacgggtacccgtaaccccgggg

SEQ ID NO: 49188 - DNA, 847 bp, Homo sapiens
  misc_feature: GYAE6OF01BXJYS.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatgggagtttgggctgagtcgttgggttttcctcggttgcgttacttttaaggaggttcgtaccgagttgtcgtagggtgcaggtcgtgggtggaggtcggtggggggagtcgttggccaggtccgttaggggacgttcccctaggaacgtccttctccgtggtgccgacgtccttcggtaggtaccttccgtacctttgacgttgtacttgacgtactagtcggtacctacggtccggtacccgaccgtacggtccctaccggaagggtcgggtaacggggcgttaacggggagggttcgggggttacaccgttaagggtttaactaagtttacccgaagtttaggttacggaaaggtaaggggtaaaaattaacttaagttaattaaccgggtatacgggaacccgttacggtaacccggttacgggtaacgggtaaaccgggtccgttaaccgttaccctaacccgtttaaccgttaacgggaaccgttaaccggaacccttaacccgaacccgtaaaggaacccttaccgggttactttaggtttaacctttaacgaacgtaaacgttaccgaaagtcccgtacgttaggaacgtacgtacgtaggaaccgtacgtacggtacgttggttacgaggttttacccgagggttaacgtaaaccgtttaacgtaaccggtacgggtaaccgggtaaaccgtacccggtaacccggg

SEQ ID NO: 49189 - DNA, 812 bp, Homo sapiens
  misc_feature: GYAE6OF01BB6RH.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcgtgggggaggcgtggtccagccgtggggacggtccctggacgaccttctcctggtcgccgacgcctcgtggtactttcccaccctttcgagttcgtacttagtacgactagtcgtccgtacggtttccgggggtcccccgaccgacgggtcccttaccggaacggggtcggaaacgggggtctaggggaagggttgggggtcggacgttaagtttacttaactacgtaagtagttacggtaagttaagggtaaaacgttaaagtacttaaagttaccgttaagtcggaacctaacgggtaccgttaccgggtacgggtaacgggtacccgtaacgtttacccaacccgttaaccgtttacccgaaggtaaccgtaacccgtaaaccctaacccgtaaaacgtaaaccaaccggttaactttacgttaacgtttaacgaactaaacgtaacggaaaccgtacggtaacccgtaggaacgacggtacgtacggaaggtaaccgtacgggtacgtttggttacgttaagtttaccggtagttacggtaaccgttaaacgtttaaccgaaccgggtacggtaaacgggtaaccggtaaaccccggg

SEQ ID NO: 49190 - DNA, 886 bp, Homo sapiens
  misc_feature: GYAE6OF01CPCEV.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggtagtttgggctgagtcttgggttttcctcgttgtcttacgtttttaaggaggttgtcctagtgtcgaggtgcagcgtgggtggagtcggtgggggaggcgtggtccaggccgtgggacgtccctgacgtcctctccgtgtcgcacgcctcgtggacttcctaccttcgagttcgttctagtggaactagtgccgtaccggttccgggtcccgccgacgggtccctaccggaggggtaccggaacgggggtcgttaggggtacggggttggggttacggacgttaagtttaagtacttacgtaaagttagtaggtaaggttaagggtaaaagttaaacgtaatttacttaacgtagtacggacgtaacggttacccgttaccgggtaagggaaaccgggtaccgttacttacccgtaacccgtttacgtttacccgaaacggtaaccgtaaccctaaacccgtaacccgaaaacggaacccgttaccgttaccgtttaaggtttaacgtttaaccgaaaccgttaaaaggtacccgtaaaaccggtaccggtaaccgttaagggtaaaccggtacggtaaccgggtaacggggtaaccgaaccgggtaccgggtttaagtttaccggggtttaacgttttaaaccggtttacggttacgggttaacccggtaaacgggtttaaaccctttaaaccgggaacggtaaaacccgggggttaaccgggaaacccccgggtttaaaccccccggggg

SEQ ID NO: 49191 - DNA, 787 bp, Homo sapiens
  misc_feature: GYAE6OF01EKVD2.52.77.G11.1.454.CMB.1.raw
  modified_base (159)..(159): a, c, t, g, unknown or other
  misc_feature (159)..(159): n is a, c, g, or t
  modified_base (268)..(268): a, c, t, g, unknown or other
  misc_feature (268)..(268): n is a, c, g, or t
tcagcgcagtacgacacgaccggtgctcgatttagctagtcactcaagggaaaggggggggagaggagcccagcactagaagtcgcgtgtttccattcggtgatcagcactgaacacagaggactcaccatggagtttgggctgagcttgggttttccngttgcttcttttaagagtgtccagtgtcaggtgcagctggtgacgtcgtggggagcgtgtccagccgtgggacgtccctggagaccttcgtactgtcgcagcccttagnggtacttccaccgttcgaagttcgtactatcgaactatcggactacggtcgggtcccaccgtggtacccttacccggagggtaccggtaaaggggccctaggggtacggtcggggtacgtacgtaaacgtttagtacttcgtaagttaagtaccggtaagtacggggaaaagtttaacgagtttaaaccctattaaggtccgtaaccgtaaacggttaccccgttccggtaacgggtaaccgggtaaccgttactttaaccgtaacccttacgtttaaccgaaccggtaaacgtaacccgtaaaccgtaacccgaaacgtaacccgaacggttactttacggttaaccttacggaacttaaacggtacgtaacccgacgtaccgtaaggacgacgtcggtaacgggtaacggtaccgaccggttacgtagttaaccggttaacgtttaacgtaccggttacgtaaaccgttaacggttaaccctacgggaaaccggtaccgggtaaccgtaaccccggg

SEQ ID NO: 49192 - DNA, 644 bp, Homo sapiens
  misc_feature: GYAE6OF01EF4JO.52.77.G11.1.454.CMB.1.raw
  modified_base (251)..(251): a, c, t, g, unknown or other
  misc_feature (251)..(251): n is a, c, g, or t
  modified_base (260)..(260): a, c, t, g, unknown or other
  misc_feature (260)..(260): n is a, c, g, or t
tcagcgcagtacgacacgaccggtgctcgatttagctagtcactcaagggaaaggggggggagaggagcccagcactagaagtcggcggtgtttccattcggtgatcagcactgaacacagaggactcaccatggagtttgggctgagtcttgggttttcctcgttgcttcttttaagaggtgtccagtgtcaggtgcagctgggtggagtcgtggggggagcgtggtccagccgtgggacggtcctgacnctctctgtncagcctctggacttccgaccttcgagttcgtctaatcgactagtcgccgtacggtccggggttcccaccgtacgggctacccgagggccggtaacgggggctaggggtaggttcgggggtaggcttaacggtttattacgtcgaattagtgggaagtagggtaaacgtagtaataatacgtatgacacgtaccgtacgtaggtacgggctagtacacgtacttacgataacacaacgtaccaagaccacgtgttattacgttcgaactaatacgaacgtcggacctaggagcggacgtacgggacgtacgacggtcgtaggttagtacgttcgtagttacgacttaacgttacacgggtaacggacggtacccggtaacccggg

SEQ ID NO: 49193 - DNA, 725 bp, Homo sapiens
  misc_feature: GYAE6OF01CBWY0.52.77.G11.1.454.CMB.1.raw
  modified_base (175)..(175): a, c, t, g, unknown or other
  misc_feature (175)..(175): n is a, c, g, or t
  modified_base (193)..(193): a, c, t, g, unknown or other
  misc_feature (193)..(193): n is a, c, g, or t
  modified_base (320)..(320): a, c, t, g, unknown or other
  misc_feature (320)..(320): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagnggtgtccagtgtcaggtncagctggtggagtcgtggggggagcgtggtccaggccgtggggaggtccctgacgacctctcctgtcgcagcctcgtggtacttccaccttcagttgtctagtgacagtgcctacgtcggggtcccnccgaaggtcctcccgaaggggccgaaaggggggctaggggaaggttggggtacgactagttaatacgtcaattagtacggaatttagggaaaagttaacgattaacgtactaagtcgacgtaacgtccgtaccggtaggaacgggtaccgtaactttaccgaacccgttacgtttaccgaacggtaacgaaccctaaaccgtaccaaaacggtaccaaccggtacttagttaactttacggaaacgttaaaagtacggaaacgtacgtacccgttaagggaagacggtacggttacggaaaccgggtcgtaaccgggtcttaacggttacgttaactttcgtacggtacgtaaccgttaaaccgttaatacccggaaacgggtacgggtaaaccgtaaccccggg

SEQ ID NO: 49194 - DNA, 786 bp, Homo sapiens
  misc_feature: GYAE6OF01A7LBE.52.77.G11.1.454.CMB.1.raw
  modified_base (199)..(199): a, c, t, g, unknown or other
  misc_feature (199)..(199): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagtcttgggttttcctcgttgcttacttttaagaggttgtccagttgtcaggtncagcgtggtggagtcggtgggggagtcgtcggtccagccgtgggacgtccctgacgacctctccgtgtcgcacgtcctgtggtacttccacctttcgagttcgttctagtgacctagttcgcctaccggtcggggtcccaccgacggcctaccggagggccggaaggggtccgttaggggacgggttggggtcgggtacctaaggtttacgtacttacgtaaattagtaggtaagtaagggtaaagtaaagtaagttaaagtacttaaggtcgaccgtaacggttaccggtaccgggtacgggaaaccgggtaccgttacgttacccgtaacccttaacgtttaccccgaaaggtaaacccggtaaccctaaaccgttaacccgaaacgtaaacccgtaccgtacttacgtttaagtttaacgaactaaagttacggaaacctacgtacccgtagacgacgtcgtaacggaacggtccgaacgggttcttagggttagttaaagtttccggtacggttaactaaacggttaaaccgtttacgaaccgggttaacgggaaaccggtaacccggttaaacccccggggg

SEQ ID NO: 49195 - DNA, 767 bp, Homo sapiens
  misc_feature: GYAE6OF01CIC84.52.77.G11.1.454.CMB.1.raw
  modified_base (338)..(338): a, c, t, g, unknown or other
  misc_feature (338)..(338): n is a, c, g, or t
  modified_base (428)..(428): a, c, t, g, unknown or other
  misc_feature (428)..(428): n is a, c, g, or t
tcagcgcagtacgacacgaccggtgctcgatttagctagtcactcaagggaaagggggggagaggagcccagcactagaagtcggcggtgtttccattcggtgatcagcactgaacacagagactcacatggagttgggctgagtcgtgggttttcctcgttgctactttaaggaggtgtccagtgtcaggtgcagtcgtgggtggacgtcggtaggggggaggtcgttcggccaggcccgtgggggtacgtcccgaggaacgtcctcgtacctggtcgccaggtccctaggttggaactttccgaactttcgaacgttgtacctagtacaacgtagngtaccacggtcgggtaccccgcgtacggtccaacggagggtaccgaaggggtcgttagggaggttcgggacggctaaggtttactagtanaaattagagtaaggtaaggtaaagtaaagtaccttaagtactaagtaccgacgaacgttacccgtaccggtaacggaacgggtaccgtagttaccctaacgtacctttaacgaaacgtaacgaaccgaaaccgtaaccaaaccggtaactaaccgtacgttaacgttaacgttacgtaaacgtaaacgtacggtaaacgtacgaaccgttagaacggtacgacggtaggaaccggaacggtacggcgttaggtacgtttaacgttacggtagttaacggtaacgttaaaccttaaaacggtaccgtaaccgggtaagggaaaccggtaaacccccgggg

SEQ ID NO: 49196 - DNA, 799 bp, Homo sapiens
  misc_feature: GYAE6OF01BQU9L.52.77.G11.1.454.CMB.1.raw
  modified_base (204)..(204): a, c, t, g, unknown or other
  misc_feature (204)..(204): n is a, c, g, or t
tcagcgcagtacgacacgaccggtgctcgatttagctagtcactcaagggaaaggggggagaggagcccagcactagaagtcggcggtgtttccattcggtgatcagcactgaacacagaggactcaccatggagtttgggctgagcttgggttttcctcgttgcttcgttttaagaggttgtccagtgtcaggtgcagctggnggagtcgtggggagcgtggtccaggccgtggggacgtccctagacgaccttctccgtggtcgccacgtccttcgtaggactttccacctttcgaagttcgttactagttcggataagttcgcccgtaaggtccggggttccccacccgggtaggtcccgttacccggaacggggtcgggtaaacggggtcgttaggggtacggtggggtcggtaccggtaagtttagtacttagaaactttgtaaggtacgtaagggtaaaacgttaaaggtaactttacgttaaacgttacggtacgacgtaacgttacccgtccggtaacgggtaacggtaccgttacgtaccgtaaccctaaccgtttcccgaaacgtacgaacctaacccgtaaccgaacgtaaccgacgtacttacgttagttacgaacgtaacgtacgaaccgtacgtccgtaaggtacggacgtacggtacgaaccggacccgtacgggttacgttacggttaagtttacggttaccgttaggtaaccgttaacccgttaaaccgttaaccggttaaccgggaaccgggttaccggtaaaaccccggtacccccgggg

SEQ ID NO: 49197 - DNA, 582 bp, Homo sapiens
  misc_feature: GYAE6OF01B69NC.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcctctggattccaccttcagttgtctatgacatgctacgtcggggtcccgccaggcctccgaggcgaaggggctgggaggtgggtgctagttatatcatatgagtaggaagtaagatatactatgacagacgtcggtaggacggccgtattccactacttaccgagtacgacaactaccaaagaaccacgcttagtaatttcgactaaagtacgaactagccttagaacgtacgcgtaggaacgacgacggtgtacggttatacgttacgtagttacggaccgtaaacttaacgtacgtaaccggggagaaccggtaacccggg

SEQ ID NO: 49198 - DNA, 717 bp, Homo sapiens
  misc_feature: GYAE6OF01C3TYL.52.77.G11.1.454.CMB.1.raw
  modified_base (631)..(631): a, c, t, g, unknown or other
  misc_feature (631)..(631): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatgggtagtttgggctgagtcgttggggtttttcctcggtttgccttacgtttttaagaggttgtccaggttgtcaggtgcagcgtgggtggatcggtgggggagcgtggtcccaggcccgtaggggcggttccctggagaccttccgtcctggtgctacgcctcgtggactttccgacctttcaggttcgttactagtacgaactagtcgtaccgtacggtttccggggtacccgccgtacggtcctacccggagggtacgggaaggggtccgtaggggaggtcgggggtacgtaccgttaaggttacttatcgtaaagttacgtagtaacggtttaaggtaaaagtaagtaattacgtaaactagtacggactaaggtacccgttcggtaaggaccgggtaaccgtactttacccgtaacgtaccgtttaacgaacgtacaaccctaaacgtacccaaagacctacgtactagttacttagaactaatacgaacgtcgngttacgagtagcgtaggacgaccgtacggcttagttagtacttcgtagtagacgtaactacgtacggaaggacgaccgtaacccgg

SEQ ID NO: 49199 - DNA, 816 bp, Homo sapiens
  misc_feature: GYAE6OF01AY17B.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagtcttgggttttcctcgttgcttcgttttaaggaggtcgtccaggtgtcagggtgcaggtcgtgggtcggagttcgtggggggaggtcgtggtcccaggccgtaggggacggttccctggacgtacctcgtccgtggtcgcacggtccctcgttaggtacttcctaccgttcacggttgtctatacgtacctatcggcctacggtccggggtcccccaccggtacgggtccctaccggacgggtaccggtaacgggggcgttagggtaacggggttcgggggttacgaccggttaaggtttaaagttaacgtacgaaggtttaacgtggtaaacggttaggggtaaaaagttaaacggtaagtttaaactaacggttagttacgacgtaacggtaccgtttaccgggtaagggtaaccggggtccgtaacgtttacccctaacgttaacgtttacccgaacgtaaacgtaccgtaaaccctaacccggaaagtaaacccgtccggtaacgttaggttactttaacgggaacctaaacgttacggaactacccggtagttacggacgtaacgtcgtaacgaacggtaccgtccgggtacgttaggtagttacggttcgaggttacggacttaaacgttacagggtaacggtacggtaaccggtaaccccgg

SEQ ID NO: 49200 - DNA, 930 bp, Homo sapiens
  misc_feature: GYAE6OF01BZX7Y.52.77.G11.1.454.CMB.1.raw
  modified_base (143)..(143): a, c, t, g, unknown or other
  misc_feature (143)..(143): n is a, c, g, or t
  modified_base (185)..(185): a, c, t, g, unknown or other
  misc_feature (185)..(185): n is a, c, g, or t
tcagcgcagtacgacacgaccggtgctcgatttagctagtcactcgaagggaaagggggggagaggagcccagcactagaagtcggcggtgtttccagttcggtgatcagcactgaacacagagactcacagtggtagttggntgagtcgttcgggttttcctgttcgtctttacgttttaaggnggttcgtaccgtaggttcggtcgtagggtcgacgtaggtcggttaggggtacgggtaggttcggggtggggggtacggtccggttcggtacccgagggtccggttacggggtaccgttcccgtaggaccgtcccttccgtcgtaggtccgccgaccgttccgttacggtacggtacccttttacccgtaacccgttttggtaaggtttccgttaacttaacggtaccgtacggttaacgtacggccccggttaaccgggtttcccgggggttacccccgaccggtaaaccccgggtccccgttaaacccgggtagggggaacccgggttaacgggggttcggttaggggggtaacgggttcggggtagtaccggttaattacgtacgtagttaagtaggtaggtacgtaagtaaacgtatagttactacgtagtacgacgtaaccgtaggtaccggaagggtaccgctttaccgtaccctaagttaccgtaacgaaccgtaaacggtaaccctaacggtaacgtaaaccgacccgtagttttaacctttgggtaactttaaagaccggtaaactaaccgaacggttcgaacgtaggtaacgcggtaacgggtaccgaaccggtcgttaacccgttaggttccggtttaaacaggttttaccgtagggttaaacccgtaaaggtttaacccgaaaggggttacccccgaaaggggttaacccccggtaaccccgggttaccccggg

SEQ ID NO: 49201 - DNA, 889 bp, Homo sapiens
  misc_feature: GYAE6OF01BZBQJ.52.77.G11.1.454.CMB.1.raw
tcagcgcagtacgacacgaccggtgctcgatttagctagtcactcgaaggggaaaggggggggagaggagcccagcactagaagtcggcggtgtttccagttcggtgatcagcactgaacacagaggactcaccatggagtttgggctgagtcgttgggttttccttcggttgtcttacgttttaaggaggttcgtccgaggtcgtacgagggtgcgagtcgtgggtgggtacggtcgggtagggggacgggtcggtcgggtaccgacggtcccgggtagggggtaccggttcccgtaggtaacggtcccgttccgtccgttcgggtcgccgtaccggtcccgtttacggtacgggttaccttaccttaacccgtttagtacggttaccttacttaagtaccggactacgtacggtacccgtaccgggttcccggggtaccccgaccgggtaccggtccgttacgggaacgggacggggtaaaccgggggtggttacgggggaggggtttcggggtacggtaacgttacggttaagtaacgtacgtaaagttcggttaaaggacggttaaaaggtaaacggttaagtaattaccgttaatacgggtagaaccgtacgtacggtacggtagggtaacccggtattaccgtaccgtaacttaaactacgtaaaccgaactaacgtacccgtaaacaacggtaaccacgtttcgttattacgtaacgacgaaaccgtagaacctacggaacgttaggaacggacgtccggtaacgggaacggtaccgttccggagtttaaccggttacgttaacggttcgtacggttaaacgggtacctttaaacggaccggaaaccggacggggtaaccggtaaaccccggtaccccgggg

SEQ ID NO: 49202 - DNA, 838 bp, Homo sapiens
  misc_feature: GYAE6OF01EM6A0.52.77.G11.1.454.CMB.1.raw
  modified_base (379)..(379): a, c, t, g, unknown or other
  misc_feature (379)..(379): n is a, c, g, or t
  modified_base (472)..(472): a, c, t, g, unknown or other
  misc_feature (472)..(472): n is a, c, g, or t
tcagcgcagtacgacacgaccggtgctcgatttagctagtcactcaaagggaaagggggggagaggagcccagcactagaagtcggcggtgtttccattcggtgatcagcactgaacacagaggactcaccagtgggagtttgggctgagtcgttcgggtttttccctcgtttgtcctttacgtttttaaaggaggttcgtccgtaggttcgtcgtaggtgctaggtcgttgggtggtaggtcggtgggggacggtcgtcggtccaggtcccgtgggacgtcccgtgacgtcctcgtccgtgtgcagtccttgtacggtacttcctaccgttctggtttactacttacgcgtacctagtcgccgtacggtcgggtcccncggtaccggtcctaaccggacggtacggaacgggtcgtaggggtagggttacgggtcggtaccgttaagtttacgtaacgttacgtaagttanacgggtaaaggttacgggttaaaaggttaaccggttaacttaagtacggtagtaacgtacgtacgtaccgggtaggtacggaccttacgttacctaccgttacgttacgaacgtaacaacctaacctaaacgaacgtaaccgacgtacttacgttagttacaacttaaacgacgtaaccgtagtaccgaaggacgtacggtaacggttacggaaacgggacccgtacggtaagtttcgggtttacgttaacggttttccggtaagggttaccgtaaaacccgtttaaacgggttaacccggttaaccgggtaaacccggggaaaccgggttaaaccccggtaaccccggggtttaacccccccggg

SEQ ID NO: 49203 - DNA, 768 bp, Homo sapiens
  misc_feature: GYAE6OF01CA2RE.52.77.G11.1.454.CMB.1.raw
  modified_base (354)..(354): a, c, t, g, unknown or other
  misc_feature (354)..(354): n is a, c, g, or t
  modified_base (419)..(419): a, c, t, g, unknown or other
  misc_feature (419)..(419): n is a, c, g, or t
tcagcgcagtacgacacgaccggtgctcgatttagctagtcactcaagggaaaggggggagaggagcccagcactagaagtcggcggtgttccagttcggtgatcagcactgaacacagaggactcaccagtggtagttgggctgagcgttgggttttcctcgttgtcttgttttaagaggtgtctagtgtcgaggtgcagtcgtggtggtaggtcggtgggggagcgtggtcccagccgtgggacggttcccgtagacgtacctccttccgttagcgacacgtcctacgtggtacttcctacttcgagttcgtactagtagactagttgacccgtaggttccgggcccaccgnggcctaccgagggtcgtaacgggggtcgtgggtaaggtgggtacgtacttaagttttagaacgtnttaaagttaggtagtaaggttaggtaaagtaagtaacgtttataacgttagtcggtactaacgggtaccgtaccggtaaggtaaccgggtacccgttacgttacccgtacccttaacgttacccgtaaaggaacctaaacccgtaaaccgtacgaaaaccgtaaccgtaccgtacgttacgttaagtttacgaaacttaaacgtacgaacgtaaccgtacgtaaggacgtacgtacgtaagggaacgtacccgtagggtaccgttaggtttagttaacgttacggttagtaacgttaacctaaacgttaacggtacggaaacgggtaacggtaaccggtaaaccccggg

SEQ ID NO: 49204 - DNA, 685 bp, Homo sapiens
  misc_feature: GYAE6OF01DIG72.52.77.G11.1.454.CMB.1.raw
  modified_base (173)..(173): a, c, t, g, unknown or other
  misc_feature (173)..(173): n is a, c, g, or t
  modified_base (179)..(179): a, c, t, g, unknown or other
  misc_feature (179)..(179): n is a, c, g, or t
  modified_base (184)..(184): a, c, t, g, unknown or other
  misc_feature (184)..(184): n is a, c, g, or t
  modified_base (188)..(188): a, c, t, g, unknown or other
  misc_feature (188)..(188): n is a, c, g, or t
  modified_base (194)..(194): a, c, t, g, unknown or other
  misc_feature (194)..(194): n is a, c, g, or t
  modified_base (198)..(198): a, c, t, g, unknown or other
  misc_feature (198)..(198): n is a, c, g, or t
  modified_base (212)..(212): a, c, t, g, unknown or other
  misc_feature (212)..(212): n is a, c, g, or t
  modified_base (226)..(226): a, c, t, g, unknown or other
  misc_feature (226)..(226): n is a, c, g, or t
  modified_base (240)..(240): a, c, t, g, unknown or other
  misc_feature (240)..(240): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagccggtgttcgctaggctcttagaggntcagtncagtncagntggtgngcgnggggagccgtgacngcctagggcgtccngacgcctctcgtgngcgcgccgtcgtcgtactcctaccttcgtgttgtactatacgacgtactcggtcgtacggtacggtccgccgtacggtccgtaccggacggacggacgggtggtagggtagggtagggtacggtacgtagtagtacgtacgtatagtagtagtagtaagtaagtatagtactagtacgtacgtacgtaccgtacggtacggtacggtaccgtacgtacctaccgttacgtactaacgtaaccgtaaccgtaaccgtaaccgtaaaccgtaacgtaccgtacgttacgttacgttacgtaacgtaacgtaacgtacgtaccgtacgtacgtacggaccggaaccggaaccggaaccgtaacccgtaccgtaccgttaccgttacgtaacggtaacgtaaacgtaacgtaacgtaacgtacgacgtacggtaacggtaacggaacgg

SEQ ID NO: 49205 - DNA, 683 bp, Homo sapiens
  misc_feature: GYAE6OF01B8BL1.52.77.G11.1.454.CMB.1.raw
  modified_base (264)..(264): a, c, t, g, unknown or other
  misc_feature (264)..(264): n is a, c, g, or t
  modified_base (307)..(307): a, c, t, g, unknown or other
  misc_feature (307)..(307): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtggggagtccctgagacctctcctgtgcagcctntggattcaccttcagtgtctatgacatcgcacgtcgggtcccnccgaggcctccgaggcgaaggggtctgggagtgggtgctagttatatcatatgataggaataagattatactatgacagtacgtccggtagaacgggccgtattcaccttacgttaccgaagaacgacctaacctaccgaaacgaaccgacgtacttacgttaatttacgaacttaaacgtacgtaaaccgtacggtaccgttaggaacggtaccggtacggtacggaaccgggtaaccgtaacccgggtacgtttcgggtttaacggttaacgtttaacggttacgggtttaacggtaacccggttaaaaccgtttaaccggttaacccgggaaaccgggggtaaacgggtaaaccccggttaaacccccggggg

SEQ ID NO: 49206 - DNA, 971 bp, Homo sapiens
  misc_feature: GYAE6OF01C0H9M.52.77.G11.1.454.CMB.1.raw
tcagcgcagtacgacacgaccggtgctcgatttagctagtcactcaaggggaaagggggggagaggagcccagcactagaagtcggcggtgtttccattcggtgatcagcactgaacacagaggactcaccatgggagtttgggctgagtcttgggttttcctcgttgcttacttttaaggaggtgtcagtgtcgaggtgcagcgtgggtggagtcgtggggggaggccggtggtcccaggccgtggggacggtcccctggacgaccttcctccgtggtcgccacggtcccttcgtacgggtaactttcccgtaacccttttcgaacgtttcggttaccttaagtcggaaacctattccgggtcccttaacccggggtttccggggggttacccccggacccggtaacggggtccccttaaccccgggagggggaaccggtaaacgggggggtcgttaggggggtagggttcggggggtacggaaccgttaaggtttaactacgttacctaaaggttacgttaggaaaggtttaacggggtaaaagttaaacggtaagtttaaactttaacgtaaggttcggaaccgttaacggtaacccgttaccgggtaaccggggtaaacggggttaccccttaaccgtttaccctaaaccccgtttaacgtttaaccccgaaacgggaaacccgttaaccgtaaaacccgttacccgaaaaaccgggtaaacccgtaccgtttaccgtttaacgggtttaagtttacggtaaacctaaaggtaccggtaaaccgtaacgtacccgttaaggtaacgggtacgtaccggttacgggaaaccggtacccggtacgggttaccgtttacggttaggtttaaccgttaaccggtagggttaccgtaaacccgggtttaaaacctttaaccgggtacccgggaaacccggggtaacgggtaaacccccggtaaacccggggg

SEQ ID NO: 49207 - DNA, 846 bp, Homo sapiens
  misc_feature: GYAE6OF01COCC8.52.77.G11.1.454.CMB.1.raw
  modified_base (180)..(180): a, c, t, g, unknown or other
  misc_feature (180)..(180): n is a, c, g, or t
  modified_base (194)..(194): a, c, t, g, unknown or other
  misc_feature (194)..(194): n is a, c, g, or t
tcagcgcagtacgacacgaccggtgctcgatttagctagtcactcaagggaaagggggggagaggagcccagcactagaagtcggcggtgttccagttcggtgatcagcactgaacacagaggactcaccatggagtttgggctgagcttgggttttcctcgttgcttctttaagaggtntccagtgtcaggtncagtctgggtggagtcgtggagggaggcggtcggtccaggccgtggggacggtccctaggacgcctcctccgtgtgccgtacggtcccttcgtacggtactttcctaacccgtttcgaagttcggttacctaagttaccggaacctagttcggaccctaaccggttccggggtccccgacccggtaggtcccgtacccggagggtaccggaaggggtccgtagggacggtgggggtacgcgtaaggttaatacgtacgtaagtagtggtaagtagggtaaaacgttaagtaacttaagtaaccttagtacgacgtaaggtaacccgttccgggtaagggtaaccggggtaccctaacgtttaaccccgtaaccgttacgtttaacccgaaggtaacccgtaaaccctaaacccggttaaacccaaaacggtaacccgtaccgttacgtttaacgttaacgtttaacgaaacgtaaacggttaccgaaaccgtaccgtaggtaacggaacggtaacggtcggtaaacgggcggtaaaaccgggtcggtaccggttaaggttacggtttaccgttaaccggttggtaaccgttaaccccggttaaacgttaaccggtaaccgggtaaccggggaaccccgggttaaaccccggg

SEQ ID NO: 49208 - DNA, 479 bp, Homo sapiens
  misc_feature: GYAE6OF01EZLV4.52.77.G11.1.454.CMB.1.raw
  modified_base (448)..(479): a, c, t, g, unknown or other
  misc_feature (448)..(479): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtcgacccccgtccgcgtcggtgcggacgtcgtggggccgaagggaccacggtcagcgtctcctcagccctccaccgaacgggccccacgtccggtccttcccccctggcccacccctccctaccaagcgcctacccgtcgtgggggccacgacggccggccccgtggggcctcggcccgttggtaccgaaacgggtaccttaacctttccctaattaccgagttccggcgtaggacggccgggtcgtcgggaccgaacgggcggtacagtacggnnnnnnnnnnnnnnnnnnnnnnnnnnnnnnnn

SEQ ID NO: 49209 - DNA, 757 bp, Homo sapiens
  misc_feature: GYAE6OF01EXQF3.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgcttcgtttaagaggtgtccagtgtcgaggtgcagcgtgggtggagtcggtgggggaggcgtggccaggccggtgggacggtccctgacgtacctctccgtggtcgccgacgtccctacgtggtacttcctaccttctagttcgtactagtacgacgtagtcgaccgtacggtccggggtcccaccggacggtcccgtaccggacggggtacgggtaacggggtcgtagggggtacgggtcgggggtagtacgttaaggttaactacgtagtaatagtagtagtaggtaaagtaagtaattaactacgtatacgacgacggtaccgtcggtacggaaccgggccttaacgttaccctaccgttaacgttacccgaagtaaccggtaaccctaaccgtaacgaaacgtaccgtaccgttacgttaagtttacgttacaaacgtaaatacggaacgtagtaccgtaggacgtacggacggtaaggtaacggtacgaccggttagttgggttacgttaacttccggtaggtaacccgtaagtttaaacccggtataccgggtaaacggggtaccgtaaccggggtaaccccccggg

SEQ ID NO: 49210 - DNA, 711 bp, Homo sapiens
  misc_feature: GYAE6OF01CZ1AP.52.77.G11.1.454.CMB.1.raw
  modified_base (210)..(210): a, c, t, g, unknown or other
  misc_feature (210)..(210): n is a, c, g, or t
  modified_base (336)..(336): a, c, t, g, unknown or other
  misc_feature (336)..(336): n is a, c, g, or t
  modified_base (352)..(352): a, c, t, g, unknown or other
  misc_feature (352)..(352): n is a, c, g, or t
tcagcgcagtacgacacgaccggtgctcgatttagctagtcactcaagggaaagggggggagaggagcccagcactagaagtcggcggtgttccattcggtgatcagcacgaacacagagactcaccatggagtttgggctgagtcttgggttttcctcgttagcttacgttttaagaggtgtccagtgtcaggtgcagcgtgggtaggngtcggtagggggagcggtcggtccagccggtggggtacggtccctggaacgtcctcttccgtggtacgcgacgtcctgtcggtactttacctacccgttgtagttcgtactatacgacctagtccncgtacggtcggtcccncgtacggctaccggaggtacggaggggctggggaggtcgggtagcgttaaggtatactacgtagtacgtagaacgttaggtaaaagtacgtaattactaagtagtacgacgtacgtaccgtcggtaaggaccgggcttacgtacaccttagtaccgaagtacaccctaacgacaacgtacgacgtcttaggttacttaacgaactaaatacgaacgtacgtaccgagaagtcgaccgaggtaaccggagtacccggtgttaaggttacttaacggtttgtaaccggtacgtaaacctttaagtaaacccgggtcggaaacggggaacccgttaaccggtaacccgggttcccccccggg

SEQ ID NO: 49211 - DNA, 761 bp, Homo sapiens
  misc_feature: GYAE6OF01B0J4U.52.77.G11.1.454.CMB.1.raw
  modified_base (161)..(161): a, c, t, g, unknown or other
  misc_feature (161)..(161): n is a, c, g, or t
  modified_base (181)..(181): a, c, t, g, unknown or other
  misc_feature (181)..(181): n is a, c, g, or t
  modified_base (193)..(193): a, c, t, g, unknown or other
  misc_feature (193)..(193): n is a, c, g, or t
  modified_base (211)..(211): a, c, t, g, unknown or other
  misc_feature (211)..(211): n is a, c, g, or t
  modified_base (268)..(268): a, c, t, g, unknown or other
  misc_feature (268)..(268): n is a, c, g, or t
  modified_base (280)..(280): a, c, t, g, unknown or other
  misc_feature (280)..(280): n is a, c, g, or t
  modified_base (351)..(351): a, c, t, g, unknown or other
  misc_feature (351)..(351): n is a, c, g, or t
  modified_base (453)..(453): a, c, t, g, unknown or other
  misc_feature (453)..(453): n is a, c, g, or t
tcagcgcagtacgacacgaccggtgctcgatttagctagtcactcgaagggaaagggggggagaggagcccagcactagaagtcggcggtgtttccattcggtgatcagccactgaacacagaggactcacatggtagtttgggctgagcttggttttccncgttgcttctttaagaggtntcagtgcaggtncagctgggtggagttggngggggagtcgtggtaccaggtccgtgggacgtcccagacgtaccttcctccgtggtnccgagtcccttntacggactttccaccgtttgaacggtttgtaccttagtaccggactacgtggacctacggttcgggacccncgaacggtctacgacggtacggaggggtctaggggacggttggggtatacggttaatttagtacacgagttaacgtggtaagtttaacgggtaagtaaattntaaacgtacgtatacggcaaggtaccgtaccggtagggtaaccggtacgttacgtaactacccgttaacgtccgaagtaacgaacccgttaacaaccgtaacgtaaccgaccgttagttaacgttagttagaaccgtaaagttaccaacgtacggaccgttagaccgaacggtaacgttacgggaacgaccgttacggttagtacgggtttactacgtttaaacggtacgtttaaaccaaacgggtttaacttaaccgggaaacccgggaacgggttaaaccgggtaaccccggtaaacccccggggg

SEQ ID NO: 49212 - DNA, 882 bp, Homo sapiens
  misc_feature: GYAE6OF01E147C.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggctcaccatggagtttgggctggagcttgggttttcctcgttgcttacttttaaggacggttgtccgtaggtcgttacagggttcgcaggtcgttgggtgggacggttcgggtgggggggaggtcggttcgggtccacggtccgtcggggtacgttcccctggacgtaccttctccgtaggtcgaccgacggtcccttgtgggtaactttacctaaccccttttgacggtttcgtacttaagttacgaaccgtagtccggtccgtacggttaccgggggtcccacccggtaacggggtcccttaccgggaacggggtaccggtaagggggtccgttagggggtaacgggttcggggtcggtacgttaacggtttaataacggtctaaagttaacggttaggtaagttaaacgggtaaagttaaaagtacttaaacgtaaccttaggacggaaccgtaaccggtccgttaccgggaacggtaacccgggtccgtaacgtttaacccgaaccgtttaacgttacgaacggtaaccgtaacctaacccgtacgaaaacgaccgtacgtcgttaacgtttacgttacgaaacgtaaagtacgaaccgtaccgtacggtacgaagtacggtacgtaacgggaccgtaccgtaaccgggttcggttacgttaggttaacgttacgggttaacggttaaccgtaaacgttaaacccgttaaggtaacccggtaaaccgggtaccggttaaacccgggtaaccccggg

SEQ ID NO: 49213 - DNA, 839 bp, Homo sapiens
  misc_feature: GYAE6OF01APXMA.52.77.G11.1.454.CMB.1.raw
  modified_base (353)..(353): a, c, t, g, unknown or other
  misc_feature (353)..(353): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcacatggagtttgggctgagtcgttgggttttcctcgttgtcttacgtttttaaggaggtcgtccagtgttcgagggttgctaggcgtgggtaggtaggttcggtggggggaggtcggttcgggtccgaggtcccggtaggggaccgttcccgtaggaacggtcccttcttccgtggtacgccgtacgtcccttggttacggtaactttccgtacctttcgaggttnttactagtcgaactgtcggaccgtacggttccggggtccccaccggtacggtcccgtaccggaacgggtcggaacggggtcgttaggggacgggttcgggtcggtacttaaggttactaagtcgtaagttagtagggttaagtagggaaaacgttaagtaactttaacgtaactaggttacgaacctaacgggttaccgggttaaccggtacggggtaaccggtaccgttaaccgttcccttaaaccgttaccgtttaaccgaggtaaaaccgaacccttaaacccgtaacgaaaccggtaaccgtaccgtttacgttaggtttaaccgttaacggaaactttaaaccggagtaaaccggtacggtctaacgggtaagacgttcggtaacggacgttacggacggttcgtagttacggtacttaacggtcgtaacgtaaccggtaagtttaccggaggtaacggtacccggtacggtaaccccggg

SEQ ID NO: 49214 - DNA, 795 bp, Homo sapiens
  misc_feature: GYAE6OF01CBLB1.52.77.G11.1.454.CMB.1.raw
tcagcgcagtacgacacgaccggtgctcgatttagctagtcactcaagggaaagggggagaggagcccagcactagaagtcggcggtgtttccattcggtgatcagcactgaacacagaggactcaccatggagtttggctgagcttgggttttccctcgttgcttacgttttaagaggtgtccagtgtaaggtgcagcgtggtgacgtcgtgggggagcgtggtcccaggcccgtaggggacgtcccgtaggaacgtccttccgtccgtggtcgaccacggtccctcggtaggtaactttcctaaccgtttcgaagttcgttaccgtattcggaactagtggacccgtaacggtccggggtcccgaccgtacggtccctaccggaaggacggaaacggggtcgttagggaagggtcgggttagaccgttaagttaactacgtacgtagtaagtagtaaacgtgggtaaaagttaaacggatttaactaacgttaagacgtacgtaaacgccgttacgggtacggtaacgggaccgttacgttacctacctacgtttaaccgaagtaaaccgtaaacctaaaccgttaaccgaaaacgaaccgtaacgtacgttacggttaactttacggaaactaaagtaacgtaacgtaacgtacccgtaaggtaacgacggtacgtaacggtaacgggaaccggtacggtacgtacggttacgttacgttacggtgtaaccgtaacgttaaacgttaaccgtacgtaacgggaacgtaaaccggtaaccggtaaccccccgg

SEQ ID NO: 49215 - DNA, 852 bp, Homo sapiens
  misc_feature: GYAE6OF01C27QQ.52.77.G11.1.454.CMB.1.raw
tcagcgcagtacgacacgaccggtgctcgatttagctagtcactcaagggaaaggggggggagaggagcccagcactagaagtcggcggtgtttccattcggtgatcagcactgaacacagaggactcaccatgggagtttgggctgagtcgttgggttttcctcgttgtcttacgttttaagaggtgtccagtgtcaggtgcagtctgggtggtagtggtgggggaggcgttcggccaggcccgtaggggacgttcccgtggacgtaccttccgtccgtggtcgacctacggtccttcgtggaactttcccaacctttcgagttcgttacctaagtcgaactagtcggacctcgggtccggggtcccaccgtacggccctaccggagggaccggaaggggtccgtaggggacggttggggacgtactaagttatctaacgtaagtagtaggtaagtaaggtaagtaaagtacttaagtaaccgtagtacgacctaacggtaccgttaccggtaacgggacggtaccgtaacttaccgtaacccgttacgttaaccgaacggtaaacccgacctaaaccgtaaccgaaacgtaacgtaaccgttacgttacgttttaacgtttcggaaaaccttaaagtaaccgtaaaccgtacgggtaaccgttaacggaacgggttaccgtaacgggttaaccggggaaaggaaaccccgggttaaggggttaccgttaaggggttttaatttaacggtttacggttaacgggttaaaccgttaaacggttaaaacccgttttaaacggtacccgggaaaaccggggtcccgggttaaaacccggtaaaccccccggggg

SEQ ID NO: 49216 - DNA, 520 bp, Homo sapiens
  misc_feature: GYAE6OF01CIC3Y.52.77.G11.1.454.CMB.1.raw
  modified_base (159)..(159): a, c, t, g, unknown or other
  misc_feature (159)..(159): n is a, c, g, or t
  modified_base (210)..(210): a, c, t, g, unknown or other
  misc_feature (210)..(210): n is a, c, g, or t
  modified_base (241)..(241): a, c, t, g, unknown or other
  misc_feature (241)..(241): n is a, c, g, or t
  modified_base (292)..(292): a, c, t, g, unknown or other
  misc_feature (292)..(292): n is a, c, g, or t
  modified_base (470)..(476): a, c, t, g, unknown or other
  misc_feature (470)..(476): n is a, c, g, or t
  modified_base (478)..(520): a, c, t, g, unknown or other
  misc_feature (478)..(520): n is a, c, g, or t
tcagcgcagtacgacacgaccggtgctcgatttagctagtcactcaaggggaaagggccgattcaccatttccagagacaactccaagaacacgctgtatttgcaaatgaacagcctgagagctgaggacacggctgtgtattactgtgacgaacttancgacgggaggacaacggtcgaccccccgtcgcgtcgggtgccggacgtcgnggggaccaagggccacgggtcaggtccgtcncctcgacgcctaccaaccgaacgggcccctagtccggttcccttcccccgnggaccaccccttccgaccgaaagcgccaccgttcgggacgggggcaacgtcggcccggtccgtaggggcctcggacccgtggtaaccaacggtacctttaccttccgtaagtaccgtacctcggtaccgtgggaacggccgggtacgtcgggacgaaacggggtcacggaatacggcnnnnnnncnnnnnnnnnnnnnnnnnnnnnnnnnnnnnnnnnnnnnnnnnnn

SEQ ID NO: 49217 - DNA, 859 bp, Homo sapiens
  misc_feature: GYAE6OF01BNK32.52.77.G11.1.454.CMB.1.raw
  modified_base (159)..(159): a, c, t, g, unknown or other
  misc_feature (159)..(159): n is a, c, g, or t
  modified_base (190)..(190): a, c, t, g, unknown or other
  misc_feature (190)..(190): n is a, c, g, or t
  modified_base (254)..(254): a, c, t, g, unknown or other
  misc_feature (254)..(254): n is a, c, g, or t
tcagcgcagtacgacacgaccggtgctcgatttagctagtcactcgaagggaaagggggggagaggagcccagcactagaagtcggcggtgtttccattcggtgatcagcactgaacacagagacctcaccatggatttgggctgagctgggttttccncgttgcttactttaagaggtgtccagtcgtnaggtgcagctgggtggagtcggtagggggacgcgtagggtccaggtcccgtgggacgttccccnggacgtacctctcctggtagctacgtccttcgtggtacttctacccgttcacggttctacctaagtcggaactacgttgacccgtaacggtttcggggtaccccgcgaccggtaccgtaccggaagggaccggtaagggggtcgtacggggtagggtgggggtccgggattaaacggttactacttaccgtaagttacggtgtaaagggttaaggtaaaccggttaaaaggtattttaacgaaactttacggagtacccgtaacggtaccgtttacccgggtaaggtacccggggtaaccttacgtaacccgttaacccgttaacgtttaccggaaacgtaaacctaaccccgtaaacgtttaacccggaaacgtaaacccgtaccggttacgtttaacggttttaaaccgtttacgaaaccgttaaaacgttacggaaaccgtaacccggtacgttaaaccggagtaccgggacgttaacgggaacggtaaacccgggtaccgtagggtttccgttaaggttaccgttaggttccggtaaccggtaacgtttaaaccgtaccggttaacggaacccggggacgttaaaccccgggaaccccggg

SEQ ID NO: 49218 - DNA, 732 bp, Homo sapiens
  misc_feature: GYAE6OF01DVKZ7.52.77.G11.1.454.CMB.1.raw
  modified_base (293)..(293): a, c, t, g, unknown or other
  misc_feature (293)..(293): n is a, c, g, or t
  modified_base (465)..(465): a, c, t, g, unknown or other
  misc_feature (465)..(465): n is a, c, g, or t
tcagcgcagtacgacacgaccggtgctcgatttagctagtcactcaaagggaaaggggggggagaggagcccagcactagaagtcggcggtgtttccattcggtgatcagcactgaacacagaggactcaccatgggagtttgggctgagcttgggttttcctcgttgcttcttttaagaggtgtccagtgtcaggtgcagctggtggacgtcgtgggggagcgtggtccagccgtgggacgtccctgagtacctcgtcctgtcgcacgtcctcgtggaacttccaccgtttnaggtttctactaagtcgactatcggtaccgaacgttcggggtacccgacccgtaggggtcccttaccggagggaccggtaaggggtctaggggaggttggggtacggacttaggttaactacgttcaagttagtggtaagtagggtaaacgtaagtaacttattaacttagngaaccgtaaggtaccgttacccggtaaggaccgggttaccctaacgtttaccaaaccctttactttaacccgaagtaccgaacctaaacccgttacccgaaaccgtaacgtaccgtacgtttagttaactttcggaaactaagttacggaaactcggtacgtacgagtacggtactaggacggtaccgcggtacgttgtagttacttcggtaggtacgaaaccgtttaactaagtaccggaaacgggtcgaacggttaacccccggg

SEQ ID NO: 49219 - DNA, 758 bp, Homo sapiens
  misc_feature: GYAE6OF01DSFYF.52.77.G11.1.454.CMB.1.raw
  modified_base (445)..(445): a, c, t, g, unknown or other
  misc_feature (445)..(445): n is a, c, g, or t
  modified_base (494)..(494): a, c, t, g, unknown or other
  misc_feature (494)..(494): n is a, c, g, or t
tcagcgcagtacgacacgaccggtgctcgatttagctagtcactcgaaagggaaagggggggagaggagcccagcactagaagtcggcggtgtttccattcggtgatcagcactgaacacagagactcacagtggagttggctgagcgttgggtttcctgttgtctacgttttaaggaggtgtccgagtgtcgaggtgcagtcgtgggtggagtcggtgggggagtcggtggtccaggtccgtggggtacggtcccgtaggacgtaccttcgtccgtggtcgaccgtagtcccgttcggtacggtacttcccgtacgttccgaggttcgtactagtacgactacgtggaccgtacggtccgggtacccacgtacggtaccgacccgaagggaccggtaaggggctaagggggtcggtacgggtcgaacgttagtttaagtacgtntaagtagtaggtaaacgtagggaaagtttaaacgattaacgtacgttancggaactacgggtaccgtaccggtaggtaacggaccgtaacgtacctaccgtacgttaacgaacgtaacgaacctaacgtaacaaacgaaccgtacgtacgttagttaacttaagaactaaacgtagaaccgtaacggaacgttaggaacgtaaggcgtaacgggacggtaccgacgggttacgttcggtagttacggttacgtacgtacggtaacgtaaaccgtacggtaacggaaccgggaacggtaaccggtaaaccccgg

SEQ ID NO: 49220 - DNA, 788 bp, Homo sapiens
  misc_feature: GYAE6OF01D9S04.52.77.G11.1.454.CMB.1.raw
  modified_base (181)..(181): a, c, t, g, unknown or other
  misc_feature (181)..(181): n is a, c, g, or t
  modified_base (195)..(195): a, c, t, g, unknown or other
  misc_feature (195)..(195): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgcttcttttaagaggtntccagtgtcaggtncagctggtggagtcgtgggggagcgtggtccagccgtgggacgtccctgagtctctcctgtcgacacgcctctggtacttccaccttcgtagttcgttctatcgaactactcgtacctacgtcggggtccccgccgacggtcctaccgacgggacggtaaggggctagggacggtggggtggacgtaggttatagtacgtagtataggtagtaagggtaaattaagattaacgtacgttaatacggacgtaaacggtaccgtcccgggttaaggaaccggggtacccgttaacttaaccctaaccgttaacgtttaacccgaaaggaacccgtaaaccgtaaacccgtaacccgaaaaacggtaacccgtaaccggttacgtttaacgtttaacggtttaacgaaactaaacgggtaactaaacccgtacgtacccgttaagggaaccgtaggccgtaaaccgggacgggtaccgtaaccgggttcgttaaacgggtttcgttaaacgtttaccgtacgggttacgtaaaccggttaaactttaaaccggacgggtaaacccggggtaaacgggtaaccccgtaaccccgggg

SEQ ID NO: 49221 - DNA, 837 bp, Homo sapiens
  misc_feature: GYAE6OF01DI6LB.52.77.G11.1.454.CMB.1.raw
  modified_base (317)..(317): a, c, t, g, unknown or other
  misc_feature (317)..(317): n is a, c, g, or t
tcagcgcagtacgacacgaccggtgctcgatttagctagtcactcaagggaaagggggggagaggagcccagcactagaagtcggcggtgtttccattcggtgatcagcactgaacacagagactcaccatggagtttgggctgagcgttgggttttcctcgttgcttacttttaagaggtgtccagtgtcgaggtcgcagcgtgggtggaggtcgtggggggagcgtggtaccaggtccgtggggacgtcccctaggacgtacctctccgttggcgaccacgcctgtggtactttccgaccttcagttgtcttagngactagtgaccgtacgtcgggtacccgcgacggcctaccggagggacgaaggggcgttagggagggttgggtcggacgttaaggttatacgtactaagttaagtaggaagtaagggtaaagtaaaggttacttaacttaacttaacgtacgaccgtaagggtacccgtttaccggggtaacggtaacccggggttaacccgttatttaaccccgtaacccgtttaaacgtttaaacccgaaaggtaaccggaaaccctaaacccgttaaacccaaaaccggtaaacccgtacccgttacggtttaacggtttaacgtttaacgtaaaccgttaaacgtaacgggtaaaacccgtaccggtaacgttaagtaacggtacggtccggtaaaggaaccggtaccggtaacggtcccgttaggttagtttaacccggtttacgttaggtaaccgtaaaccgtaaaccgttttaaacggaccggttaaacgggaacccgggttaaacccggtaaaccccgggggg

SEQ ID NO: 49222 - DNA, 741 bp, Homo sapiens
  misc_feature: GYAE6OF01BWC6K.52.77.G11.1.454.CMB.1.raw
  modified_base (196)..(196): a, c, t, g, unknown or other
  misc_feature (196)..(196): n is a, c, g, or t
tcagcgcagtacgacacgaccggtgctcgatttagctagtcactcaagggaaaggggggagaggagcccagcactagaagtcggcggtgtttccattcggtgatcagcactgaacacagaggactcaccatggagtttgggctgagtcgttgggttttcctcgttgcttcttttaagaggtgtccagtgtcaggtncagctggtgagtcgtggggagtcgtgtccgagccgtgggacgtccctgacgcctcgtccgtgtacgctacgcccttgtcggacttaccgtaccttcgagttcgtacctatcggactatggccgtacgtcgggtcccaccgtaacggtccctaccggaggaccggtaaggggtctaggggtaggttcggggtcgtacgtaggtttaacgtagtacgtaagttagtgtaacgtaaggggtaaaattaagattaacgtaacgttagtcggactacggtaccgttaccggtaggtaaccgggacgtacgttacccgtaaccttacgttaccgaaacgtacgaacccgtaaccgttaaccgaaacgtaaccgacgttacgttagttaacgttacgaaacgtaaacgtacggtaaccgtaacggtacctaaggtacgacgtacgtacggaacgggtaccgtaccggtacgttcggttaacgttagttacgtacggtacgtaaccgttaaacgttacgtaacgaaaccggtacggaaccggtaaaccccggg

SEQ ID NO: 49223 - DNA, 766 bp, Homo sapiens
  misc_feature: GYAE6OF01CT9NT.52.77.G11.1.454.CMB.1.raw
  modified_base (312)..(312): a, c, t, g, unknown or other
  misc_feature (312)..(312): n is a, c, g, or t
  modified_base (329)..(329): a, c, t, g, unknown or other
  misc_feature (329)..(329): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcggtgggggagcgtggtccaggccgtggggacgtccctgacgtacctctccgtgtcgcacgcctcgtggtacttccgtaccttcgagttcgtctagtgaactntcgccacgtcgggtccnccgaggcctccgaggtcgaaggggtctaggggacggtggggtggacgtaggtttaatacttacgaagttagtaggaagttaacgggtaaaaggtaagtaattaacgttaacgttagttacgaccgtaacggttaccggtacccggtaagggtaaccgggtccgttaacgtttacccaacccgtttacgtttaacccggaaagaaccggtaaccctaaacccgttaacccgaaaacgaaccgtaaccgttacgtttacgtttaagtttaccgaaacgtaaacgtacgaaaccgtacggtaccgtaggaacggtacgtacgtaagggaccggaaccggtaccgggttcgttacggtttaggttaactttccggagtttaccggtaacgttaaacgttaacgtaccggaaacgggtacggtaaacccggttaaccccggg

SEQ ID NO: 49224 - DNA, 542 bp, Homo sapiens
  misc_feature: GYAE6OF01BLNS6.52.77.G11.1.454.CMB.1.raw
  modified_base (475)..(475): a, c, t, g, unknown or other
  misc_feature (475)..(475): n is a, c, g, or t
  modified_base (485)..(485): a, c, t, g, unknown or other
  misc_feature (485)..(485): n is a, c, g, or t
  modified_base (487)..(495): a, c, t, g, unknown or other
  misc_feature (487)..(495): n is a, c, g, or t
  modified_base (498)..(501): a, c, t, g, unknown or other
  misc_feature (498)..(501): n is a, c, g, or t
  modified_base (503)..(504): a, c, t, g, unknown or other
  misc_feature (503)..(504): n is a, c, g, or t
  modified_base (506)..(508): a, c, t, g, unknown or other
  misc_feature (506)..(508): n is a, c, g, or t
  modified_base (510)..(511): a, c, t, g, unknown or other
  misc_feature (510)..(511): n is a, c, g, or t
  modified_base (513)..(523): a, c, t, g, unknown or other
  misc_feature (513)..(523): n is a, c, g, or t
  modified_base (525)..(542): a, c, t, g, unknown or other
  misc_feature (525)..(542): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggagacaacggtcgacccccgtcgcgtcggtgcggacgtcgtggggccgaagggaccacgggtcagcgttcctcctcacgccctacccaccgaacgggccccagtcccggtcctttccccccgtggccctacccctccctacccgaagacgccacccgtcggtcgggggcaccgacggtccccgggtccccgtgggcctcggccgttacgggtacgaacgggttaccttacctttaccctaacgtaccgtacgttcgcctcgggaacgggccgggtcgtacgggtaccgaaacgggccgacgtaaggtacggcngtgccatcgngnnnnnnnnncannnncnncnnncnncnnnnnnnnnnngnnnnnnnnnnnnnnnnnn

SEQ ID NO: 49225 - DNA, 708 bp, Homo sapiens
  misc_feature: GYAE6OF01CMLRZ.52.77.G11.1.454.CMB.1.raw
  modified_base (160)..(160): a, c, t, g, unknown or other
  misc_feature (160)..(160): n is a, c, g, or t
  modified_base (176)..(176): a, c, t, g, unknown or other
  misc_feature (176)..(176): n is a, c, g, or t
  modified_base (194)..(194): a, c, t, g, unknown or other
  misc_feature (194)..(194): n is a, c, g, or t
  modified_base (213)..(213): a, c, t, g, unknown or other
  misc_feature (213)..(213): n is a, c, g, or t
  modified_base (392)..(392): a, c, t, g, unknown or other
  misc_feature (392)..(392): n is a, c, g, or t
tcagcgcagtacgacacgaccggtgctcgatttagctagtcactcaaggggaaaggggggggagaggagcccagcactagaagtcggcggtgttccattcggtgatcagcactgaacacagaggactcaccatggagtttgggctgagctgggttttccncgttgcttctttaagnggtgtccagtgtctaggngcagtctgggtgagtcggngggggagcgtggtccaggccgtggggacgtcctaggacgtacctccttcgtggcgactgcccttcgtggtacttcaccctttcagttcgtctagtagactgtgccgtacggtccggggtccgacccgtaggccctaccgacgggacggtaacggggtgtaggggaggttggggtacggntaaggtttaactgtacaagtagtgtaaaggttaggtaaaggtaagtaagtaactaacgtagtagaccgtaagaccgttaccggtaggaacgggtacgtactccgaccttaacttaccgaacgacgtaactaacctaacccgaaacggaacctaccgtaccgttaagttttaccgttaacgtaaacttaaacgtacggaaacctacggtaccctaggaacggtacgacggtacggaacgtaccggacgtacgttgtagttaattcgtacgttgaaccgttaagtaaccgtggaaacggtggaaacccgtacccgggg

SEQ ID NO: 49226 - DNA, 822 bp, Homo sapiens
  misc_feature: GYAE6OF01BSYAY.52.77.G11.1.454.CMB.1.raw
tcagcgcagtacgacacgaccggtgctcgatttagctagtcactcaagggaaaggggggagaggagcccagcactagaagtcggcggtgtttccattcggtgatcagcactgaacacagaggactcaccatggagtttgggctgagcgttgggttttcctcgttgcttcgttttaagagttgtccagttgtcaggtcgcagcgtgggtggagttcggtgggggaggtcgtggtccaaggccgtggggacgtccctaggacgtaccgttcgtccgtggtcgaccgacggtcccttggtacggtaacttcccgtacccttcgacgttacgtctaagtacgactagtcgcctaacggttccgggtcccgaccgtacgggtccctaaccgggacgggaaccggtaaacgggggtcgttaacggggtacgggtttcggggtacggtaccgtttaaaggtttaaccgttaagtaccgtaaaggtttacggtaacggttaagtttaaacgggaaacgtttaaagtacttaaacttaacggttagtacgaaccgtaacggttacccgttaacccggtaaggaaccggtaccccttaattacccgtaacgttaacgtttaacgtaacggaacgtaaccgtaacccgttaacgaaacgtaaccgtacgtacgtttaaggttacgttaaccgaacgtaaacgtaacgtaaccgaccgttaacggtagacgacggttcgtaacgggtacgaccgtggttcgtagttaagttacgtggtacgtaccgtaacgtaaacgttacggaaacggaccggtaacggtacccgtacccggg

SEQ ID NO: 49227 - DNA, 817 bp, Homo sapiens
  misc_feature: GYAE6OF01D8AC8.52.77.G11.1.454.CMB.1.raw
  modified_base (448)..(448): a, c, t, g, unknown or other
  misc_feature (448)..(448): n is a, c, g, or t
  modified_base (492)..(492): a, c, t, g, unknown or other
  misc_feature (492)..(492): n is a, c, g, or t
tcagcgcagtacgacacgaccggtgctcgatttagctagtcactcaaagggaaaggggggggagaggagcccagcactagaagtcggcggtgtttccattcggtgatcagcactgaacacagagactcacatggtagtttgggctggagcttgggttttcctcgttgtcttacgtttttaaggaggttgtccctaggtttgtccgtagggtgctaggtcgttgggtgggtacggttccgggtagggggggacggtccggttggggtacccaacgggtcccggttagggggaccggttcccccgttaggtaacggtaccctttccgtcccgttaggttcgaccgtaccggtccctttcggtaggtacctttaccctaccccgtttagtaggtttcgttacttaacgtcggtaacttcgtcggtacgtaccggtttccgggggtaccccnccggtaacgggtccctaaccgggtagggaccggaacggggttcnggggttacggtcggggaagttctaaggtttactagttacgaagttacgtaggtaagtaagggtaaactaagtagttatacgtagcgacgtacgtacgtacggtggaaccgtcgtaacttccgacttacgtaccgaagaacgtaacacgtacaaagtaccgtacgtacttagtactagaactaactacgtaacgagtaccgtagacggagagttacggaacggaccgtacggtcgttacgggttagtttaacgttggttacggtacgtaaaccgttaacggttaaccgaccggttaaacgggggacccgtaaccgggtaccccggg

SEQ ID NO: 49228 - DNA, 707 bp, Homo sapiens
  misc_feature: GYAE6OF01AUVN2.52.77.G11.1.454.CMB.1.raw
  modified_base (160)..(160): a, c, t, g, unknown or other
  misc_feature (160)..(160): n is a, c, g, or t
  modified_base (167)..(167): a, c, t, g, unknown or other
  misc_feature (167)..(167): n is a, c, g, or t
  modified_base (174)..(174): a, c, t, g, unknown or other
  misc_feature (174)..(174): n is a, c, g, or t
  modified_base (178)..(178): a, c, t, g, unknown or other
  misc_feature (178)..(178): n is a, c, g, or t
  modified_base (199)..(199): a, c, t, g, unknown or other
  misc_feature (199)..(199): n is a, c, g, or t
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
  modified_base (229)..(229): a, c, t, g, unknown or other
  misc_feature (229)..(229): n is a, c, g, or t
  modified_base (261)..(261): a, c, t, g, unknown or other
  misc_feature (261)..(261): n is a, c, g, or t
  modified_base (263)..(263): a, c, t, g, unknown or other
  misc_feature (263)..(263): n is a, c, g, or t
  modified_base (543)..(543): a, c, t, g, unknown or other
  misc_feature (543)..(543): n is a, c, g, or t
  modified_base (575)..(575): a, c, t, g, unknown or other
  misc_feature (575)..(575): n is a, c, g, or t
  modified_base (637)..(637): a, c, t, g, unknown or other
  misc_feature (637)..(637): n is a, c, g, or t
tcagcgcagtacgacacgaccggtgctcgatttagctagtcactcaaggggaaagggggggagaggagcccagcactagaagtcggcggtgtttccattcggtgatcagcactgaacacagaggactcaccatggagtttgggctgagcttgggtttccngttgctntttaagnggtntccagtgcaggtgcagctggnggagtcgngggggngcgaggtccagtccgnggggtacgtccctagagccttcgtcctggtcncngtccctgtcggtattccaccttcagttctacctagttagaacgtatccgtacgtacggtcgggtccccgacgtacggtcccacgggacggcggtaacggggcgtaggggtaacggggtcgggtcggtactaaggtttagactacaaatcggtggtaaagtaggaaacggttaaagtacctaacgttacctaagttccgacagtacccggttacggaagggaccgttaccgtataccctacttaacgttacggataacggaacctaccaaccgaatccgancggtttaatcgttaacaacgaaagtaccgacncggtaaccgttagaacggtactacggacggaaacggtcggtaaacgttcggtgtttaaaccnggttattacccggggaatttaccggtaaacctttaagaaccggggaacttccgggaacggttaccccggg

SEQ ID NO: 49229 - DNA, 678 bp, Homo sapiens
  misc_feature: GYAE6OF01BGHUJ.52.77.G11.1.454.CMB.1.raw
  modified_base (160)..(160): a, c, t, g, unknown or other
  misc_feature (160)..(160): n is a, c, g, or t
  modified_base (178)..(178): a, c, t, g, unknown or other
  misc_feature (178)..(178): n is a, c, g, or t
  modified_base (182)..(182): a, c, t, g, unknown or other
  misc_feature (182)..(182): n is a, c, g, or t
  modified_base (250)..(250): a, c, t, g, unknown or other
  misc_feature (250)..(250): n is a, c, g, or t
  modified_base (298)..(298): a, c, t, g, unknown or other
  misc_feature (298)..(298): n is a, c, g, or t
  modified_base (356)..(356): a, c, t, g, unknown or other
  misc_feature (356)..(356): n is a, c, g, or t
  modified_base (439)..(439): a, c, t, g, unknown or other
  misc_feature (439)..(439): n is a, c, g, or t
  modified_base (451)..(451): a, c, t, g, unknown or other
  misc_feature (451)..(451): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggttttccncgttgcttcgttttaagnggtntccagttgtcaggtgcagcgtggtcggagtcggtgggggacgcgtcggtccagccgtgggacgtcccnggacgccttctccgtgtcgccacgtcctcgtaggtacttcacccgttnagttcgttctatagactagtcgccgacggtcgggtcccgcgtacgggccgtacccggnggtaccgggaaggggtctacgggtagggttgggtacgacgtacggttatagtactagtactaggtacgtaaggtaataacgtnttaacgtctagngactagtaccgtacggtagaaccggtctacgtaccaacgttcttacgacgtaacgtacctacgtaaccgaagacctcggtactagttacgtttacaacgtaacgcgtaaacgtcgaccgtagaacgtagacgtagggaccggtaagtccgtagttacggttagtacgttacggtctacggaacgttaaactcgttaacgggaacggtccggtaaaccggtccccggg

SEQ ID NO: 49230 - DNA, 763 bp, Homo sapiens
  misc_feature: GYAE6OF01DVBMD.52.77.G11.1.454.CMB.1.raw
  modified_base (497)..(497): a, c, t, g, unknown or other
  misc_feature (497)..(497): n is a, c, g, or t
  modified_base (651)..(651): a, c, t, g, unknown or other
  misc_feature (651)..(651): n is a, c, g, or t
  modified_base (683)..(683): a, c, t, g, unknown or other
  misc_feature (683)..(683): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatgggagtttgggctgagtcttgggtttttcctcgttgtcttcgttttaagaggtgtccgagttgtcgaggtcgcgagtcgtgggtggaggtcggtggggggaggcggtggtccagcccgtggggacgtcccgtgacgtcctctccgtgcgtacagccttcgtaggtacttcctaccttccgagtttctacttaagcgtaacacgttcgaccgtacggttccggggtccccgaccgtacgggtcccgttacccggagggaccgggaagggggttcgttacgggtaggggtcgggttacgggctaagtttataagtaccgtagttaagtcggaagtttaaacgggaaaaggtttaagtaaaccgtttntttaaaaccgttggaaccgtacggttaaaccgacccggttacccggtaacgggtaaccggtaccggttactaacccgttacccggtttacttaccgaacggtaaccgtaaccgaacctaaccgaaacgtaactacgtacgttacgtacgtttanaacgtaagtacgaaccgtagtactagacgagngacggtacgacgtcggtagtgtagttatcggtacgtagtacgttaacgtaacgacggtaacggtacggcccgtaaccggg

SEQ ID NO: 49231 - DNA, 849 bp, Homo sapiens
  misc_feature: GYAE6OF01EG8OT.52.77.G11.1.454.CMB.1.raw
  modified_base (312)..(312): a, c, t, g, unknown or other
  misc_feature (312)..(312): n is a, c, g, or t
  modified_base (496)..(496): a, c, t, g, unknown or other
  misc_feature (496)..(496): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagtcgttgggtttttcctcggtttgtcttacttttttaaaggaggttcgtccgtaaggttcgttacgagggttcgccgagtcgtgggtgggagttcggtggggggagtcgtggtcccaggcccggttaggggaccgtccctaggacgtaccttcgtcctggtcgacncgtccttgtcgtacttcctaccttgagtttgtactagtcgactagtcgtccgacggtttccggggcccacggtacggccgttaccgagggtccggtaaggggtcgtagggtgggtcgggtgaccgttagttatagtactaagttacgtaggtaagtacgggtaaaagttaagattaactttaanacgtagtacgaaccgttaccggtaaccggtagggtaacccgggttacctaacgtttacccgtactttaaccgttacccgaaacggtaacccggtaaccctaaacccgttaaaccgaaaccgtaacgtaacccgttacgtttaacgtttacgttaacggaacgttaaacgtaccggaaaccgtaccgttaccggacgaaccggtaacggtacggtacggtaaacccggacggtaccggtttaacgtacgggtttagttaaccgtttacgggttacgttaaccggtaaccgttaaaaccgtttaacgggaacccgttaacgggaaccgggttaaacccccgggtaaaccccgggg

SEQ ID NO: 49232 - DNA, 824 bp, Homo sapiens
  misc_feature: GYAE6OF01CYP4Z.52.77.G11.1.454.CMB.1.raw
tcagcgcagtacgacacgaccggtgctcgatttagctagtcactcaagggaaagggggggagaggagcccagcactagaagtcggcggtgttccattcggtgatcagcactgaacacagaggactcaccatggagtttgggctgagtcgttgggttttcctcgttgtcttacgttttaagaggtgtccagtgtcaggtgcagtcgtgggtggaggtcggtgggggagcggtggtccaggtcccgtggggacggtccctaggacgtacctcctcctggtcgccgacgccttcgttcggtaacttttccgacccgtttacgtacggtttcgttaccgttaagttacgaactacgttcggacccgttaccgggttccggggtcccgaccgtaccggggtccctaccggggacggacgggtaacggggggtcctagggggtaaggttggggacggtaccttaaggtttaactacgttacaagtttagtaggaagtttaagggaaaggttaataacttaacgttaacctaggtacgacgtaacggtaccgtaccgggtaggaaccgggtacctacgttaccgtaacccttaacgtttaccgaaaggtacccgtaaaccgtaaaccgtaaccgaaacgtaaaccgtacggttacttaacgttagttaacgaactaaagtaacgtaacgtacgtacgtaggacgtagttaccgaaggtaacggtacgtacccggtgttaacggttacgttagttaaccgttggttaacgtaaacgttaacctttaaacggaggtaaaacccggggtacggaaaccgggttaaccccccggg

SEQ ID NO: 49233 - DNA, 738 bp, Homo sapiens
  misc_feature: GYAE6OF01B2SH3.52.77.G11.1.454.CMB.1.raw
  modified_base (178)..(178): a, c, t, g, unknown or other
  misc_feature (178)..(178): n is a, c, g, or t
  modified_base (291)..(291): a, c, t, g, unknown or other
  misc_feature (291)..(291): n is a, c, g, or t
tcagcgcagtacgacacgaccggtgctcgatttagctagtcactcaagggaaaggggggagaggagcccagcactagaagtcggcggtgtttccattcggtgatcagcactgaacacagaggactcaccatggagtttgggctgagcgttgggttttcctcgttgcttcgttttaagnggtgtccagtgtcgaggtgcagtcgtggtggagtcgtggggagcgtggtccagccgtgggacgtccctagacgacctcgtcctgtcgcacgtcctcgtggtacttccaccttnagttcttactagtgactagtcgaccgtacgttcgggtcccgcgacggtcctaccggaaggccggtaacggggctggggtacggttgggtacgtacgttagttacgtagtaccagttaacgtggtaagtacgggtaaaagttaagtaacttaaacgttacgtaactcggtaacgtaaccggttacccgttaccgggtaacggtaaccggggtaccctaacgtttaccccgtaaccttaaccgtttacccgaaaggtaaccctaaacccgtaaacccgtaaccgaaaccgaacccgttaccgtaccgtttagttaacgtttaggaacctaaagtcggaaaccgtcgacgttacgaggtacgtcgtacgggacggtacgtacggtcgttagttagttacttacgtcggtacacgttaacttagaccggaacggtagtacccgtacccggg

SEQ ID NO: 49234 - DNA, 722 bp, Homo sapiens
  misc_feature: GYAE6OF01B7184.52.77.G11.1.454.CMB.1.raw
  modified_base (308)..(308): a, c, t, g, unknown or other
  misc_feature (308)..(308): n is a, c, g, or t
  modified_base (421)..(421): a, c, t, g, unknown or other
  misc_feature (421)..(421): n is a, c, g, or t
tcagcgcagtacgacacgaccggtgctcgatttagctagtcactcaagggaaaggggggggagaggagcccagcactagaagtcggcggtgtttccattcggtgatcagcactgaacacagaggactcaccatggagtttgggctgagcttggttttcctcgttgcttcttttaagaggtgtccagtgtcaggtgcagtctgggtggagtcggtggggggaggcggtggtccaggtccgtggggacgtccctggacgacctctccgtgtagccacgtcctcgtcggtacttcctacccttgtaggttntcttagtgactattcgaccgtacgtccgggggtccccaccggtacggccctaccggaggggtaccgaagggggtcgtggggaggtggggtacgtcgttaaggttactacgtanaattagtagtaagtaggggaaatagtaacttataacgttatacggactacggtaccgttcggtaacggtaaccgggtcgtaacgttaccctaccgtacgttaaccgaagaacgtaaccctaaacgtaaccgaaacgtacgaccgtcttaacggttagttacgaaacctaagtaccgaacgtacgtacgtgaaggtcgacgtaggacgtacggtcggtacgtttaggtacttagttacgtaggtaaccgtaacgttaacgttaacggtaccggaacgggaacggtaacccggtaaccccggg

SEQ ID NO: 49235 - DNA, 748 bp, Homo sapiens
  misc_feature: GYAE6OF01AHC33.52.77.G11.1.454.CMB.1.raw
  modified_base (334)..(334): a, c, t, g, unknown or other
  misc_feature (334)..(334): n is a, c, g, or t
tcagcgcagtacgacacgaccggtgctcgatttagctagtcactcaaagggaaagggggggagaggagcccagcactagaagtcggcggtgtttccattcggtgatcagcactgaacacagaggactcaccatggagtttgggctgagcttggggttttcctcgttgcttcttttaagaggtgtccagtgtcgaggtgcagtctggtggagtcgtgggggagcgtggtccaggccgtgggcgtccctgacgtacctctccgtgtcgactacgtcctactggtacttccgacctttccgaagtcgtactatgactagtgctaccgtcggggcccncgacggtcctccgaggaccgaaggggcgtagggtaggtcggggtggacgttagttaatactacaagttatacggtataagggtaagtaaggaattacttaacgtagtcggataaccggtacgtccgggtacggaacgggtacccgtacttacccgtaacctaactttacccgaagtaaccgaaccctaaaccgtacccgaaaacgtaaccgtaccggtcgttaagttaaccgttttaacgaaaccgttaaaagtcggaaacccgtacgtacctaacgggaacgtacggaacgtcggtaaccggaaaccggtacggtacggttacggttaacgttacgtttacggcggtaaacggtttaccgttaaaaccgttacgtacccggaaacggggtaggtaacccgtaaacccccgggg

SEQ ID NO: 49236 - DNA, 735 bp, Homo sapiens
  misc_feature: GYAE6OF01CPOE1.52.77.G11.1.454.CMB.1.raw
  modified_base (188)..(188): a, c, t, g, unknown or other
  misc_feature (188)..(188): n is a, c, g, or t
  modified_base (268)..(268): a, c, t, g, unknown or other
  misc_feature (268)..(268): n is a, c, g, or t
  modified_base (277)..(277): a, c, t, g, unknown or other
  misc_feature (277)..(277): n is a, c, g, or t
  modified_base (297)..(297): a, c, t, g, unknown or other
  misc_feature (297)..(297): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatgggtagtttgggctgagtcgttgggttttcctcgttgcttacgttttaaggaggtntccgagtgtcgaggtgcagtcgtgggtggagtcggtgggggagcgtgtccgagccgtgggacgtcctgacgctctctgancacgtcctntaggtaacttccaacctttnacgttgtacctagtcgaacacgtcggaccgtacggttccgggtacccgaccgacgggtcccaaccggtagggaccggaagggggtcctaggggtacgggtgggtggaccgttaggtacttacgataagttagtagtaaggtacggtaaaagtaagtactagttaatagtacgtacgaacgtaccgtacggtaaggaaccggtccgtaacgtacctaccgtttacttaacgaaacggtaacctaaccgtaaaccctaaccgtaaacggaaacccgtacgttacgtttagttaaacgtttagaaaccgtaaagtacgtaaaccgtgttaccgagtaagcgtacgaaggacggacgtgggttactaggtatttaacggtcgtacgttacgaaaccgtttacgaacggtaccgaaacgggtccgtaaccgttaacccccggg

SEQ ID NO: 49237 - DNA, 827 bp, Homo sapiens
  misc_feature: GYAE6OF01DK3HF.52.77.G11.1.454.CMB.1.raw
  modified_base (389)..(389): a, c, t, g, unknown or other
  misc_feature (389)..(389): n is a, c, g, or t
  modified_base (550)..(550): a, c, t, g, unknown or other
  misc_feature (550)..(550): n is a, c, g, or t
tcagcgcagtacgacacgaccggtgctcgatttagctagtcactcaagggaaagggggggagaggagcccagcactagagtcggcggtgttccattcggtgatcagcactgaacacagagactcaccatggtagtttgggctgagtcgttcgggttttcctcgtttcgcctttacgttttaaggcggttcgtccgtaggttcgtacgtaggtcgacgtggtcggtgggttacgggtacggttcgggtaggggggtacggcggttccgggtcccgacgggtccccggttaggggaccggttccccgtgaacgtccttccgccgttagtcgtctaccggtccttgttacggtacctttccgtaaccttgagttcgtactagtcgtaacgtntccggccgtaccggtaccggtccgaccggtaggaccctccggaagggtccggaaggggtccggcgggttgggtacgggagttacctaaggtttatacgtagtaaaggtttgaagggttaagtaaaaacgggtaattaaagtaacgtttaacgtaacgttanaaccggggttacaccgggttaaccgtcccggtaagggtaacccggtaccgtaaccttaacccgtacccgtttaaaccgttaaccggaacgtaaacctaacccgaaacccttaaacggacccgtaacgtaaccgtacttagtttaacgttaagaaacgtaagtacctaacgacgtactaggactacggagtcggaacgtcggaacttaggttagtagttacgttacgacgtataaaccgttaagaacgacggaacggtaaccggtccggtaaccccgg

SEQ ID NO: 49238 - DNA, 873 bp, Homo sapiens
  misc_feature: GYAE6OF01D8JBJ.52.77.G11.1.454.CMB.1.raw
  modified_base (347)..(347): a, c, t, g, unknown or other
  misc_feature (347)..(347): n is a, c, g, or t
tcagcgcagtacgacacgaccggtgctcgatttagctagtcactcaaggggaaaggggggggagaggagcccagcactagaagtcggcggtgtttccattcggtgatcagcactgaacacagagactcaccagtggtagtttgggcttggagtcgttggggtttttcctcgtttgtacctttacgtttttaaaggaggttcgttcccgtaaggttcggtaccgtaagggttcgcctaacgggtccgttggggtacgggtaggttccgggttagggggggacggtcggtaccggtccgacggtccggtaggggtacgtccctagacgtccttcgtccgtaggtcgacnccgtccgttacgtaggtaccttcccgtaccgtttcgaggtttcgtactaacgttacgactagttcggtacccgtaccgggttcgggtaccccacggtacggtcccgtaccggaacggcgggtaacgggttcggtaaggggtcgggttcggggtagtacggttaaattacgtacgttaccgaagttaggtaggtaagggtttaaaggtaaacgttaagtaacttaacggttaaacgtccggtttgaaaccggttaccggaaaccggtttaccgggaacggtaaaccggggtctttaacccgttaaccgttaacccgttaacgtacgaaggtaacccaacctaaacccgtaccgaaacgtaccgtagttaccgttaagtttacgtacgaaacgtaacgtacgacctagttaccgagtaacgccggtagaacggtacgtcggtacgttaacggttcgtattacgtcggttagtaacgtaacggttaactacggaaccggtacgggtaaaccgtaacccggtaccccggg

SEQ ID NO: 49239 - DNA, 741 bp, Homo sapiens
  misc_feature: GYAE6OF01AGA8Y.52.77.G11.1.454.CMB.1.raw
  modified_base (340)..(340): a, c, t, g, unknown or other
  misc_feature (340)..(340): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgcttcttttaaggaggttgtccagtgtcaggtgcagctgggtggagtcgtgggggaggcgtggtccaggtccgtggggacgtccctgacgactctcctgtcgcagtccctcgtgggactttccacctttcgacggtttgttactactcggtactagttcgacacgttcggggtcccncgtacggctaccgaggacgaaggggcttagggcggttggggtcgactagttatagtcaagtgtacggtagtaacggaagtaacgtagttaactaacggtacgttggaaccgtacgtaaccgttcggtaggtaaccggggtacctaacgtttacccgaacccgtttaagttaccggaacgtaacgaacccttaaacccgtacaaaccgaaccgaccgtacttagtttaacgtttacgaacgttaaacgtacggaaacgtaacggtccgtagtaaacgcgggtacccggttaggaaccggtaccggaacgggttcgtacggttaagttacgttacggttcggtacgtaaccgttaaacgttaacgtaaccggacgggtaaacccgtacggttaaaccccgggg

SEQ ID NO: 49240 - DNA, 885 bp, Homo sapiens
  misc_feature: GYAE6OF01B3K3E.52.77.G11.1.454.CMB.1.raw
  modified_base (209)..(209): a, c, t, g, unknown or other
  misc_feature (209)..(209): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgngggggagcgtggtccagccgtgggacggtccctgacgtacctctcctgtcgcagcctcgtggtacttccaccctttcagttgtctatgactagtcgcctacgtcggggtcccgaccgacggtcctaccggacggacggtaagggggtcctaggggacgggttggggtcggacgttaagttatacgtactaagttaacgtaggtaacgttaagggaaacgttaaaggtaattaacgttaacttagtaccggtacgtaacggtacccgttaccgggtaacgggaaaccggggtacccgttaacgtttaacccctaaccccgtttaacgttttacccggaaacggtaacccggtaaacccgtaaaacccgttaacccgtaaaaccggtaaacccgttacccggttacgttttaacggtttaaacgttttaacccggaaaccttaaaacggttaccggtaaaacgtaacccggttacccggtaacgggtaacgggaacggtaccggttaacggggaaccgggtaacccgttaaccggggtaccgtttaacggggtttaagttttaaaccgttaacgggttacggttaaccggtaaacccgggtttaaaaccgttttaaccgggaacccgggttaaaaccggggtaaccccgggtaaaaccccgggttaaacccccggggg

SEQ ID NO: 49241 - DNA, 666 bp, Homo sapiens
  misc_feature: GYAE6OF01CVFLZ.52.77.G11.1.454.CMB.1.raw
  modified_base (183)..(183): a, c, t, g, unknown or other
  misc_feature (183)..(183): n is a, c, g, or t
  modified_base (260)..(260): a, c, t, g, unknown or other
  misc_feature (260)..(260): n is a, c, g, or t
  modified_base (297)..(297): a, c, t, g, unknown or other
  misc_feature (297)..(297): n is a, c, g, or t
  modified_base (328)..(328): a, c, t, g, unknown or other
  misc_feature (328)..(328): n is a, c, g, or t
  modified_base (367)..(367): a, c, t, g, unknown or other
  misc_feature (367)..(367): n is a, c, g, or t
  modified_base (417)..(417): a, c, t, g, unknown or other
  misc_feature (417)..(417): n is a, c, g, or t
  modified_base (525)..(525): a, c, t, g, unknown or other
  misc_feature (525)..(525): n is a, c, g, or t
  modified_base (554)..(554): a, c, t, g, unknown or other
  misc_feature (554)..(554): n is a, c, g, or t
tcagcgcagtacgacacgaccggtgctcgatttagctagtcactcaagggaaaggggggggagaggagcccagcactagaagtcggcggtgttccattcggtgatcagcactgaacacagaggactcaccatggagtttgggctgagcgttgggtttttccctcgttgctacgttttaaaggnggttcgtccagttgtccgaggtgcaggtctgggtaggagtcgtaggggggagcgtggtccagccgtggggacgtccngacgtctctccgtgcgcacgctcgtggacttcacctnagtctctatgacagtcgctacgtgggtcccncgacgcctcgaggcgaaggggctagggaggtgggtacgngtaagtttacagatagtagtgaagtaggaaagtaagaacttatacgttangcaaggtactaccggtaggaacgggaccgtattaccaaccgtattacgaagtaacgaacctaacaaccgaaacggaacaacgtactaaggtatttaaccgaagtaaanacgtaaaccagtaccgtagaacgtaacgngaagggaacgaccggtactacggttagttagttaaacgttcgtaacgggttctaaacccggtaaagtttaacggaaccgaaagggaaaccgggtaaacgtaaacccccgggg

SEQ ID NO: 49242 - DNA, 778 bp, Homo sapiens
  misc_feature: GYAE6OF01CYES7.52.77.G11.1.454.CMB.1.raw
  modified_base (656)..(656): a, c, t, g, unknown or other
  misc_feature (656)..(656): n is a, c, g, or t
  modified_base (662)..(662): a, c, t, g, unknown or other
  misc_feature (662)..(662): n is a, c, g, or t
tcagcgcagtacgacacgaccggtgctcgatttagctagtcactcaagggaaaggggggagaggagcccagcactagaagtcggcggtgtttccattcggtgatcagcactgaacacagaggactcaccagtggagtttgggctgagtcgttgggttttcctcggttgtccttacgtttttaaggaggttcgtcccgtaggttgttcgagggtgctaggcgtgggtggaggtcggtggggggacggcggttcggtccgaggtcccgtggggacggtcccgtggacgtccttctccttggacgtcagccttgtacgtactttaccaccgttctacggttgttacctaagtacggactgtccgtacccgttacggttccggggtaccgaccggacggtccgtaacccggaggggtaccgggaacgggggtcgttagggggtacgggtacgggggttacgtaacgttagttagttaacggtccttaaggtttaacgtagggtaagttaagggtaaacgtaaaggtacttagtttaaacgagttacggcctacggtacggttaccggtaggtaaccgggaccttacgtaccgtaacttacgtacgaacgtacgaccaactacgaaacgcagttcgtagtacgtagactaagtacgaacgngtacgngacgcgtcggtaacggagtacccgtggttacgttagttacgttaagttccgttaacggttaagtaaccgtttaaacgtacgtaacggacgggtaccggtaacccggttaccccggg

SEQ ID NO: 49243 - DNA, 941 bp, Homo sapiens
  misc_feature: GYAE6OF01B37B5.52.77.G11.1.454.CMB.1.raw
  modified_base (271)..(271): a, c, t, g, unknown or other
  misc_feature (271)..(271): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagtcgtgggtttttccctcgttgcttcttttaaggaggtgtccagtgtcgaggtgcgagcgtgggtggagtcggtgggggaggtcgtggtccagccgtgggacggtccctggagtactctccgtgngcagccctgtgtattccgaccttcaggttcgtactagtcgacagtcgaccgtacgttcggggtccccgacgtacggggtccctaccggaacgggaccgggtaaacggggggtccgttaggggggtaacgggtttcggggggtacgggttaaccgtttaagggtttaaacttacgtttaaccgaagtttaaggtaagggtaaaacgtttaagggggtaaaaccgttaaaaggttactttaaacggtttaaccgtttacggtaggtaacccgtaagtaacccgttacccggggtaacggtaaacccggggtaccgttaaccgtttaacccgtaacccgttaaccgttttacccggaaacggtaacccgttaaacccgtaaaaccccgttaacccgaaaacgggtaaacccgaacccggtttacgtttaacggtttacggtttaaccgaaacgttaaaacgttaccggaaaaccgtaccggtaaacccgttacgggtaaccgggacggtaccgtaaccggggaaagggttaaccccgaaccggggtttacgtttcgggtttaaccggtttaaacgttttacggccgggtttaagtaaacccgggtttaaacttaaccccggtaacgggtaaaccgggggtaacccgggtaaaccccgggttaacccccggggg

SEQ ID NO: 49244 - DNA, 778 bp, Homo sapiens
  misc_feature: GYAE6OF01D03IL.52.77.G11.1.454.CMB.1.raw
  modified_base (217)..(217): a, c, t, g, unknown or other
  misc_feature (217)..(217): n is a, c, g, or t
  modified_base (239)..(239): a, c, t, g, unknown or other
  misc_feature (239)..(239): n is a, c, g, or t
tcagcgcagtacgacacgaccggtgctcgatttagctagtcactcaagggaaaggggggagaggagcccagcactagaagtcggcggtgtttccattcggtgatcagcactgaacacagaggactcaccatggagtttgggctgagcttgggttttcctcgttgcttcgttttaagaggtgtccagtgtcaggtgcagcgtggtggagtcgtggggngcgtggtccagcgtggagtccngagactctcctgtcgcagtcctacgtgacttccgacctttcgaggttcttacgtatcgaacgtgtcgtccgtacggtcggggtacccgaccgtaacggccgttacccgacgggcgtaagggggtccttggggaacgggttcgggtggtacctaaggtttaacgtaagtctaaacggttaagtagtaggttaacggaaaagttaagaacttaataccgttagtacgaactaacgtaccgtaccggtaaggtaaccgggtaccgtaactttaccctaaaccgtttaacgtacccgtaaacggtaaaccggtaaccctaaacccgtaacccggtaaaacgtaaccgtaacccggttacgtttaacggttaacttttaaccggaaacgttaaaacggtaccggaaaaccgttagaccgtaagttacggtaacggacgtaacgtagggaaccggaacggtaccgtaccggttaggttaccgttaagttaccgtggttaacgtaaccgttaactttacgaaccgtacgggtaaacgtaacccggg

SEQ ID NO: 49245 - DNA, 495 bp, Homo sapiens
  misc_feature: GYAE6OF01CFRH2.52.77.G11.1.454.CMB.1.raw
  modified_base (454)..(455): a, c, t, g, unknown or other
  misc_feature (454)..(455): n is a, c, g, or t
  modified_base (457)..(495): a, c, t, g, unknown or other
  misc_feature (457)..(495): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgacgaacttaatcaccgaggacaacggtgacccccgtcgctcggtgcggacgtcgtggggccaacgggaccacggtcagcgtctcctacacgcctccaaccgaaggggtccccaatccggtcccttccccccgtgggcctaccccgtccctaccgaaacgaccggtccacccgtccggtggggggccaaccgtcggccgggccccgtggggcccttcggcccgttgggtaccaaacgggaccttaacctttcccgtataacccgacttcggactggacgcgggcgtcggacgaacgcggacagtggnngnnnnnnnnnnnnnnnnnnnnnnnnnnnnnnnnnnnnnnn

SEQ ID NO: 49246 - DNA, 734 bp, Homo sapiens
  misc_feature: GYAE6OF01BKDOH.52.77.G11.1.454.CMB.1.raw
  modified_base (104)..(104): a, c, t, g, unknown or other
  misc_feature (104)..(104): n is a, c, g, or t
  modified_base (459)..(459): a, c, t, g, unknown or other
  misc_feature (459)..(459): n is a, c, g, or t
  modified_base (466)..(466): a, c, t, g, unknown or other
  misc_feature (466)..(466): n is a, c, g, or t
  modified_base (500)..(500): a, c, t, g, unknown or other
  misc_feature (500)..(500): n is a, c, g, or t
  modified_base (508)..(508): a, c, t, g, unknown or other
  misc_feature (508)..(508): n is a, c, g, or t
tcagcgcagtacgacacgaccggtgctcgatttagctagtcactcgaaaggggaaaggggggagaggagcccagcactagaagtcggcggtgttccattcggtnatcagcactgaacacagagactcacgatgggagtttcgggctggagtcgttgggttttccctacggtttgtcgtttacgttttaaggaggttcgtccgtaggttgtcagggtgcgaggtcgtgggtcggtacggtcgggtagggggacggtcgtcgggtaccacggtccggtaggggtaccgttccgtagaacgtccttcgtccgttaggccgcgttacgccgttgtacggttaccttaccgtccgttagtaggttctacttacgagaccgtgtcgaccgtacggtcggacccgccgacggttccgaccggagggaccggaggggtgacgggtggtaggtacggtactaggttanaacgttnaagtagacggtagaacggtaaagtatagttaacnctaaggtnaacgtccgacgtacggtaacgacggtctaacgtactacgtactacgaacgaactacccgaataacccgatacgcgttacgtagttaacgtacgtaactaacgtacgtactacggaccgtaaggcgacgtacgaggtaactaccgggcggttagttactaggtagttgtcccggtaaagtccgttaaacggacgaaagggtaccgaccgggtaaccggtaaccccgg

SEQ ID NO: 49247 - DNA, 837 bp, Homo sapiens
  misc_feature: GYAE6OF01EUBA6.52.77.G11.1.454.CMB.1.raw
  modified_base (220)..(220): a, c, t, g, unknown or other
  misc_feature (220)..(220): n is a, c, g, or t
  modified_base (566)..(566): a, c, t, g, unknown or other
  misc_feature (566)..(566): n is a, c, g, or t
tcagcgcagtacgacacgaccggtgctcgatttagctagtcactcaaggggaaagggggggagaggagcccagcactagaagtcggcggtgtttccattcggtgatcagcactgaacacagacgactcacctagtgggtagtttgggctggagtcgttcggggtttttcctcgttgtctttacgttttaaggaggttcgtcctaggtcgtacgagggtcnctaggtcgttgggtgggtaacggttcgggtggggggacggtcggttccgggtcccaggtcccggttaggggaacgttcccctaggtacgtacccgttcgttacccgttggtcgaaccgtcgtcccgttcggttacgttacttccctacccgttagtacggtcgttacctagtcgtaacgtgttcgtaccgtacgggtccggtcccgacgggtacccggcccgttaaccgggacgggtaccggtaacgggggttcgtacgggggtacgttggggttacgacgtttaaaggttacttaacgtcgtaaagttcgttaaggaagtttaggaaaacgttaagtacgtttanaaccgtttgacggactaaccggttacgtcgggacgtaaccggtacttacgtacctaacgtagttaaccgaagtaaccacctaaccgtaaccgaaacgtacgtcgttagttaccgttagtaacgtagtaaacgcgtaaccgtacgaggttacgaacgggtactaacgggtacggtaacgttaccggtaacggttgttaccggttaagttcttagtaaccggtgttaaacctagtaccgtaacggacgggttaaccgacccgggttacccccg

SEQ ID NO: 49248 - DNA, 774 bp, Homo sapiens
  misc_feature: GYAE6OF01CXNS6.52.77.G11.1.454.CMB.1.raw
  modified_base (234)..(234): a, c, t, g, unknown or other
  misc_feature (234)..(234): n is a, c, g, or t
tcagcgcagtacgacacgaccggtgctcgatttagctagtcactcaaggggaaaggggggagaggagcccagcactagaagtcggcggtgttccattcggtgatcagcactgaacacagaggactcaccatggtagttggactgagtcgttgggttttcctcgttgcgttacttttaaggaggttcgtccgagtcgtcgaggtgacgtagtcgtggtggagtcggtggggacgngtcgacgagccgtgggacgttcccgagacgtacttccgtccgttggtgccgtacgtccttcgttacgtaaccttcgtaacctttcgtacgttcgttaacgttgaaggtactacggttcgaccgtaccgggttccggacccgtaccggcgacccgtaccggaagggtaccggaagggttccgtacgggtaggttcgggtagtaaccgttagttaacgtagtacgttagtaagttaggaacgtaaagtaggtaaataacgttactaagtacgtagtaccgacgtccgtacggtacgtacggacgtacttacgtactacgttccgaaagacccgtaacaaccgtaccaaacgtaacgaccgtacgttacgtaacgtttacgaaacgtaaagtacgtaaacgcgaacgttaacgaagtcggaacgtaccggaaacgtaccggtaccgttggtacgtttaaccgttagtttaccgaggttaccgttaaacggtaaaccgttagtaacccggtaacgggaaaccgggttaacccggtaaccccggg

SEQ ID NO: 49249 - DNA, 819 bp, Homo sapiens
  misc_feature: GYAE6OF01BIRK3.52.77.G11.1.454.CMB.1.raw
  modified_base (62)..(62): a, c, t, g, unknown or other
  misc_feature (62)..(62): n is a, c, g, or t
  modified_base (161)..(161): a, c, t, g, unknown or other
  misc_feature (161)..(161): n is a, c, g, or t
  modified_base (182)..(182): a, c, t, g, unknown or other
  misc_feature (182)..(182): n is a, c, g, or t
  modified_base (206)..(206): a, c, t, g, unknown or other
  misc_feature (206)..(206): n is a, c, g, or t
  modified_base (250)..(250): a, c, t, g, unknown or other
  misc_feature (250)..(250): n is a, c, g, or t
  modified_base (503)..(503): a, c, t, g, unknown or other
  misc_feature (503)..(503): n is a, c, g, or t
  modified_base (534)..(534): a, c, t, g, unknown or other
  misc_feature (534)..(534): n is a, c, g, or t
  modified_base (546)..(546): a, c, t, g, unknown or other
  misc_feature (546)..(546): n is a, c, g, or t
tcagcgcagtacgacacgaccggtgctcgatttagctagtcactcaagggaaaggggggganaggagcccagcactagaagtcggcggtgttccattcggtgatcagcactgaacacagagactcaccatggagtttgggctggagtcttgggttttcccncgtttgcttacttttaaaggnggtcgtaccaggttgtcgagggtncgaggtcgtgggtggacgtcggtggggggacgtcgttcggaccnggtcccggttggggaccgtccctaggtaccgtccttcgtccgttaggcgccgaacgtccccgtttagtcggttaacttcccgttaaaccgttcgaaggtttcggtaaccttaaggttacgaaacttagtcggtaacccggtaaccggttccggggggtacccacccgtaaggtcccgtaaccggtaacggacgggtaaacggggtccgttaggggtagggtccgggttaagacttaaaggtttactacgttanaacgttagacggtaaggtaaggtaaagtaanacgttaacgtanacgtggaaccgtacgtacggttacggtaggtaaccggtcgttaacgtacctaacgttacgttacccgaagaaaccgttacgaaacccttaacgaaacgtaccacgttacgttaacgttacgtaacgtaaacgtaactaaacgagtaccgtaccgtaagtacggtacgacggtacggaaacgtcgtaacgggttcgtagttaaccttacggttaccgtagttaaaccgacgttaaacgttacgtaacggaacgggtaacgacccggtaacccgg

SEQ ID NO: 49250 - DNA, 954 bp, Homo sapiens
  misc_feature: GYAE6OF01AZ3A4.52.77.G11.1.454.CMB.1.raw
  modified_base (175)..(175): a, c, t, g, unknown or other
  misc_feature (175)..(175): n is a, c, g, or t
  modified_base (259)..(259): a, c, t, g, unknown or other
  misc_feature (259)..(259): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagnggtgtccagtgtcagtgcagctgggtggagtcgtgggggagcgtgggtccaggccgtaggggacgtccctggagtcctctccgngtacgcagtccctgtggtactttcccgtacctttcgaaggtttcgtaccttaagtcggaacctagtttcggacccgttaaccggtttcgggggtacccctcccggaagggtccccttcccgggaaaggggtacccggaaacgggggggtccgttggggtaacggggttcgggggtacgggtacgtaagggtttttaataacgttcgtaaaacttttaggtaggaaggttttagggggaaaaccggtttaaaaggtaccttttaaaacggttaaccgttaaagtttaccgggaccgtaacggtaaccccgggttttacccgggtaagggtaaccggggggtaacccgtaacgttttaaccccggtaaccctttaaccgtttttaccccggaaacgggttaaaccgtaaaccccgtaaaaccgtttaaccccgaaaaacgggtaaaccccgtaccgttaaccggttttaaccgtttaagggttttaaccgaaacgttaaacgttaaccggaaaccgttaccgtaccggttaggaaccggtaggtaccggttagggaaccgggtaaaccggtccgggttacgttcgggtttaaggtttaacggtttaccgttacgggttaccggttaaccggtttaaacctttaacgggtaaccggtaaaccgggggtaaccgggtaaccgggttaaaccccccgggg

SEQ ID NO: 49251 - DNA, 791 bp, Homo sapiens
  misc_feature: GYAE6OF01EFOWS.52.77.G11.1.454.CMB.1.raw
  modified_base (189)..(189): a, c, t, g, unknown or other
  misc_feature (189)..(189): n is a, c, g, or t
tcagcgcagtacgacacgaccggtgctcgatttagctagtcactcaaggggaaaggggggggagaggagcccagcactagaagtcggcggtgtttccattcggtgatcagcactgaacacagaggactcaccatggagtttgggctgagcgttgggttttcctcgttgtccttagttttaaggaggttntccaggttgttcgaggtgcagcgtggtggagtcggtgggggagtcgtggtcgagccgtgggacgtccctggacgtaccttccgtccgttggtcgacctacggcccttgtacggtacttcctaaccttcgaggtttcttacgtatacgtacgtaagtccggtaccctaacgggttccggggtaccccgtaccggacgggtacccgtacccggaaggggtaccgggtaacggggtccggtaggggtacgggttacggggtacggtactaaggtttagtacgtacgtagttaacgtggtaaaggtaaggtaaaaccgttagaaactttacgtaaacgttgacgtacgaacggtaccgttacggtaagggtaccggaccgttattacccgtaactacgttacgacggaactaccgaactaacgaaccgtactaggtaccgtttagtacttagaacttaagtacgacgtaccgtacgtagaggacgtcggtaacggaaccggtcgaaccggttggttaacggtttagtaaacgtttccggaggttcgtaaaaccgttaactaacggtaacgggttaacccggaacggggtacccttaacccccgggg

SEQ ID NO: 49252 - DNA, 895 bp, Homo sapiens
  misc_feature: GYAE6OF01D8GPK.52.77.G11.1.454.CMB.1.raw
  modified_base (214)..(214): a, c, t, g, unknown or other
  misc_feature (214)..(214): n is a, c, g, or t
  modified_base (282)..(282): a, c, t, g, unknown or other
  misc_feature (282)..(282): n is a, c, g, or t
tcagcgcagtacgacacgaccggtgctcgatttagctagtcactcaagggaaaggggggggagaggagcccagcactagaagtcggcggtgtttccattcggtgatcagcactgaacacagaggactcacatggagtttgggctgagcttgggttttcctcgttgcttcgttttaagaggtgtccgtagtgtcaggtgcagctggtggagtcgngggggagcggtggtccaggccgtagggacggtcccgtgacgtacctctccgtgtcggccagtcccgtnttggaactttccctacctttcgaaggttcgttccttagtacgaactagttcggacctacggttcgggggtccccaccggtacgggtcctacccggagggaccgggaaggggtcctgggggaacggtgggggtacgtagtaacgtttagatcgtaattacgtaggtaggttacgggtaaaaagttacgaagttaacttacggttagttacgaacccgtaaggttaacccggttccggtaaggggtaaaccggggtccgttaaccgtttacccgtaaaaccccgtttaacgttttaacccggaaacggtaaaccggtaaacccgtaacccgttaaaaccccgaaacggtaaaaccccgttacccggtaacgtttaacggttttaccgttaacgaaaccggttaaaccgtaacgtaaacccgtaaaccggtacccgtaagggtaaccgggaacggtaccgtacgggtaaaccgggtacgtaaacccggggtttccgttaggggttttaccggttaaattttaccgggaggtttaaccggaaacccgtttaaaacgggttaaccttaacccgggaaacgggttaacccggggaaaacccgttaaaccccccgggggg

SEQ ID NO: 49253 - DNA, 756 bp, Homo sapiens
  misc_feature: GYAE6OF01E40GA.52.77.G11.1.454.CMB.1.raw
  modified_base (166)..(166): a, c, t, g, unknown or other
  misc_feature (166)..(166): n is a, c, g, or t
  modified_base (205)..(205): a, c, t, g, unknown or other
  misc_feature (205)..(205): n is a, c, g, or t
  modified_base (368)..(368): a, c, t, g, unknown or other
  misc_feature (368)..(368): n is a, c, g, or t
  modified_base (436)..(436): a, c, t, g, unknown or other
  misc_feature (436)..(436): n is a, c, g, or t
  modified_base (678)..(678): a, c, t, g, unknown or other
  misc_feature (678)..(678): n is a, c, g, or t
tcagcgcagtacgacacgaccggtgctcgatttagctagtcactcgaaggggaaaggggggggagaggagcccagcactagaagtcggcggtgtttccattcggtgatcagcactgaacacagaggactcacatggtagtttgggctgagtcgttcgggttttccncgttgcttacgtttaaggaggtcgtccagtgtcgaggtncagtcgtggtggagtcggtggggagtcgtggtccaggccgtagggaccgtcctagaccgtactccgtcgtagtcgcgacgtccgttgtacggttactccgttacccttggagtttcgtaccttagtacgaccgtagtccgacgttaccggtccggggtacccnccggtaacgtccgacgggacgggacggtaacgggtgtggggtacggttcgggacgaacttaaggttanagtaacagttagagtaagtaacgtaaacggtatattaacgtactaagcgacgtacgtacggttacgaagggtaccgtactaacgtacctaacgttaactaccgaagtaaccgtaaacctacgtaaaccgaagtaccgttacgtacggttaatacgtacgtaaacaaggtaccaacgtaccgagttaacgagaccgtacggaacggacggtaacccgtggttcgttaaggttacggtttaacncgggttaaccggtaaccgaacgtttaaacggtaaccgtaaacccgggtacgggaaaacccggtccgggttaaccccgg

SEQ ID NO: 49254 - DNA, 819 bp, Homo sapiens
  misc_feature: GYAE6OF01BTVPL.52.77.G11.1.454.CMB.1.raw
  modified_base (198)..(198): a, c, t, g, unknown or other
  misc_feature (198)..(198): n is a, c, g, or t
  modified_base (431)..(431): a, c, t, g, unknown or other
  misc_feature (431)..(431): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagtcttgggttttcctcgttgcttacgttttaagaggtgtccagtgtcaggtncagctgggtggagtcggtagggggacgcggtcggtccagtccggtggggacgttcccgtgacgtactcctcctggtcgccgactccttgaggttactttccgtaccctttgaaggtttcttacctagtacggtactagttcgacgtacggtcgggtcccgacgtacggtcgacccggaggtcccggaaggggtccgtagggagggttcgggtcgtacgttacggttataagtntaatagtacgtaaggtacggtaaataaaggtactttaacgtagtacgtaggtaccaaggttaacccgttaccggtaagggtacccgggtaaccggttaccttaccggtaaaccccttaagttacccgtaaaggaaccgtaacgtaaacccgttaacccgaaacggtaacctaaccgttacctttaaggttaccttttaaagaacgtaacgaacgtaaccgaaccggttccgtaaaggacgtaagtacccgggacgggtaaaccggaccggtaacgggttcgttacggttaacgttacgttaacccggttcggttaaccgtaaaccgttaaaccggttaaacgaacccgggttaaccgggaaaccgggtaaacccggttaccccccggg

SEQ ID NO: 49255 - DNA, 720 bp, Homo sapiens
  misc_feature: GYAE6OF01D0UB9.52.77.G11.1.454.CMB.1.raw
  modified_base (197)..(197): a, c, t, g, unknown or other
  misc_feature (197)..(197): n is a, c, g, or t
  modified_base (256)..(256): a, c, t, g, unknown or other
  misc_feature (256)..(256): n is a, c, g, or t
  modified_base (279)..(279): a, c, t, g, unknown or other
  misc_feature (279)..(279): n is a, c, g, or t
tcagcgcagtacgacacgaccggtgctcgatttagctagtcactcaaagggaaagggggggagaggagcccagcactagaagtcggcggtgtttccattcggtgatcagcactgaacacagaggactcaccatggagtttgggctgagcttgggtttttcctcgttgcttcttttaagaggtgtccagtgtcaggtncagctggtgagtcgtggggagcgtggtccagccgtgggacgtccctgagtactctctgngcagcctcgtgtacttcaccttnagttcgtactatcgacacgtcgtccgacgttcgggtacccgccgacgggccctaccggaggtccggaaggggtccgttaggggacggtggggttacgggtaccttaaggtttaataacgtttccgaatttaaaggtcggtaaaggtttaaggggaaaagttaaaagtattaaacgtttaacttaagtcgaaccgtaacgtcccgttaccggtaacggaacgggtacctacgttaccgtaaccgttactttaacccgaagtaaccaacctaacctaaccgaaacgtaaccacgtactttacgttacttcgaaacctaagtaacgaacgtacgtacgtacgaagtacgagtacggaacggacgtaccggtcgttagttagttacgttcgtacggtactaacggttaactaacgtacgtaaccgggacgtaccgtaaacccggg

SEQ ID NO: 49256 - DNA, 812 bp, Homo sapiens
  misc_feature: GYAE6OF01D3J6P.52.77.G11.1.454.CMB.1.raw
  modified_base (207)..(207): a, c, t, g, unknown or other
  misc_feature (207)..(207): n is a, c, g, or t
  modified_base (342)..(342): a, c, t, g, unknown or other
  misc_feature (342)..(342): n is a, c, g, or t
tcagcgcagtacgacacgaccggtgctcgatttagctagtcactcgaaaggggaaaggggggggagaggagcccagcactagaagtcggcggtgtttccattcggtgatcagcactgaacacagagactcacatggagtttgggctgagtcgttgggttttcctcgttgcttacgttttaagaggttcgtccagttgtacagggtcncaggtcgtgggtggaggttcggtgggggggacggtcgtcgggtccacggtccggtgggggtacgtccctaggacgtccttccgttccgtggcgcacgtccttctcggtacttcctacctgtagtgtctatcgatntcgcgtacgtcgggtcccgccgaggtcctaccggacggtacgggaaggggcgtgggtacgggtggggtcggtactaggtttaatagtacttaagtacgtagtaaggtaaggtaaaagttaagaattaagtactaagtacgacgtaaccggttaccgttaccgggaagggaaacccggggtcccttaaattccccgtaaaccctttagttaacccggaaagttaacccaaccctaaaccgtaaccgaaaacgtaccctaccggtgttttaattacgtttaaacgagtaaaactacggtaaacctaccggtaactagggaacccggtagtacggtaaacgggaacgggacccgttggggttaacgttgggttttaacctttaaggtttccgtaaggttaccgggttaaaacttaaccccttaacgggacgggaaacccggggtaaaggggtaaccccgtaaacccccggggg

SEQ ID NO: 49257 - DNA, 843 bp, Homo sapiens
  misc_feature: GYAE6OF01EX9D7.52.77.G11.1.454.CMB.1.raw
  modified_base (174)..(174): a, c, t, g, unknown or other
  misc_feature (174)..(174): n is a, c, g, or t
  modified_base (662)..(662): a, c, t, g, unknown or other
  misc_feature (662)..(662): n is a, c, g, or t
tcagcgcagtacgacacgaccggtgctcgatttagctagtcactcaagggaaagggggggagaggagcccagcactagaagtcggcggtgtttccattcggtgatcagcactgaacacagagactcacatggagtttgggctgagcttgggttttcctgttgcttgttttaagnggtgtccaggtgtacgaggtgcaggtctgggtgaggttcggtggggggaggtcgttacggtccaggtccgtggggtacggtccctggacgtaccttcgtccgtggtcgaccacgtccttcgtcggtacttaccgtaccttgacggttacttccgtaatcgtacctagttacgtcccgtacggttccggggtacccgtccggtacggtaccgtacccggaacgggtacggggaacgggttcggtaggggggtaccgggtttggggtacggtacgttaaacgtttaaccgtagttaccgttaagtacgttaggtaagttaaggaaaacggttaataattaacgtaacgttaagtcggacgtaaacggtcccgttaacgggaaggttaaccgggtaccgtaacgtttaccctaaacggttaaccttaaccggaacgtaaacccgtaaccttaaacccgtaaccgtaaaacggaaacccgtttaacccgggnttttaaaccggtttacgttaaacggacgttaaacgtaccgttaaacgacggttaccgtaaggacgttacgtacggtacggaacgggtacacgggttaccgttgtacgtttagttacgtcgggttaactaaacggttaaccgtaacgtaacgggtaacgggtaaaccgtaacggtaacccgg

SEQ ID NO: 49258 - DNA, 792 bp, Homo sapiens
  misc_feature: GYAE6OF01AQ3Q3.52.77.G11.1.454.CMB.1.raw
  modified_base (179)..(179): a, c, t, g, unknown or other
  misc_feature (179)..(179): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagtcttgggttttcctcgttgcttacttttaagnggtgtccagtgtcgaggtgcagcgtggtggagtcgtggggggagcgtggtccagccgtggggacgtccctggacgtactctccgtgtcgccagtcctcgtaggtacttccaccttgagttgtctatcgaacctagtcgccgtaccggttcgggtcccgaccgtacggcccgtaccgagggtaccgggtaaggggtccgttagggggtacggttgggggtacggacgtttaacggtttaatacgttacgtaagtttagtaggtaaagttaggggtaaaagttaagtaagtttaactaacggttatacggacgttaacggtacccgttacggtacggaaccgggttactaccgttacctacccgttaacgtttacccgaaggtaaccgaaccctaaccttaaccgaaacgtaccgtaccgtacgtttagttaccgtttacgaacctaaacgtacgaaccgtacggtaccgtaaggaccgtacggtaccgtacgggtaaccggtaccgtaacgggttccttagggttaagtttacgtttacggtacggttacgtaaaacgttaaccgttaacggtaccgaacccggggtaaacggttaacccggtaaaccccgggg

SEQ ID NO: 49259 - DNA, 656 bp, Homo sapiens
  misc_feature: GYAE6OF01EWCTH.52.77.G11.1.454.CMB.1.raw
  modified_base (385)..(385): a, c, t, g, unknown or other
  misc_feature (385)..(385): n is a, c, g, or t
  modified_base (598)..(598): a, c, t, g, unknown or other
  misc_feature (598)..(598): n is a, c, g, or t
tcagcgcagtacgacacgaccggtgctcgatttagctagtcactcaagggaaaggggggagaggagcccagcactagaagtcggcggtgtttccattcggtgatcagcactgaacacagaggactcaccatggagtttgggctgagcgttgggtttttcctcgttgtcttacgtttttaagaggttgtccaggtgtcaggtgcagcgtggtggaggtcgtgggggaggcgtggtccagccgtggggacgtccctggagtctctcctgtgctagccttcgtggtcttccgaccttcgagttgtctatcgactattgcctacgtcgggtcccgccaggcctccgaggacgaacggggcgtgggaggtggggtcgagtacgttatacntatagtgagttaggaagttaacgattatacgtagtgacagtacgtcggaaggaacgggtacgtattccgtaacctactttacgaagtaacgaactaaccgaaccgaagaaactaccgtcttaggttattagtaacctaaagtacgaacgtacggtcctagtaggacgtcgtagggaccgaacgtaccggttataggttagttacgtttaacgnggttacggaaccgttaaacgttaaccgtaggaaccggtaacggacgtaaaccccgggg

SEQ ID NO: 49260 - DNA, 930 bp, Homo sapiens
  misc_feature: GYAE6OF01E5DOD.52.77.G11.1.454.CMB.1.raw
tcagcgcagtacgacacgaccggtgctcgatttagctagtcactcaagggaaaggggggggagaggagcccagcactagaagtcggcggtgtttccattcggtgatcagcactgaacacagaggactcaccatggagtttgggctgagcttgggttttcctcgttgtcttcttttaagaggtgtccagtgtcgaggtgcagcgtgggtggaggtcggtggggggagcggtggtccaggcccgtggggacgtccctgacgtaccttcctcctggtgccacgtcccttcgtggtactttcctaacccgtttcgtaggttcgtacttaagttacgaaccgtagttccggccgttaccgggttccgggggtaccccgtacccggaacggggtccccttaccggggaaaccggggaccgggtaaacggggggtcggttacgggggtaaggggttcggggggtacggtaccgttaaggtttaacttaacggttcctaaagtttagggtaaggtaaacgggtttaaaggggtaaaaagttaaacggttaatttaaacttaaccgtaagtcggtaaccgtaaccggtacccgggttaccggaagggtaaacccgggtcccgtaactttacccctaaccgttaacttaaccggaacgtaaaccgtaaccctaaaccccgttaacgaaaaccggtaacccgttacgttacgttacggtttaacgttaacaaaccggttaaaagtacccgaaaccggttacgtacccgtaagggtacgtaacggggtacctaaacgggggtacccggtaaacccggtccggttaggttaacgggttttagttaaacccgtttaaccgggttcgaaacgggtttaaaacccttaaacgttaacccggaacggggtaacccgggaaaccgggtaacccggtacccccccgggg

SEQ ID NO: 49261 - DNA, 741 bp, Homo sapiens
  misc_feature: GYAE6OF01D3PY6.52.77.G11.1.454.CMB.1.raw
  modified_base (348)..(348): a, c, t, g, unknown or other
  misc_feature (348)..(348): n is a, c, g, or t
  modified_base (383)..(383): a, c, t, g, unknown or other
  misc_feature (383)..(383): n is a, c, g, or t
  modified_base (502)..(502): a, c, t, g, unknown or other
  misc_feature (502)..(502): n is a, c, g, or t
tcagcgcagtacgacacgaccggtgctcgatttagctagtcactcgaaagggaaagggggggagaggagcccagcactagaagtcggcggtgtttccattcggtgatcagcactgaacacagagactcacatgggagtttgggctgagtcgttgggttttccctcgttgcttacgtttttaaagcggtgtccagttgtcgaggtgcagtcgtgggtggagtcgggtaggggggacggtccgttcgggtccaggtcccggtaggggtacgtccctaggacgtaccttccgtccgtaggtcgcctacgtcctcgtgtaccttccgtaaccctttgagtttcgtacgtaancggtaactcgtacgccgtacggtccggggtccccnccggacggtccctaacccggagggtacgggtaggggtccgtgggacgggttggggacgtacgtagtttcagtactagtaggtagtaaggtagtaaaagtaacgtaattagtaactagcncgtaacgtcccgtacggtagacggtcctagtcctaaacttacgtacgacgtaaacacctaacctaacgaacgtaacctacgtcttagttacttaagaacgtaagtccaaagttaccgataaggtcgacgaggtaacgggacgacggttacgacgttttagtagtttatccgttggtaaccgttaaaccgttaaacgtcggttaaccggtaacgggaaaccggtacccggtaaccccggg

SEQ ID NO: 49262 - DNA, 716 bp, Homo sapiens
  misc_feature: GYAE6OF01AS8N0.52.77.G11.1.454.CMB.1.raw
  modified_base (286)..(286): a, c, t, g, unknown or other
  misc_feature (286)..(286): n is a, c, g, or t
  modified_base (314)..(314): a, c, t, g, unknown or other
  misc_feature (314)..(314): n is a, c, g, or t
  modified_base (362)..(362): a, c, t, g, unknown or other
  misc_feature (362)..(362): n is a, c, g, or t
tcagcgcagtacgacacgaccggtgctcgatttagctagtcactcaagggaaagggggggagaggagcccagcactagaagtcggcggtgttccattcggtgatcagcactgaacacagaggactcaccatggagtttgggctgagctgggttttccctcgttgctcttttaagaggtgtccagtgtcaggtgcagtctggtggagtcgtgggggagcgtggtccagccgtggggacgtccctgagactctcctgtagcagcctcgtggattccacctttgagttntctatgactagtgctacgtcgggtcccnccgaaggtcctaccgaagggccgaagggggtctagggaggttcggggngtactaggtttaatagtccaattagtaggaagtagggaaacgttaagtacttaagtacctaagtcgacctaaggtaacccgttccggtacggaacgggtaccgtacttacccgaacccgttaactttacccgaacgtaacgtaacctaaacccgttaacccgaaacgtaaccgaccgtacgttaggttactttacgtaacgtaaagtacgtaaccgtacgacccgtaggaacgacggacgtacggtacggtaaccgtaccgggtacgttacggttagttacgttacggttaggtacgtaacgtaaaccgtttaacgtaaccggacgggtaaaccgggtaaccggtaaacccggg

SEQ ID NO: 49263 - DNA, 749 bp, Homo sapiens
  misc_feature: GYAE6OF01AS4HZ.52.77.G11.1.454.CMB.1.raw
  modified_base (178)..(178): a, c, t, g, unknown or other
  misc_feature (178)..(178): n is a, c, g, or t
tcagcgcagtacgacacgaccggtgctcgatttagctagtcactcgaagggaaaggggggagaggagcccagcactagaagtcggcggtgtttccattcggtgatcagcactgaacacagaggactcaccatggagtttgggctgagcttgggttttcctcgttgcttcgttttaagnggtgtccagtgtcaggtgcagctgggtggagtcggtgggggagcgtggtccagccgtgggacgtccctgagcctctctgtacgcacgtcctgtggtacttccgacctttcgagttcgtactatggaccagttcgaccgacggttcggggtcccaccgtacgggccctaccggaagggccggaacgggggtctaggggagggttcggggtgacgtagtttaactacgtgtaattggtaggaagtagggaaacttaaagtcgttaaataccgtagtcgaactacggtacccgtcggtaaggaaccggtcctaacttccaacgttacgttacgaacgaacgaaccctaaacgtaccgaaagtacccgtacgtacgttacgttaacttacgaactaagtacgaacggtacgtaccgtaagggaacgtaccggtaccgtaacgggtaacggtaccgtaccgggttatttcgggttaacgtttaacgtttcggttacggtaacccgttaaacgttaaaccgtttaacggaaaccccgggtacgggtaaaacccggttaccggtaaaccccccggggg

SEQ ID NO: 49264 - DNA, 748 bp, Homo sapiens
  misc_feature: GYAE6OF01EWMR3.52.77.G11.1.454.CMB.1.raw
  modified_base (198)..(198): a, c, t, g, unknown or other
  misc_feature (198)..(198): n is a, c, g, or t
  modified_base (219)..(219): a, c, t, g, unknown or other
  misc_feature (219)..(219): n is a, c, g, or t
  modified_base (260)..(260): a, c, t, g, unknown or other
  misc_feature (260)..(260): n is a, c, g, or t
tcagcgcagtacgacacgaccggtgctcgatttagctagtcactcaaggggaaaggggggggagaggagcccagcactagaagtcggcggtgtttccattcggtgatcagcactgaacacagaggactcaccatggagtttgggctgagcttgggttttcctcgttgcttcttttaaggaggttgccagtgtcaggtncagctggtgagtcgtgggggngtcgtggtcagtccgtgggagtcctgagtacctctcctgtncgacgcctgtcgtacttcctaccttgagttgtctatacgtactagtcggtacctacggtcggggtcccaccggtacgggccttacccggagggacgggtaaggggtccgtaggggtagggttccggggtatacggtaggttatacgtacaagtacgtaggtaagtacggtaaataagtacgttaaatacgttaaggacgtaaccggtaacttaccggtacccgggtaagggtaaccggtacccgttaacgttaacccctaacgttaccgttaacgaaacgaacccgtaacctaaaccggtacctaaaacgtaaccgtacgttacgtttaacgttacgttaacgaaacgttaacgtaaccgtaacggtccgtacggttaggaacgtaccgaacggtacgggaacgtaccggtacggtagttcggttaatttgttaccggagtaactaccgttaagtaaccgacgggtagaacccggtacggtaccccgg

SEQ ID NO: 49265 - DNA, 879 bp, Homo sapiens
  misc_feature: GYAE6OF01CNIJ4.52.77.G11.1.454.CMB.1.raw
  modified_base (87)..(87): a, c, t, g, unknown or other
  misc_feature (87)..(87): n is a, c, g, or t
  modified_base (561)..(561): a, c, t, g, unknown or other
  misc_feature (561)..(561): n is a, c, g, or t
tcagcgcagtacgacacgaccggtgctcgatttagctagtcactcaagggaaaggggggggagaggagcccagcactagaagtcggnggtgtttccattcggtgatcagcactgaacacagaggactcaccatggacgtttgggctgacgtcgttgggttttcccttcggttagtctttacgtttttaaaggaggttcgtcccgtagttcgtcgtaggtgaccgtagtcggtggtggtacgtcggtggggggtgcgtggtaccaggtccgtgggacgtcccgtagtacgtaccttccgtaccgtgtccgacgtaccgtccttacggtcggtacttccgtacgtttacgtaggttcgttacttaagtacgtactacgtcgtaccgtaccgggttccgggtaacccgtccgtacggtccgtaccggaagggtacggacggggtcggtacggggttaagggtcggggtaccggtaacgtaacgttaacgtaacgtttaactaacgttggtacggtaacggtaagggttaaataaggaactttacgtaaacgtaatcgggtaacncgtttaaccggtacggtaacgggaccggtaaccgttacgtaccgtaacttcgtaaccgaacgaccaaccgaacctaaccggaacgtaaccggtagtacgtttaagttaccttaacggaacttaaacggtacgtaaccgtaaccgtcggtaacggtacgtacggtaccgtaagggaaacgggttccccggacggtttaaccggtttaacgggttagtttaacgttaccgggttaggtaacccggttaaaggtttaaaccgttaacccgtacggggtaaaccggttaacccggggaaaccccggttaaaccccccggggg

SEQ ID NO: 49266 - DNA, 1011 bp, Homo sapiens
  misc_feature: GYAE6OF01E1L99.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatgggagtttgggctggagtcttcgggttttcctcggttcgcgttacgttttaaaggcggttagtccaggtcgtacgagggtcgcaggtcgtagggtggacggttcggtaggggggaggtcggttacggtcccgtaggccggttaggggacggttccccgtaggaacgtccttccgtccgtaggtcgtccgacgttcccgttcgtacggttacctttacctacccgtttacgtacggttcggttaccttacgttcgaaacccgtagttaccggtaccggtacccggttcggggtaaccccgtcggtacggtccctaccgggacggtccgggaaacggggttccgttaggggtaacgttcgggggttacgtcgttaaaggtttacctaacggtttaccgtaacggttagttacggaaggtttaaacgggtaaaccttaaagggttaactttaaacgtaccgtttaaagccgggtaaacgttacccggtaaccgggttaccgggtacgggtaaaccgggtcctacgtttaaacccgtacgtttaactttaaccggacgtaaacgtaaacccgtacccggtaaacccgtaaacggtaaacccgttaccgggttaccttttaacgggttttacggttaacccaaacgggtttaaacgtaacccggtaaaccggttacccgggttaaacggtttgggaaacccggtacgggttaaccggtaaccggggaaccgggttaacccggtaaaccgggggttcgtttacgggttaacccgttttaaacggttccggttaaacgggttacccggttaaaccgggtttaaaccgttaaccgggtaaacccgggtaacggggtaaaccccggttcggggttaaaccccccgggg

SEQ ID NO: 49267 - DNA, 885 bp, Homo sapiens
  misc_feature: GYAE6OF01AKFTH.52.77.G11.1.454.CMB.1.raw
  modified_base (103)..(103): a, c, t, g, unknown or other
  misc_feature (103)..(103): n is a, c, g, or t
  modified_base (531)..(531): a, c, t, g, unknown or other
  misc_feature (531)..(531): n is a, c, g, or t
  modified_base (814)..(814): a, c, t, g, unknown or other
  misc_feature (814)..(814): n is a, c, g, or t
tcagcgcagtacgacacgaccggtgctcgatttagctagtcactcaagggaaagggggggagaggagcccagcactagaagtcggcggtgtttccattcggtnatcagcactgaacacagaggactcaacctagtggtagtttgggctgtagtcgttgggtttttccttcgtttgctttacgttttaaaggaggtcgtaccagtgtcgaggtgcagtcgtgggtggtagttcggtagggggaggtcgtcggtccgaggccggtggtacggtccctggacgccgttcctccgtgtcgaccgtacgtcccgttgtacggttactttacccgaccccgttttgaccggtttaggtacctttaaagtcggtaaaccgttccgtaccggtcccgtaaccgggtttacccggggtccccaacccggtacgggttaccccgtacccgggaacggggtacgggtaaccgggggttggttacgggggacgggttttacggggggtacgtacccggtttaaaagttttaacgtactttaanaaacggttttagacggttaaaagggtagtaaaaagttaacgttaacttaagttaacgtcggtacctaaacgtaccggtaccggttacccgggtaagggttaaccgggttaccttaacgtttaaccccgtaacccgttacgtttaacccggaacgtacggtaaaccctaacccggttaaaccgaaaccgtacgtacccgttagttacgtttacgttaacgtaaacgttaacgtacgaaaccggttccgaagttcgaagtcgtaccgtagaaccggtcgtaacgngttacgttagttacgtagttccgtaagttaaccgtacgttacgacgggtcgaaccggttacggtaccccgg

SEQ ID NO: 49268 - DNA, 788 bp, Homo sapiens
  misc_feature: GYAE6OF01AZL9N.52.77.G11.1.454.CMB.1.raw
  modified_base (179)..(179): a, c, t, g, unknown or other
  misc_feature (179)..(179): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggtagtttgggctgagcttgggttttcctcgttgcttcgttttaagnggtgtccagtgtcaggtgcagcgtggtggagtcgtgggggagtcggtcggtccgagccgtgggacgtccctgacgacctctccgtgtcgccacgtcctcgtggtacttcctaccttcgagttgtcctatgactatcgaccgtaccgtcgggtcccgaccgacggtcctaccggaggtacggaagggggtcgttcggggaggttacgggggtcgtaacgttaaggtttactaacgttaccgtaaagttacggtaaggtaaggttaaggggtaaaaacgtttaaggtaattaaacgttaaacgttaagtaccgtacggtaaccggtacccgtaccgggtagggaaccgggtacccgtaattacccgtaaccgtacgtttaccgaaggtaaccgtaaccctaacgtacccaaaggtaaccctacgttacgttacgtttaacgttacgaacgtaaagtaccgtaaccgtacgtaccgtagacggtacgtacgtaacggacggtaccgtacgggtacgttggttaccgttacgtttacgtaggtaacccgttaaacggtaaactttaacgtaacccgggaaacgggtaaccggtaaccccggtaacccccgggg

SEQ ID NO: 49269 - DNA, 795 bp, Homo sapiens
  misc_feature: GYAE6OF01ETWP6.52.77.G11.1.454.CMB.1.raw
  modified_base (189)..(189): a, c, t, g, unknown or other
  misc_feature (189)..(189): n is a, c, g, or t
  modified_base (196)..(196): a, c, t, g, unknown or other
  misc_feature (196)..(196): n is a, c, g, or t
  modified_base (200)..(200): a, c, t, g, unknown or other
  misc_feature (200)..(200): n is a, c, g, or t
tcagcgcagtacgacacgaccggtgctcgatttagctagtcactcaagggaaaggggggggagaggagcccagcactagaagtcggcggtgtttccattcggtgatcagcactgaacacagaggactcaccatggagtttgggctgagcttgggttttcctcgttgtctttttaagaggttgtccagtntcaggtncagntgggtggagtcgtgggggagcggttggtaccaggccgtggggacgttcccgtgacgaccttcgtcctggtcgaccacgtcccttgtaggtactttccaacccgtttcaaggttcgttactagtagaacgtattcgccgtaccggtcgggggtccccgccgaagggtccctacgggaacgggtaccggaagggggtcttagggggtagggttcgggggtacggacgttaacggttttaataacttcgtaaatttacggtaggttaaacggttagggtaaaaagttaaagtaatttaacgttaaccgtagtacggaaccgtaacgggtaacccgtttacccggtaagggtaaccgggtacccgtaacgtttaccctaaccgttaaccgtttaaccgaagtaaaccgaaaccctaacctaaccgaaacgtaaccgtaccgttacgttagttaacgttacgaactaaagtacgtaaccgacgtaccgtagacgtacgacgtacggacggacgtacggtacgttacgttagttattcggtaggtacgtaacgttaacgttaacgacggtaacgggacgtaacccgtaaccggtaccccgg

SEQ ID NO: 49270 - DNA, 788 bp, Homo sapiens
  misc_feature: GYAE6OF01BHQBH.52.77.G11.1.454.CMB.1.raw
  modified_base (373)..(373): a, c, t, g, unknown or other
  misc_feature (373)..(373): n is a, c, g, or t
  modified_base (717)..(717): a, c, t, g, unknown or other
  misc_feature (717)..(717): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgaggcttgggttttccctcgttgcttcttttaagaggttcgtccagtgtcaggtgctagtctgggtggagttcggtagggggaggccgttggtcccagtcccgtgggggacgttccccgtaggacgaccgttcctcctggtcgaccgtacggtcccttgtcggtactttccaacccttcggtaagttcgtaccttagtgaacctagttcgcctacggtccgggtccccncgacggtcctcccggaggacgtaagggggccgttagggtacgggtggggttacggacgttaagtttagacttcgtaattacgaggtaggtaagggtaaactaagtactaagttactagtacgactaacggtaccgtccgggtaggaaccggtacgtttaaccgtacctaacccgttaacgtttacccgaagtaaacccggtaacctaaccgtaacccgaaacgtaacctaccgtagttacgttataccgtaataacgtacggaaacctcggtacttacggaaacggttcgacgtaggaacgtaccggtacgggttaacgttcggttagttaacggtttacggtnttaacccgggaaactttaaaccggttaacgtaacccggtaacgggtaaaccgtaacccggttaaccccggg

SEQ ID NO: 49271 - DNA, 808 bp, Homo sapiens
  misc_feature: GYAE6OF01BPIZD.52.77.G11.1.454.CMB.1.raw
  modified_base (191)..(191): a, c, t, g, unknown or other
  misc_feature (191)..(191): n is a, c, g, or t
  modified_base (221)..(221): a, c, t, g, unknown or other
  misc_feature (221)..(221): n is a, c, g, or t
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
  modified_base (346)..(346): a, c, t, g, unknown or other
  misc_feature (346)..(346): n is a, c, g, or t
tcagcgcagtacgacacgaccggtgctcgatttagctagtcactcaagggaaagggggggagaggagcccagcactagaagtcggcggtgtttccagttcggtgatcagcactgaacacagagactcaccagtggtagtttgggctggagtcgttgggttttcctcgttagccttcgttttaaggagggtntccgagtgtcgacggtgcaggcgttggggnggacggttcggtggggggacggtccggtcgggtaccaggtccggtacgggggtacggttcccctgacgtaccgtccttccgtggtcgccacggtcctggtgtattccctacgttnacgtntctangaactagcgtacgcgtcgggaccccgacgtcgccgtacgacgggacggtaggggtctagggtagggtcggtcggacgttaagttacgtattaacgtagttaggtaggaagtttaacggggtaaattaacggtaaatttaccggtaaacttaggtagaacccgttaaggttacccgtcgggttaacggaccggtacgtaacgtttaccaacccgtttaccgttaacgaagtaaactacccgaaaccgtaaccaaaccggtaaccgtaccgttacgtttaacgttacgtttacgtaaacgtaaacgtacgggaactaaccgtaccgagggtaccacgttaccgggagacccgggtacgtacgttcgggtcgtttaacggttacggttacgtcgttaaccggtaaccgttaaagttaccgtaaaccggggtaccggttaaaacgggcccggttaaacccccgggg

SEQ ID NO: 49272 - DNA, 765 bp, Homo sapiens
  misc_feature: GYAE6OF01AFSD4.52.77.G11.1.454.CMB.1.raw
  modified_base (205)..(205): a, c, t, g, unknown or other
  misc_feature (205)..(205): n is a, c, g, or t
  modified_base (224)..(224): a, c, t, g, unknown or other
  misc_feature (224)..(224): n is a, c, g, or t
  modified_base (340)..(340): a, c, t, g, unknown or other
  misc_feature (340)..(340): n is a, c, g, or t
  modified_base (355)..(355): a, c, t, g, unknown or other
  misc_feature (355)..(355): n is a, c, g, or t
  modified_base (369)..(369): a, c, t, g, unknown or other
  misc_feature (369)..(369): n is a, c, g, or t
tcagcgcagtacgacacgaccggtgctcgatttagctagtcactcaaagggaaagggggggagaggagcccagcactagaagtcggcggtgtttccattcggtgatcagcactgaacacagaggactcaccatgggagtttggggctgacgcgttgggtttttccctcgtttgcttacttttaagaggtgtccagtgtacaggtncagcgtgggtggagtcggnggggggagcgtcggtccaggccgtggggacgtccctggagcctctcctggtcgcacgtcctgtaggacttcctaccttgagttctactatgactagtcgaccgcgtcggggtcccnccgtagccgtaccgnggacggacggggtnttagggaggtgggtcggtaactaggtttaatactcgaaattagaggtagtaagggtaaactaagtaacgtattaacttagtcacgtacgtacccgtacggtacgggtaaaccgggtcgtaacttacccgtaacccgttaaccgtttaccgaaacggtaaccggtaacccttaaacccgtaaaccggaaacccgttaacccgaccgttaccgtttaagttacgtttaacggaactaaaccggtaacgtaaccgtaaccggtacccgtaaggaaccggtacggtaccggtagggaacggtaccggaccggttagttacggttaccgtttattacggttacggtaacgtaccgtaaacgttacgtaaccggaacgggtacccgtaaacggtaccccggg

SEQ ID NO: 49273 - DNA, 374 bp, Homo sapiens
  misc_feature: GYAE6OF02GF3L0.52.77.G11.1.454.CMB.1.raw
  modified_base (370)..(374): a, c, t, g, unknown or other
  misc_feature (370)..(374): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtccgctcggtgcggacgtctggggccaagggaccacggtcagcgtctcctcagcctccaccaagggcccatcggtcttccccctggcaccctcctccaagagcacctctgggggcacagcggccctgggctgcctggtcaaggactacttcctatacgatcgctgagcgggctggcaaggcgcatagnnnnn

SEQ ID NO: 49274 - DNA, 376 bp, Homo sapiens
  misc_feature: GYAE6OF02IZ21Q.52.77.G11.1.454.CMB.1.raw
  modified_base (370)..(376): a, c, t, g, unknown or other
  misc_feature (370)..(376): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtccgctcggtgcggacgtctggggccaagggaccacggtcagcgtctcctcagcctccaccaagggcccatcggtcttccccctggcaccctcctccaagagcacctctgggggcacagcggccctgggctgcctggtcaaggactacttcctatacgatcgctgagcgggctggcaaggcgcatagnnnnnnn

SEQ ID NO: 49275 - DNA, 373 bp, Homo sapiens
  misc_feature: GYAE6OF02F31SY.52.77.G11.1.454.CMB.1.raw
  modified_base (369)..(373): a, c, t, g, unknown or other
  misc_feature (369)..(373): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtccgctcggtgcggacgtctggggccaagggaccacggtcagcgtctcctcagcctccaccaagggcccatcggtcttccccctggcaccctcctccaagagcacctctgggggcacagcggccctgggctgcctggtcaaggctacttcctatacgatcgctgagcgggctggcaaggcgcatagnnnnn

SEQ ID NO: 49276 - DNA, 373 bp, Homo sapiens
  misc_feature: GYAE6OF02H8PUZ.52.77.G11.1.454.CMB.1.raw
  modified_base (370)..(373): a, c, t, g, unknown or other
  misc_feature (370)..(373): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtccgctcggtgcggacgtctggggccaagggaccacggtcagcgtctcctcagcctccaccaagggcccatcggtcttcccccctggcaccctcctccaagagcacctctgggggcacagcggccctgggctgcctggtcaaggctacttcctatacgatcgctgagcgggctggcaaggcgcatagnnnn

SEQ ID NO: 49277 - DNA, 516 bp, Homo sapiens
  misc_feature: GYAE6OF02GSCM8.52.77.G11.1.454.CMB.1.raw
  modified_base (344)..(344): a, c, t, g, unknown or other
  misc_feature (344)..(344): n is a, c, g, or t
  modified_base (495)..(495): a, c, t, g, unknown or other
  misc_feature (495)..(495): n is a, c, g, or t
tcagcgcagtacgacacgaccggtgctcgatttagctagtcactcaagggaaaggggggagaggagcccagcactagaagtcggcggtgtttccattcggtgatcagcactgaacacagaggactcaccatgggagtttgggctgagctgggttttcctcgttgctcttttaagaggtgtccagtgtcaggtgcagctggtggagtcgtgggggaggcgtggtccagccgtggggaggtccctgagactctcctgtgcagcctctggattcaccttcagtgtctatgacatgcactgggtccgccaggcctccgaggcaaggggctgggagtgggtgcagttanatcatatgatggaataagatatactatgcagactcgtgaggcgatcactattcagagacaactaccaagaacacgctagtatttgacaaatagaacagacctagagagactagagacgacggcgtgtgtattacgtgtgacgtaacttaanacgacggacggacgtaaccgg

SEQ ID NO: 49278 - DNA, 529 bp, Homo sapiens
  misc_feature: GYAE6OF02GNIXR.52.77.G11.1.454.CMB.1.raw
  modified_base (272)..(272): a, c, t, g, unknown or other
  misc_feature (272)..(272): n is a, c, g, or t
  modified_base (300)..(300): a, c, t, g, unknown or other
  misc_feature (300)..(300): n is a, c, g, or t
tcagcgcagtacgacacgaccggtgctcgatttagctagtcactcaagggaaagggggagaggagcccagcactagaagtcggcggtgtttccattcggtgatcagcactgaacacagaggactcaccatggagtttgggctgagcggtggtttcgcgtaggctctttaagaggtgtccagtgtcaggtgcagctggtggagtcgtgggggaggcgtggtccagcctgggaggtccctgagactctcctgtgcagcctctggattcaccttnagttgtctatgacatgcacgtgggtccnccaggctccaggcaaggggtctgggagtggggtggacaggttatatcatatgatggaaataagatatactatgcagactcgtagaaggccgatcacctatttccagagacaactaccaagaacacgactgtatttgactaatagaacacgacctgagagcgtagagacgacggcgtgtagtagttacgttgtgtacgtacgttaagttacgacggacggacgtaaccgg

SEQ ID NO: 49279 - DNA, 511 bp, Homo sapiens
  misc_feature: GYAE6OF02GZ1FD.52.77.G11.1.454.CMB.1.raw
  modified_base (298)..(298): a, c, t, g, unknown or other
  misc_feature (298)..(298): n is a, c, g, or t
tcagcgcagtacgacacgaccggtgctcgatttagctagtcactcaagggaaagggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtgtctatgacatgcactgggtccnccaggctccaggcaaggggctggagtgggtgcagttatatcatatgatggaagtagatatactatgcagactcgtgaaggcgatcacattcagagacaactcaagaacacgctgtatttgacaaatgaacagcctagagagctagaggacgacggctggtagttattacgtgtagacgtaacttaataccgaacgggtacggacgtaaccggg

SEQ ID NO: 49280 - DNA, 375 bp, Homo sapiens
  misc_feature: GYAE6OF02GSEYR.52.77.G11.1.454.CMB.1.raw
  modified_base (370)..(375): a, c, t, g, unknown or other
  misc_feature (370)..(375): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtccgctcggtgcggacgtctggggccaagggaccacggtcagcgtctcctcagcctccaccaagggcccatcggtcttccccctggcaccctcctccaagagcacctctgggggcacagcggccctgggctgcctggtcaaggactacttcctatacgatcgctgagcgggctggcaaggcgcatagnnnnnn

SEQ ID NO: 49281 - DNA, 599 bp, Homo sapiens
  misc_feature: GYAE6OF02HZQVM.52.77.G11.1.454.CMB.1.raw
  modified_base (181)..(181): a, c, t, g, unknown or other
  misc_feature (181)..(181): n is a, c, g, or t
  modified_base (183)..(183): a, c, t, g, unknown or other
  misc_feature (183)..(183): n is a, c, g, or t
  modified_base (186)..(187): a, c, t, g, unknown or other
  misc_feature (186)..(187): n is a, c, g, or t
  modified_base (190)..(192): a, c, t, g, unknown or other
  misc_feature (190)..(192): n is a, c, g, or t
  modified_base (198)..(198): a, c, t, g, unknown or other
  misc_feature (198)..(198): n is a, c, g, or t
  modified_base (201)..(201): a, c, t, g, unknown or other
  misc_feature (201)..(201): n is a, c, g, or t
  modified_base (205)..(205): a, c, t, g, unknown or other
  misc_feature (205)..(205): n is a, c, g, or t
  modified_base (207)..(207): a, c, t, g, unknown or other
  misc_feature (207)..(207): n is a, c, g, or t
  modified_base (212)..(212): a, c, t, g, unknown or other
  misc_feature (212)..(212): n is a, c, g, or t
  modified_base (224)..(224): a, c, t, g, unknown or other
  misc_feature (224)..(224): n is a, c, g, or t
  modified_base (236)..(236): a, c, t, g, unknown or other
  misc_feature (236)..(236): n is a, c, g, or t
  modified_base (239)..(239): a, c, t, g, unknown or other
  misc_feature (239)..(239): n is a, c, g, or t
  modified_base (246)..(246): a, c, t, g, unknown or other
  misc_feature (246)..(246): n is a, c, g, or t
  modified_base (260)..(260): a, c, t, g, unknown or other
  misc_feature (260)..(260): n is a, c, g, or t
tcagcgcagtacgacacgaccggtgctcgatttagctagtcactcaagggaaaggggggagaggagcccagcactagaagtcggcggtgtttccattcggtgatcagcactgaacacagaggactcaccatggagtttgggctgagcgggtcgttcggtcgtaggcgtacttaagtaggtncngtnngtnnngtgtgntgngggngngtgcngcgtggcgtccngagtctctctgngcnctcctgnggtattcctccttnaggttctatagtagatatcgcgtcgtcggtccgcgcgtcgtcgacggacggacggtcggtaggtggtggtggtacgtagtagtacgtagtagtagtagtagtagtaagtaagtaataatagtagtagtacgtacgtacgtacgtacggacggtacgtactacctactacgtacgtacgacgaactaacctaacgaacgaacgtacgtacgtacgtagtacgtaacgtaacgtacgtacgacgtacgtacgacgacgacgacgacgtacgacggtcgtgtacgttacgtacgtagtacgtaacgttaacgtacgtacggtacggtacggtacggtaccgg

SEQ ID NO: 49282 - DNA, 375 bp, Homo sapiens
  misc_feature: GYAE6OF02IIRWR.52.77.G11.1.454.CMB.1.raw
  modified_base (368)..(375): a, c, t, g, unknown or other
  misc_feature (368)..(375): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtccgctcggtgcggacgtctggggccaagggaccacggtcagcgtctcctcagcctccaccaagggcccatccggtctccccctggcaccctcctccaagagcacctctgggggcacagcggccctgggctgcctggtcaaggactactcctatacgatcgctgagcggctggcaaggcgcatagnnnnnnnn

SEQ ID NO: 49283 - DNA, 381 bp, Homo sapiens
  misc_feature: GYAE6OF02JB532.52.77.G11.1.454.CMB.1.raw
  modified_base (371)..(381): a, c, t, g, unknown or other
  misc_feature (371)..(381): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtccgctcggtgcggacgtctggggccaagggaccacggtcagcgtctcctcagcctccaccaagggcccatcggtcttccccctggccaccctcctccaagagcacctctgggggcacagcggccatgggctgcctggtccaaggactacttccatacgatcgctgagcgggctggcaaggcgcatagnnnnnnnnnnn

SEQ ID NO: 49284 - DNA, 531 bp, Homo sapiens
  misc_feature: GYAE6OF02HI0PL.52.77.G11.1.454.CMB.1.raw
tcagcgcagtacgacacgaccggtgctcgatttagctagtcactcaagggaaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctggggaggtccctgagactctcctgtgcagcctctggattcaccttcagtgtctatgacatgcacgtgggtccgccaggctccaggcaaggggctgggagtgggtggcagttatatcatatgatggaagtaagatatactatgcagactcgtgagggcgatcacatttccagagacaactccaagaacacgctgtatttgacaaatcgaacagacctagaagacgcgtgaggacacggacgtggtagttagttacgttgtagtaccgtaacgttaactaccgaacggtacggaccgtaaccggg

SEQ ID NO: 49285 - DNA, 376 bp, Homo sapiens
  misc_feature: GYAE6OF02GR40H.52.77.G11.1.454.CMB.1.raw
  modified_base (370)..(376): a, c, t, g, unknown or other
  misc_feature (370)..(376): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtcgctcggtgcggacgtctggggccaagggaccacggtcagcgtctcctcagcctccaccaagggcccatcggtcttccccctggcaccctcctccaagagcacctctgggggcacagcggcccttggctgccctggtcaaggactacttcctatacgatcgctgagcgggctggcaaggcgcatagnnnnnnn

SEQ ID NO: 49286 - DNA, 527 bp, Homo sapiens
  misc_feature: GYAE6OF02JGU8F.52.77.G11.1.454.CMB.1.raw
  modified_base (298)..(298): a, c, t, g, unknown or other
  misc_feature (298)..(298): n is a, c, g, or t
  modified_base (340)..(340): a, c, t, g, unknown or other
  misc_feature (340)..(340): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggtttcctcgttgctcttttaagaggtgtccagtgtcaggtgcagctggtggagtctgggggagcgtggtccagcctgggagtccctgagactctcctgtgcagcctctggattcaccttcagtgtctatgacatgcacgtgggtccnccaggcctccgaggcgaaggggctgggagtgggtgcagttanatcatatgatggaagtaagatatactatgcagactcgagaacgggcatcactattccagacacaactcaaagacacgctagtattgacaaagtacgaacacgtcctagaagagtcgagacggacacgggctggtagttaattacgtgtagacgtaacgttataccgaacgggtagaccgtaaccggg

SEQ ID NO: 49287 - DNA, 378 bp, Homo sapiens
  misc_feature: GYAE6OF02GGUUZ.52.77.G11.1.454.CMB.1.raw
  modified_base (371)..(378): a, c, t, g, unknown or other
  misc_feature (371)..(378): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtccgctcggtgcggacgtctggggccaagggaccacggtcagcgtctcctcagcctccaccaagggcccatcggtcttccccctggccaccctcctccaagagcacctctgggggcacagcggccctgggctgcctggtcaaggactacttcctatacgatcgctgagcgggctggcaaggcgcatagnnnnnnnn

SEQ ID NO: 49288 - DNA, 555 bp, Homo sapiens
  misc_feature: GYAE6OF02JWPQA.52.77.G11.1.454.CMB.1.raw
  modified_base (303)..(303): a, c, t, g, unknown or other
  misc_feature (303)..(303): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggaggtccctgagactctcctgtgcagcctctggattcaccttcagtgtctatgacatgcacgtgggtccnccgaggcctccgagggcgaaggggctgggaggtgggtggcagttatatcaatatgataggaagtaagataatactatagcagctaccgaggaacgggccattcacctattcagacacaactaccaagacacactagtacttagacaaatcgaacacgaccgtagacgagcgtagacgacgaggtcctaggttacgtaagtcgttaggtagtacgttaacgttaagtccggaacggtaggtaccgtaaccggg

SEQ ID NO: 49289 - DNA, 377 bp, Homo sapiens
  misc_feature: GYAE6OF02GRIYY.52.77.G11.1.454.CMB.1.raw
  modified_base (364)..(364): a, c, t, g, unknown or other
  misc_feature (364)..(364): n is a, c, g, or t
  modified_base (370)..(377): a, c, t, g, unknown or other
  misc_feature (370)..(377): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtccgctcggtgcggacgtctggggccaagggaccacggtcagcgtctcctcagcctccaccaagggcccatcggtcttccccctggcaccctcctccaagagcacctctgggggcacagcggccctgggctgcctggtcaaggactacttcctatacgatcgctgagcgggctggcaaggcncatagnnnnnnnn

SEQ ID NO: 49290 - DNA, 380 bp, Homo sapiens
  misc_feature: GYAE6OF02JVUFN.52.77.G11.1.454.CMB.1.raw
  modified_base (370)..(380): a, c, t, g, unknown or other
  misc_feature (370)..(380): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtcgctcggtgcggacgtctgggccaagggaccacggtcagcgtctcctcagcctccaccaagggcccatcggtcttccccctggccaccctcctccaagagcacctctgggggcacagcggccctgggcctgcctggtcaaggactacttcctatacgatcgctgagcgggctggcaaggcgcatagnnnnnnnnnnn

SEQ ID NO: 49291 - DNA, 381 bp, Homo sapiens
  misc_feature: GYAE6OF02FZBHB.52.77.G11.1.454.CMB.1.raw
  modified_base (370)..(378): a, c, t, g, unknown or other
  misc_feature (370)..(378): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtccgctcggtgcggacgtctggggccaagggaccacggtcagcgtctcctcagcctccaccaagggcccatcggtcttccccctggcaccctcctccaagagcacctctgggggcacagcggccctgggctgcctggtcaaggactacttcctatacgatcgctgagcgggctggcaaggcgcatagnnnnnnnnnggg

SEQ ID NO: 49292 - DNA, 521 bp, Homo sapiens
  misc_feature: GYAE6OF02I8331.52.77.G11.1.454.CMB.1.raw
  modified_base (301)..(301): a, c, t, g, unknown or other
  misc_feature (301)..(301): n is a, c, g, or t
  modified_base (391)..(391): a, c, t, g, unknown or other
  misc_feature (391)..(391): n is a, c, g, or t
tcagcgcagtacgacacgaccggtgctcgatttagctagtcactcaagggaaaggggggaggaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtgtctatgacatgcactggggtccnccaggctccaggcaaggggctggagtgggtggcagttatatcatatgatggaagtaagatatactatgcagactcgtgaggcattcaccnttccagagacaactccaagaacacgctagtactttgactaaatgaaacagtcctagagagctagacggacacggcgtggtagttattacgtgtgacgtaacttaagtccgaacggaggacctaaccgggg

SEQ ID NO: 49293 - DNA, 371 bp, Homo sapiens
  misc_feature: GYAE6OF02HSTZA.52.77.G11.1.454.CMB.1.raw
  modified_base (369)..(371): a, c, t, g, unknown or other
  misc_feature (369)..(371): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtccgctcggtgcggacgtctggggccaagggaccacggtcagcgtctcctcagcctccaccaagggcccatcggtcttccccctggccaccctcctccaagagcacctctgggggcacagcggccctgggctgcctggtcaaggctactcctatacgatcgctgagcgggctggcaaggcgcatagnnn

SEQ ID NO: 49294 - DNA, 561 bp, Homo sapiens
  misc_feature: GYAE6OF02JUPE4.52.77.G11.1.454.CMB.1.raw
  modified_base (298)..(298): a, c, t, g, unknown or other
  misc_feature (298)..(298): n is a, c, g, or t
  modified_base (338)..(338): a, c, t, g, unknown or other
  misc_feature (338)..(338): n is a, c, g, or t
  modified_base (377)..(377): a, c, t, g, unknown or other
  misc_feature (377)..(377): n is a, c, g, or t
tcagcgcagtacgacacgaccggtgctcgatttagctagtcactcaagggaaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgcagcctctggattcaccttcagtgtctatgacatgcacgtgggtccnccaggctccgaggcaaggggctgggagtgggtgcagttangtcatatgatggaacgtaagatatactatgcagactcgngaaggcatcactattcagacgacaactccaagaacacgctagtatttagactaaattgaaacacgtcctaggagtacgacgtaggaacggtacgacgggtaccgtggttacgttaacgtttaccgtggttacgaaccgttaaacgtttaacgtaccgaacgggtacggaccgttaaacccgggg

SEQ ID NO: 49295 - DNA, 688 bp, Homo sapiens
  misc_feature: GYAE6OF02HRG9M.52.77.G11.1.454.CMB.1.raw
  modified_base (301)..(301): a, c, t, g, unknown or other
  misc_feature (301)..(301): n is a, c, g, or t
  modified_base (345)..(345): a, c, t, g, unknown or other
  misc_feature (345)..(345): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcgtggttttcctcgttgctctttaagaggtgtccagtgtcaggtgcagctggtggagtcgtggggaggcgtggtccagcctgggagtccctgagactctcctgtgcagcctctggattccaccttcagtgtctatgacatgcacgtcgggtccnccgaggcctccgaggccgaaggggctggagtgggtgctagttanatcatagtagagtaggaaagtaagataatactaagtgacgtagtaccgtaccggtacggaacgggaccgtacgttacccaacccgttaacgttttacccgaaggtaacgtaaaccgtaaacccgttaaccgaaaacgaaaccgtaaccgtaccgttacgtttaacgtttaacggtaacctaaaacgttacgtaaaccgtaacggaccgttaacggtaacgaacggtacgtacggaaccgggacgtaaccggtacgttcggttagttacgtttaacgttacggttacggtaccgttaaaccgttaaccgttaccggaacgggtaacggtaaccggtaacccggg

SEQ ID NO: 49296 - DNA, 551 bp, Homo sapiens
  misc_feature: GYAE6OF02HDYDR.52.77.G11.1.454.CMB.1.raw
  modified_base (302)..(302): a, c, t, g, unknown or other
  misc_feature (302)..(302): n is a, c, g, or t
  modified_base (427)..(427): a, c, t, g, unknown or other
  misc_feature (427)..(427): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctggggaggtccctgagactctcctgtgcagcctctggattcaccttcagtgtctatgacatgcacgtgggtccncaggctccgaggcaagggggctgggagtggggtgctagttatatcatatgatggaagtaagatatactatgacagactccgtagaacggcgatcactattccagacacaactaccaagaacacgntagtatttgactaaatgaaaccagaccttagaagacgacgtagaggaccacggtaccgtggttacgtaacttacgtggtacgtacgtaacttaagtacgaacgggtacggaacctaacccgggg

SEQ ID NO: 49297 - DNA, 652 bp, Homo sapiens
  misc_feature: GYAE6OF02JUF35.52.77.G11.1.454.CMB.1.raw
  modified_base (299)..(299): a, c, t, g, unknown or other
  misc_feature (299)..(299): n is a, c, g, or t
  modified_base (342)..(342): a, c, t, g, unknown or other
  misc_feature (342)..(342): n is a, c, g, or t
  modified_base (367)..(367): a, c, t, g, unknown or other
  misc_feature (367)..(367): n is a, c, g, or t
tcagcgcagtacgacacgaccggtgctcgatttagctagtcactcaagggaaaggggggagaggagcccagcactagaagtcggcggtgtttccattcggtgatcagcactggaacacagaggactcaccatggagtttgggctgagctgggtttcctcgttgctcttttaagaggtgtccagtgtcaggtgcagctggtggagtctgggggaggcgtggtccagcctgggagtccctgagactctcctgtgcagcctctggattcaccttcagtgtctatgacatgcacgtgggtccnccaggcctccgaggccaaggggctgggagtgggtgcaggttanatcgatgtgagttagggaagtaagnttaatacttagtcgacgagtaccgtacgtaggaacgggtaccgtacttaccgtacctaacgtttcccgaacgtaacgaacctaacccgttaacccgaaacggtaaccgaaccgtcctaggttaacgtttacgtaaccgtaaacgtacgaaacctaacggaccgttacggtaacggtacgtacgttacggaacggaccgtacggtacgttacggttacgttacgttaccgtaggtacgtacggtaacgttaacgtaccggtaacggtacggaaccggtaacccggg

SEQ ID NO: 49298 - DNA, 526 bp, Homo sapiens
  misc_feature: GYAE6OF02IMISB.52.77.G11.1.454.CMB.1.raw
  modified_base (276)..(276): a, c, t, g, unknown or other
  misc_feature (276)..(276): n is a, c, g, or t
  modified_base (289)..(289): a, c, t, g, unknown or other
  misc_feature (289)..(289): n is a, c, g, or t
  modified_base (423)..(423): a, c, t, g, unknown or other
  misc_feature (423)..(423): n is a, c, g, or t
  modified_base (429)..(429): a, c, t, g, unknown or other
  misc_feature (429)..(429): n is a, c, g, or t
  modified_base (433)..(433): a, c, t, g, unknown or other
  misc_feature (433)..(433): n is a, c, g, or t
  modified_base (437)..(437): a, c, t, g, unknown or other
  misc_feature (437)..(437): n is a, c, g, or t
  modified_base (440)..(440): a, c, t, g, unknown or other
  misc_feature (440)..(440): n is a, c, g, or t
  modified_base (444)..(444): a, c, t, g, unknown or other
  misc_feature (444)..(444): n is a, c, g, or t
  modified_base (446)..(446): a, c, t, g, unknown or other
  misc_feature (446)..(446): n is a, c, g, or t
  modified_base (450)..(450): a, c, t, g, unknown or other
  misc_feature (450)..(450): n is a, c, g, or t
  modified_base (453)..(454): a, c, t, g, unknown or other
  misc_feature (453)..(454): n is a, c, g, or t
  modified_base (464)..(464): a, c, t, g, unknown or other
  misc_feature (464)..(464): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcgtggtttcgcgttaggctctttaagaggtgtccagtgtcaggtgcagctggtggagtcgtggggggaggcgtggtccagcctgggacggtccctgagactctcctgtgcagcctctggattcaccttnagtgtctatgacntgcacgtggggtcccgccgaggcctccgagggcgaaggggtctggggaggtgggtggctaggttatatcaatagtgagtaggaaagttaagatatactatgcaagctcgtagaacggcgtatcactattcaganacaacncaanacanctntatnanaatnaanncagagagcgngagacacggtctgttagtactactgtacgacgtaacttaacgtcgacggacgacgtaaccgg

SEQ ID NO: 49299 - DNA, 538 bp, Homo sapiens
  misc_feature: GYAE6OF02IVOCG.52.77.G11.1.454.CMB.1.raw
  modified_base (350)..(350): a, c, t, g, unknown or other
  misc_feature (350)..(350): n is a, c, g, or t
  modified_base (360)..(360): a, c, t, g, unknown or other
  misc_feature (360)..(360): n is a, c, g, or t
tcagcgcagtacgacacgaccggtgctcgatttagctagtcactcaagggaaaggggggagaggagcccagcactagaagtcggcggtgtttccattcggtgatcagcactgaacacagaggactcaccatggagtttgggctgagctgggttttcctcgttgctctttaagaggtgtccagtgtcaggtgcagctggtggagtcgtgggggagacgtggtccaggcctgggaggtccctggagactctcctgtgcagcctctggattcaccttcagtgtctatgacatgcacgtggggtcccgccaggcctccgaggcgaagggggctgggaggtgggtggcaggttanatcgattagngatggaaagtaagattagtactatgacagtactcggtagaacgggcctattcacctattccagagacaactacaagacacgctgtattgacaatcgaacacgcctagagagacgagaggacacggctggtatattacgtagtcggactaacgttatacggacggtaggactaaccggg

SEQ ID NO: 49300 - DNA, 520 bp, Homo sapiens
  misc_feature: GYAE6OF02F1ZBX.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtgtctatgacatgcactgggtccgccaggcctccaggcaaggggctggagtgggtggcagttatatcatatgatggaagtagatatactatgcagactccgtgaaggcgattcacctatttccagagacaactaccaagaacacgctgtatttgacaaatgaaacagcctagagagctagaggacgacggctggtagtacgttactgttgacgtaacttaactcgaacggaggacgtaaccggg

SEQ ID NO: 49301 - DNA, 375 bp, Homo sapiens
  misc_feature: GYAE6OF02GIMEF.52.77.G11.1.454.CMB.1.raw
  modified_base (267)..(267): a, c, t, g, unknown or other
  misc_feature (267)..(267): n is a, c, g, or t
  modified_base (372)..(375): a, c, t, g, unknown or other
  misc_feature (372)..(375): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtccgctcggtgcggacgtctggggccaagggaccacggtcagcgtctcctcagcctccaccaagggcccatcggtccttcccccnggcaccctcctccaagagcacctctgggggcacagcggccctgggctgcctggtccaaggactacttcctatacgatcgctgagcgggctggcaaggcgcatagnnnn

SEQ ID NO: 49302 - DNA, 537 bp, Homo sapiens
  misc_feature: GYAE6OF02I9RSF.52.77.G11.1.454.CMB.1.raw
  modified_base (302)..(302): a, c, t, g, unknown or other
  misc_feature (302)..(302): n is a, c, g, or t
  modified_base (498)..(498): a, c, t, g, unknown or other
  misc_feature (498)..(498): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtgtctatgacatgcactggggtcccnccaggcctccgaggccgaagggggctgggaggtgggtggctagttatatcatatgatggaaagtagatatactatgcagactccgtgaacgggcctagttcacctattccagagacaactcaagaacacgctagtatttagacaaatgaaacagacctaggagacgcgtaggagacacggtctggtagtattacgngtacgacgttaattagtacgacggacgacgtaacccggg

SEQ ID NO: 49303 - DNA, 372 bp, Homo sapiens
  misc_feature: GYAE6OF02FY6GB.52.77.G11.1.454.CMB.1.raw
  modified_base (369)..(372): a, c, t, g, unknown or other
  misc_feature (369)..(372): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtccgctcggtgcggacgtctggggccaagggaccacggtcagcgtctcctcagcctccaccaagggcccatcggtcttccccctggcaccctcctccaagagcacctctgggggcacagcggccctgggctgcctggtcaaggctacttcctatacgatcgctgagcgggctggcaaggcgcatagnnnn

SEQ ID NO: 49304 - DNA, 575 bp, Homo sapiens
  misc_feature: GYAE6OF02IEZHX.52.77.G11.1.454.CMB.1.raw
  modified_base (261)..(261): a, c, t, g, unknown or other
  misc_feature (261)..(261): n is a, c, g, or t
  modified_base (308)..(308): a, c, t, g, unknown or other
  misc_feature (308)..(308): n is a, c, g, or t
  modified_base (348)..(348): a, c, t, g, unknown or other
  misc_feature (348)..(348): n is a, c, g, or t
  modified_base (359)..(359): a, c, t, g, unknown or other
  misc_feature (359)..(359): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtgggtccagccgtggggaggtccctggagactctcctgtgcngcctctggattccaccttcagtgtctatgacatgcacgttgggcccnccgaggcctccaggccgaagggggctggggaggttggggngctaggtttanatcaatatgaatggaaagtaagatactaatagtgacagtacgtcgtaggaacgggccgtatcactatttccagacgacaactacaagaacacgactagtattacgacaaatgaaacagtacctagacgagcgtagaacggaccgacggtcgtagttacgtaattacgtagtacgtacgtaacttaacgttacgaacgggtacgaacgtaacccggg

SEQ ID NO: 49305 - DNA, 564 bp, Homo sapiens
  misc_feature: GYAE6OF02GM13H.52.77.G11.1.454.CMB.1.raw
  modified_base (307)..(307): a, c, t, g, unknown or other
  misc_feature (307)..(307): n is a, c, g, or t
  modified_base (341)..(341): a, c, t, g, unknown or other
  misc_feature (341)..(341): n is a, c, g, or t
  modified_base (348)..(348): a, c, t, g, unknown or other
  misc_feature (348)..(348): n is a, c, g, or t
  modified_base (418)..(418): a, c, t, g, unknown or other
  misc_feature (418)..(418): n is a, c, g, or t
tcagcgcagtacgacacgaccggtgctcgatttagctagtcactcaagggaaaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggaggcgtggtccagcctgggaggtccctgagactctcctgtgcagcctctggattcaccttcagtgtctatgactatgcacgtcggggtccnccagggcctccgaggcaaggggctgggagtgggngcagttnatcatatgatggaagtaagatatactatgcagtactccgtaggacgggccgattccactactttcagaanaccaactccaaacgaacacgtctagttattagactaaatgaacagcctagagagcgtagaggaccacggtcgttggttagttaagttcgtaggttggaacgttaactttaaacgtacggtaaccgggacggaacgtaaccccgggg

SEQ ID NO: 49306 - DNA, 378 bp, Homo sapiens
  misc_feature: GYAE6OF02GMVHL.52.77.G11.1.454.CMB.1.raw
  modified_base (373)..(378): a, c, t, g, unknown or other
  misc_feature (373)..(378): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtccgctcggtgcggacgtctggggccaagggaccacggtcagcgtctcctcagcctccaccaagggcccatcggtcttccccctggcacccctcctcccaagacgcacctctgggggcacagcggccctgggctgcctggtcaaggactacttcctatacgatcgctgagcgggctggcaaggcgcatagnnnnnn

SEQ ID NO: 49307 - DNA, 546 bp, Homo sapiens
  misc_feature: GYAE6OF02JGFHI.52.77.G11.1.454.CMB.1.raw
  modified_base (260)..(260): a, c, t, g, unknown or other
  misc_feature (260)..(260): n is a, c, g, or t
  modified_base (304)..(304): a, c, t, g, unknown or other
  misc_feature (304)..(304): n is a, c, g, or t
  modified_base (348)..(348): a, c, t, g, unknown or other
  misc_feature (348)..(348): n is a, c, g, or t
  modified_base (489)..(489): a, c, t, g, unknown or other
  misc_feature (489)..(489): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggacgtccctgagactctcctgtgcagcctntggacttcaccttcagtgtctatgacatgctacgtggggtcccnccaggcctccgaggccgaaggggctgggagtgggtggcagttanatcatatgagtaggaagtaagatatacatgacagactcgtaggaacgggaccgtactactactactttctaagagaacaacctacaaacgaacacgtctagtattagacaatagaacacgctagagagcgtagacggacgnggcgtgtagttagttactgtagacgtaacttaagtacgacggtacggacgtaaccgg

SEQ ID NO: 49308 - DNA, 663 bp, Homo sapiens
  misc_feature: GYAE6OF02JVIJ1.52.77.G11.1.454.CMB.1.raw
  modified_base (309)..(309): a, c, t, g, unknown or other
  misc_feature (309)..(309): n is a, c, g, or t
tcagcgcagtacgacacgaccggtgctcgatttagctagtcactcaagggaaaggggggaggaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgagtctgggggaggcgtggtccaggcctgggaggtccctgagactcgtcctgtgcagcctcgtggtacttcaccttcagttcgtctatgacatgctacgtgggtcccncgaggcctccagggccaacggggtctgggacgtggggtcggccaggttatacgtcaattagtcgagttacgggaagtaagattataacgtagtgacgaacgtaccgtccgtaggtaacgggaccgtaacgttaccaaccgtactttacctacggaacgtaacctaacctaccgtaaacgaaccgtacggtactacgtaagttttacgaactaaacgtacgaaacgtagtaaccgtacgaaggtaacgacgtacggaacggtacaaccgggtcgttaggttaaccgttagttaccgtaggttacgtaccgttaacgtaaccgttaacgtacgggtacggtaaccgtaacccgggg

SEQ ID NO: 49309 - DNA, 869 bp, Homo sapiens
  misc_feature: GYAE6OF02HMFWP.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggacgtccctgagactctcctgtgcagcctctggattcaccttcagtgtctatgacatcgcacgtcgggtccgccaggcctccgagggccgaaaggggggtctaggggacggttgggggtcgggactaacgggtttatacgtacgtaagttagttaggtaagttaaggggtaaaagttaaggtaatttaacgtaacctttaagttacggaaccgtaacgggtaacccggtttacccgggttaacggggaaaccgggggtaccccggttaaacgtttaccccgtaaaccccgttaacgtttttaccccgaaacgggtaaaccggtaaaccccgttaaaacccgttaaccccgaaaaaccggtaaaaccccgtaaaccggttaccgtttacggttttaaacgtttttacggtaaaccttaaaaacggttaaccggtaaaaccgtaaccgggtaacccgttaacgggaaacggtaacggaccgtttaacgggaaaccggggtaaccgtaaccggggttaccgtttagggtttaacggttaacgtttttaaccggtacgggttacggtaacccgggttaaactttaaaccggttaccggtaaaccgggggtaaccgggtaaacccggtaaacccccggggg

SEQ ID NO: 49310 - DNA, 170 bp, Homo sapiens
  misc_feature: GYAE6OF02JFTJN.52.77.G11.1.454.CMB.1.raw
  modified_base (167)..(170): a, c, t, g, unknown or other
  misc_feature (167)..(170): n is a, c, g, or t
tcagcgcagtacgacacgaccggtgctcgatttagctagtcactcaagggaaaggggggagaggagcccagcactagaagtcggcggtgtttccattcggtgatcagcactgaacacagaggactcaccatggagtttgggctgagcgggctggcaaggcgcatagnnnn

SEQ ID NO: 49311 - DNA, 517 bp, Homo sapiens
  misc_feature: GYAE6OF02FTJLG.52.77.G11.1.454.CMB.1.raw
  modified_base (348)..(348): a, c, t, g, unknown or other
  misc_feature (348)..(348): n is a, c, g, or t
  modified_base (407)..(407): a, c, t, g, unknown or other
  misc_feature (407)..(407): n is a, c, g, or t
  modified_base (497)..(497): a, c, t, g, unknown or other
  misc_feature (497)..(497): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctggggggaggcgtggtccagcctggggaggtcccctgagactctcctgtgcagcctctggattcaccttcagtgtctatgacatgcacgtggggtcccgccaggcctccaggcaagggggctgggagtggggtgcagttanatcatatgatggaataagatatactatgcagactcgtgaggcgattcactattccaganacaactaccaagaacacgctgtattgacaaatgaacagcctagagagctagaggacacggcgtgtagttattacgtgtgacgtaacttanacgacggaggacgtaaccgg

SEQ ID NO: 49312 - DNA, 607 bp, Homo sapiens
  misc_feature: GYAE6OF02JKKKI.52.77.G11.1.454.CMB.1.raw
  modified_base (248)..(248): a, c, t, g, unknown or other
  misc_feature (248)..(248): n is a, c, g, or t
  modified_base (377)..(377): a, c, t, g, unknown or other
  misc_feature (377)..(377): n is a, c, g, or t
  modified_base (481)..(481): a, c, t, g, unknown or other
  misc_feature (481)..(481): n is a, c, g, or t
tcagcgcagtacgacacgaccggtgctcgatttagctagtcactcaaggggtaaaggggggggagagggagcccagcactagaagtcggccggtgtttccattcggtgatcacgcactgaacacagaggactcaccatggagttgggctgagctgggtttcctcgttgctctttaagaggtgtccagtgtcaggtgcagctggtggagtcgtggggggagcgtgggtccagccgtggggaggtccccnggagactctcctgtgcagcctctggattcaccttcagtgtctagtgactatggcacgttcgggtcccgccgaggcctaccgagggccaagggggcctagggaggtcggggtgcgtagttatatcattanggtatcggaagtaagataatactatgcaaggtctccggtaggaacggcgtattccacctattccaggacaacactacaagacacgcttatagtttagactaaanagaacacgtcgtacgagagacgtaggaccggtacgaacggtgtacggtaggttaacttaccggttggtaacggtaccgttaaacgtttactacgggaaacgggtaccggtaaccggtaaccccggg

SEQ ID NO: 49313 - DNA, 593 bp, Homo sapiens
  misc_feature: GYAE6OF02G2V6R.52.77.G11.1.454.CMB.1.raw
  modified_base (358)..(358): a, c, t, g, unknown or other
  misc_feature (358)..(358): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggtccaggcctggggagtccctgagactctcctgtgcagcctctggattcaccttcagtgtctatgacatgccacgtcggggtcccgccagggcctaccgaggccgaagggggctggggagtggggtggctaggttanagtcatatgataggaataagataatactatgacagactcgtagaacgggccgatccactagttccagacacaacctacaagaacaccgctagttattagactaaagtcgaaacacgaccgttagaagacgtacgtaggaacggacgacggtacgttggtacgtttacttacggtagttacggaaccgttaaacgtttaacgacccggaagggtaacggaacccggtaacccgggg

SEQ ID NO: 49314 - DNA, 543 bp, Homo sapiens
  misc_feature: GYAE6OF02GUQB7.52.77.G11.1.454.CMB.1.raw
  modified_base (337)..(337): a, c, t, g, unknown or other
  misc_feature (337)..(337): n is a, c, g, or t
  modified_base (346)..(346): a, c, t, g, unknown or other
  misc_feature (346)..(346): n is a, c, g, or t
  modified_base (353)..(353): a, c, t, g, unknown or other
  misc_feature (353)..(353): n is a, c, g, or t
  modified_base (431)..(431): a, c, t, g, unknown or other
  misc_feature (431)..(431): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctggggagtccctgagactctcctgtgcagcctctggacttcaccttcagtgtctatgacatgctacgtcgggtccgccaggcctccgaggcgaagggctgggagtgggngctagttanatcatangataggaataagatatactatgcagtactccggaggacggccgtatccgctattcgagacgacaactaccaagacacnctagtattgacaatgaacacgcctagagagacgtagacggacacggtcgtcggttagttacttacgtgtacgtacgtaacgttagtaccggacggtaggaccgtaacccggg

SEQ ID NO: 49315 - DNA, 610 bp, Homo sapiens
  misc_feature: GYAE6OF02IA76I.52.77.G11.1.454.CMB.1.raw
  modified_base (261)..(261): a, c, t, g, unknown or other
  misc_feature (261)..(261): n is a, c, g, or t
  modified_base (489)..(489): a, c, t, g, unknown or other
  misc_feature (489)..(489): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgccagcctntggattcaccttcagtgtctatgactatcgcactgggtccgccgaggcctccgaggcgaacggggtctgggaggttgggtggctaaggttatactcgtaatatggtatagggaaagtaagtataagtaactagtgactagaccgtcgtaggacggccgtatcaactacttacagacgaacaactaccaaagaacacgtactagttaatttcgaactaaagtcgaaacncgtacctagtacgaacgtcgtaggacggaccgtacggtacgttggttaacgttacttacgttaggtacgtaacgtaacgtttaaacgtccggtaacgggtacggaacccgttaacccgggg

SEQ ID NO: 49316 - DNA, 532 bp, Homo sapiens
  misc_feature: GYAE6OF02H28PJ.52.77.G11.1.454.CMB.1.raw
  modified_base (300)..(300): a, c, t, g, unknown or other
  misc_feature (300)..(300): n is a, c, g, or t
  modified_base (342)..(342): a, c, t, g, unknown or other
  misc_feature (342)..(342): n is a, c, g, or t
  modified_base (350)..(350): a, c, t, g, unknown or other
  misc_feature (350)..(350): n is a, c, g, or t
  modified_base (449)..(449): a, c, t, g, unknown or other
  misc_feature (449)..(449): n is a, c, g, or t
  modified_base (477)..(477): a, c, t, g, unknown or other
  misc_feature (477)..(477): n is a, c, g, or t
  modified_base (494)..(494): a, c, t, g, unknown or other
  misc_feature (494)..(494): n is a, c, g, or t
tcagcgcagtacgacacgaccggtgctcgatttagctagtcactcaagggaaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggtgtggtccagcctgggaggtccctgagactctcctgtgcagcctctggattcaccttcagtgtctatgacatgcacgtgggtccncctaggctccaggcaacggggctgggagtggggtgcagttanatcaatangagtaggaataagataatactatgacagacgtccgtagagggcctattcactacttccagtacgacaactcaagaacacgctgtacttgacaatcgaancgacctagagagcgtagagacgacggtntagtgttagtacgttgngtacgtaacttaactacggacggacggacgtaaccggg

SEQ ID NO: 49317 - DNA, 563 bp, Homo sapiens
  misc_feature: GYAE6OF02IRZU1.52.77.G11.1.454.CMB.1.raw
  modified_base (306)..(306): a, c, t, g, unknown or other
  misc_feature (306)..(306): n is a, c, g, or t
  modified_base (338)..(338): a, c, t, g, unknown or other
  misc_feature (338)..(338): n is a, c, g, or t
  modified_base (347)..(347): a, c, t, g, unknown or other
  misc_feature (347)..(347): n is a, c, g, or t
  modified_base (372)..(372): a, c, t, g, unknown or other
  misc_feature (372)..(372): n is a, c, g, or t
  modified_base (456)..(456): a, c, t, g, unknown or other
  misc_feature (456)..(456): n is a, c, g, or t
  modified_base (468)..(468): a, c, t, g, unknown or other
  misc_feature (468)..(468): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatgggagtttgggctgagctgggttttcctcgttgctcttttaagaggtgtccagtgtcaggtgcagctggtggagtcgtgggggagcgtggtccagccgtgggacgtccctgagactctcctgtgcagcctctggattcaccttcagtgtctatgactatgacacgtcgggtccnccaggctccgaggcaaggggctgggagtgggngctagttanatacgatagtgagtaggaaagtaanatatatagtgacagtactcgtagaaggccgatcacctattaccgagacgaacaaactacaaacgaacaacgctatacttagaanaaagtagaaacncgtactagagacgcgtagacgacgacggtcgtggtacttagttacgtagtacgtacgtaacgtttaagaccggaacggtacggaaccgtaaccgg

SEQ ID NO: 49318 - DNA, 661 bp, Homo sapiens
  misc_feature: GYAE6OF02IBQ7X.52.77.G11.1.454.CMB.1.raw
  modified_base (159)..(159): a, c, t, g, unknown or other
  misc_feature (159)..(159): n is a, c, g, or t
  modified_base (260)..(260): a, c, t, g, unknown or other
  misc_feature (260)..(260): n is a, c, g, or t
  modified_base (285)..(285): a, c, t, g, unknown or other
  misc_feature (285)..(285): n is a, c, g, or t
  modified_base (289)..(289): a, c, t, g, unknown or other
  misc_feature (289)..(289): n is a, c, g, or t
  modified_base (339)..(339): a, c, t, g, unknown or other
  misc_feature (339)..(339): n is a, c, g, or t
  modified_base (348)..(348): a, c, t, g, unknown or other
  misc_feature (348)..(348): n is a, c, g, or t
  modified_base (367)..(367): a, c, t, g, unknown or other
  misc_feature (367)..(367): n is a, c, g, or t
  modified_base (375)..(375): a, c, t, g, unknown or other
  misc_feature (375)..(375): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttccncgttgctcttttaagaggtgtccagtgtcaggtgcagctggtggagtcgtgggggagcgtggtccagcctgggagtccctggagctctcctgtgcagcctntggattccaccttcgagtgtcttangacntgcacgttgggtcccgccgaggctccgaggcgaaggggctgggagtgggngctagttanatcatatgatggaataagntatactangactacgtactccggaggtaacggccgtattaccaaccgttactttaccgaggtacgaaacaaccttaaccgaaacgtaaccgtaccgtacttaggttatttacgaaccgtaaagtcgaaactacggtacccgttaggaagtacggtacgttacgggaacgggaacccgtaccgggttaacgtttcgggttaacgttaacgttttaacccgtggtttaccggtaaccgtttaaacgttaacgttaacccggggaacgggtacgggtaaaccccgttaacccggggg

SEQ ID NO: 49319 - DNA, 378 bp, Homo sapiens
  misc_feature: GYAE6OF02HAQFQ.52.77.G11.1.454.CMB.1.raw
  modified_base (371)..(378): a, c, t, g, unknown or other
  misc_feature (371)..(378): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtccgctcggtgcggacgtctggggccaagggaccacggtcagcgtctcctcagcctccaccaagggccccatccggtcttccccctggccaccctcctccaagagcacctctgggggcacagcggccctgggctgcctggtcaaggctacttcctatacgatcgctgagcggctggcaaggcgcatagnnnnnnnn

SEQ ID NO: 49320 - DNA, 585 bp, Homo sapiens
  misc_feature: GYAE6OF02G5J5O.52.77.G11.1.454.CMB.1.raw
  modified_base (272)..(272): a, c, t, g, unknown or other
  misc_feature (272)..(272): n is a, c, g, or t
  modified_base (285)..(285): a, c, t, g, unknown or other
  misc_feature (285)..(285): n is a, c, g, or t
  modified_base (299)..(299): a, c, t, g, unknown or other
  misc_feature (299)..(299): n is a, c, g, or t
tcagcgcagtacgacacgaccggtgctcgatttagctagtcactcaagggaaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctggggaggcgtggtccagcctgggaggtccctgagactctcctgtgcagcctctggattcaccttnagtgtctatgacntgcacgtgggtccnccagggcctccgaggcgaaggggctgggacgtggggtgcagttatatcatatgatggaagtaagatatactagtcgacagacgtccgtaggaacgggccgtaattccgaccgtatttacccgaaggacgtaacaacctaccaaagaacctaccgtctagttattcgaactaaactagaaactacgaccgtagaacgaggacgtagggacgacgacggtcgtaggtagttacttagttgtacgtacgtaacgttactaccggacgggtacggtaaccgtaacccggg

SEQ ID NO: 49321 - DNA, 644 bp, Homo sapiens
  misc_feature: GYAE6OF02HA8F7.52.77.G11.1.454.CMB.1.raw
  modified_base (264)..(264): a, c, t, g, unknown or other
  misc_feature (264)..(264): n is a, c, g, or t
  modified_base (306)..(306): a, c, t, g, unknown or other
  misc_feature (306)..(306): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcggtggtccagccgtggggagtccctgagactctcctgtgcagcctntggattcaccttcagttgtctatgacatgcacgtgggtcccnccgaggcctccgaggcaagggggctgggaggtggggtggactaggtttactatcaattagtgaagttaggtaaaagtaaggtaattataacttatggacaagtaccgtaccggtaggaacgggaccgtattaccgaccctacgtttacccgagtaacgaaccaaaccgtaccgaaacgaactaaccgacttagttactttagtacctaaagtacgtaaacgacgtacctagaacgacgtacgtacggaacggaccgacggtcgtaggttagttaagttaccgtagttacggtaccgtaaacgttaacgtacgtaacggacggtaaccggtaacccggg

SEQ ID NO: 49322 - DNA, 731 bp, Homo sapiens
  misc_feature: GYAE6OF02IZV3M.52.77.G11.1.454.CMB.1.raw
  modified_base (561)..(561): a, c, t, g, unknown or other
  misc_feature (561)..(561): n is a, c, g, or t
  modified_base (627)..(627): a, c, t, g, unknown or other
  misc_feature (627)..(627): n is a, c, g, or t
tcagcgcagtacgacacgaccggtgctcgatttagctagtcactcaagggaaagggccgagttcaccatttccagagacaactccaagaacacgctgtatttgcaaatgaacagcctgagagctgaggacacggctgtgtattactgtgcgaacttaatcacggagacaacggtcgaccccgtcgctcggtcgcggacgtcgtgggccaagggaccacggtcaggcgtcctccgtcgacgcctccaccgaacggggcccaagttccggtaccctttacccccccgtgggaccctacccccgttcccgtaccccgtaacggacgtacccgaaccccgttccgttaccgggggggacccaaccggtaacggccccgggtaccccggttaccggggcccgtttaccggccccgttacgggtacccgtaaacgggtacccgtaccgtttacccgttaacgttaaccggtaacgttcccggaccgttacggtaacggtccggggtcccgttacgggaccggtaaaccggggccggtaccgtaacggttacggacgtcgtacgaacncgtcgacgtcgacgatcggtacgcggattccggactggaccacggtacgctcggaacttccggtancggtacgcgtcgcgtacgcgacgcgacgtcgacgtcgtcgtacgacgtacgtacgtacgcgacgcgtacgtacgtcgtcgcgcgcgacgtcgtacgtcgcgtcg

SEQ ID NO: 49323 - DNA, 543 bp, Homo sapiens
  misc_feature: GYAE6OF02HPJO9.52.77.G11.1.454.CMB.1.raw
  modified_base (346)..(346): a, c, t, g, unknown or other
  misc_feature (346)..(346): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtgtctatgacatgcacgtgggtccgccgagggcctccgaggcgaaggggctgggagtgggtggcagttanatcatatgatggaagtaagatatactatgacagactccgtgaacgggccgatcactattaccaagagacaactaccaagaaacacgactagtatttagactaaatagaacagacctagagagcgtagagacgacggcgtggtacgttacttacgtaggtacgacgtaacttaatacgaacggacggacgtaaccggg

SEQ ID NO: 49324 - DNA, 526 bp, Homo sapiens
  misc_feature: GYAE6OF02FQVRE.52.77.G11.1.454.CMB.1.raw
  modified_base (300)..(300): a, c, t, g, unknown or other
  misc_feature (300)..(300): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtgtctatgacatgcactgggtccncaggctccaggcaaggggctggagtgggtggcaggttatatcatatgatggaagtagatatactatgcagactccgtgaaggccgattcaccatttccagacgacaactccaagaacacgctagtattgacaatgaacagacctagagagctagacggacacggcgtggtagttagttacgtgtacgacgtaacttaacgacgacgggtaggtaccgtaacccggg

SEQ ID NO: 49325 - DNA, 405 bp, Homo sapiens
  misc_feature: GYAE6OF02IU00W.52.77.G11.1.454.CMB.1.raw
  modified_base (384)..(405): a, c, t, g, unknown or other
  misc_feature (384)..(405): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgaccccccgtcgctcggtgcggacgtctggggccaagggaccacggtcagcgtctcctcagcctccaccaagggcccatcggtctccccctggccaccctcctccaagacgccacctcgtcgggggccacgagccggccctgggcctcggcctggtcaaggtacctacttccatacgatcgctgagtcgggctggacaacggcgcatagnnnnnnnnnnnnnnnnnnnnnn

SEQ ID NO: 49326 - DNA, 380 bp, Homo sapiens
  misc_feature: GYAE6OF02IIJ0A.52.77.G11.1.454.CMB.1.raw
  modified_base (373)..(380): a, c, t, g, unknown or other
  misc_feature (373)..(380): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtccgctcggtgcggacgtctggggccaagggaccacggtcagcgtctcctcagcctccaccaagggccccatcggtcttccccctggccaccctcctccaagagccacctctgggggcacagccggccctgggctgcctggtcaaggctacttcctatacgatcgctgagcgggctggcaaggcgcatagnnnnnnnn

SEQ ID NO: 49327 - DNA, 682 bp, Homo sapiens
  misc_feature: GYAE6OF02F4QC7.52.77.G11.1.454.CMB.1.raw
  modified_base (178)..(178): a, c, t, g, unknown or other
  misc_feature (178)..(178): n is a, c, g, or t
  modified_base (264)..(264): a, c, t, g, unknown or other
  misc_feature (264)..(264): n is a, c, g, or t
  modified_base (315)..(315): a, c, t, g, unknown or other
  misc_feature (315)..(315): n is a, c, g, or t
  modified_base (511)..(511): a, c, t, g, unknown or other
  misc_feature (511)..(511): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatgggagtttgggctgagcgtggtttcgtcgtagctctttaagaggtntccagtgtcaggtgcagctggtggagtcgtgggggaggcgtggtccagcctggggacgtccctgacgctctcctgtgcagccttgnggtacttccaccttcgagttgtctagtgacagtgaccacgttcggggtccnccgacggcctccggaaggccgaagggggtcctaggggtaggttgggggtcgtacgtaaggtttaatacttacgaagtttagtaggtacgttaagggaaagttaagacttaataacgtagtgacaagtccgtacggtaggaacgggctactaccaccgtactttaccgaagacgaacctaactacgaaacgtaaccnccggtattacgttaagttacgaacgtaaacgtacgaaacgtacggtacctaggaagtaccgtacggtacgaacgggacgacggtacgttggtaacggttaacgttacgtacgttacggtaacgttaaaccgtttaagaccggtaacgggtacggaacccggtaacccgggg

SEQ ID NO: 49328 - DNA, 383 bp, Homo sapiens
  misc_feature: GYAE6OF02FR951.52.77.G11.1.454.CMB.1.raw
  modified_base (370)..(383): a, c, t, g, unknown or other
  misc_feature (370)..(383): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtccgctcggtgcggacgtctggggccaagggaccacggtcagcgtctcctcagcctccaccaagggcccatcggtcttccccctggcaccctcctccaagagcacctctgggggcacagcggccctgggctgcctggtcaaggactacttcctcgtactgcgctgagcgggctggcaaggcgcatagnnnnnnnnnnnnnn

SEQ ID NO: 49329 - DNA, 627 bp, Homo sapiens
  misc_feature: GYAE6OF02FFASP.52.77.G11.1.454.CMB.1.raw
  modified_base (159)..(159): a, c, t, g, unknown or other
  misc_feature (159)..(159): n is a, c, g, or t
  modified_base (247)..(247): a, c, t, g, unknown or other
  misc_feature (247)..(247): n is a, c, g, or t
  modified_base (299)..(299): a, c, t, g, unknown or other
  misc_feature (299)..(299): n is a, c, g, or t
  modified_base (473)..(473): a, c, t, g, unknown or other
  misc_feature (473)..(473): n is a, c, g, or t
  modified_base (491)..(491): a, c, t, g, unknown or other
  misc_feature (491)..(491): n is a, c, g, or t
  modified_base (537)..(537): a, c, t, g, unknown or other
  misc_feature (537)..(537): n is a, c, g, or t
  modified_base (612)..(612): a, c, t, g, unknown or other
  misc_feature (612)..(612): n is a, c, g, or t
tcagcgcagtacgacacgaccggtgctcgatttagctagtcactcaagggaaggccgattcaccatttccagagacaactccaagaacacgctgtatttgcaaatgaacagcctgagagctgagacacggctgtgtattactgttagacgaactttaancgacggacgaccgaacggtcgacccccgtcgcgtcggtcgaccggacgttcgcgggaccacggaccacggtcacggtcctccgttccncgacgtaccctaccgaaccgacgggccctacgttcccggttcccttacccgngacctacccctcacgagccgccgaccgttcggcgggacctacgcggcccggtcctacgggtctacggcgtacggtaccgtaacgtaccttaccgttacgtaacgacgtacggtccgtacgtacgggacggccggttacgcggaacgaacggcctagaggagctgaacgacgcancggttcacgcgacgacanacgacgacgacgacgacgacgacgacgacgtacgacgacgacgacncgacgacgacgacgtcgacgacgacgacgacgacgcgacgacgacgacacgtcgtacacgactacgacgacgacncgacgcgtacgagcg

SEQ ID NO: 49330 - DNA, 642 bp, Homo sapiens
  misc_feature: GYAE6OF02HTQ20.52.77.G11.1.454.CMB.1.raw
  modified_base (302)..(302): a, c, t, g, unknown or other
  misc_feature (302)..(302): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcctgggaggtccctgagactctcctgtgcagctctggattcaccttcagtgctatgacatgcacgtgggtcccnccgaggcctaccgaggcgaaaggggctagggagtggggtggctaggttatagtcatagtgaacttagggaaagtaaagattaagtacttaatgacaagtaccttaccggtaggaacgggtaccgtaagttccaaccgtatttacccgagaacgtaaccaaccgtaccgaaacgaaaccgtaccgtacgtagttaactttcgaactaaacgtacgaaactacgaccgttagacggaacgcgtagaaggacccgtagggccgttaggtaccgttaagttaccgtaggtacgtacggtaaaccttaagtacccgggtaacggacggtaaccgtaaacccgggg

SEQ ID NO: 49331 - DNA, 550 bp, Homo sapiens
  misc_feature: GYAE6OF02I18AH.52.77.G11.1.454.CMB.1.raw
  modified_base (285)..(285): a, c, t, g, unknown or other
  misc_feature (285)..(285): n is a, c, g, or t
  modified_base (301)..(301): a, c, t, g, unknown or other
  misc_feature (301)..(301): n is a, c, g, or t
  modified_base (344)..(344): a, c, t, g, unknown or other
  misc_feature (344)..(344): n is a, c, g, or t
  modified_base (351)..(351): a, c, t, g, unknown or other
  misc_feature (351)..(351): n is a, c, g, or t
  modified_base (362)..(362): a, c, t, g, unknown or other
  misc_feature (362)..(362): n is a, c, g, or t
  modified_base (371)..(371): a, c, t, g, unknown or other
  misc_feature (371)..(371): n is a, c, g, or t
  modified_base (463)..(463): a, c, t, g, unknown or other
  misc_feature (463)..(463): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgcagcctgtggattcaccttcagtgtctatgacntgcacgtcggggtccncgaggcctccgaggccaaggggctgggagtgggtgctagttanatcatangataggaatanatatactangcaagactccgaggaacggccgtatcactattccgagacacaactacaagaccacgtctagtattcgactaaatcgaacagtcctagaacgngtactaggagaccgacggtacgtggttatacgttacgtgtacgtacgtaactttaacgtaccgaacgggtacgaaccgtaacccggg

SEQ ID NO: 49332 - DNA, 681 bp, Homo sapiens
  misc_feature: GYAE6OF02GIQNG.52.77.G11.1.454.CMB.1.raw
  modified_base (309)..(309): a, c, t, g, unknown or other
  misc_feature (309)..(309): n is a, c, g, or t
  modified_base (409)..(409): a, c, t, g, unknown or other
  misc_feature (409)..(409): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctggagactctcctgtgcacgcctcgtggacttccaccttcagttgtctatgacatgcacgtcgggtccnccgaggcctccgaggcgaacgggggctagggaggttgggtcggactaggttaatatcgaattagtggaagtagggaaaagtaagtaattaactaacttanacgtaccgaagtaccgtccggtagggaaacgggtccgtaagttccgaacctacgtttccaagaacgtaacctaacctaaccgaaacgaaccacgtaccttagtttaacttacgaactaaaagtacggtaaaccacggtacccgtaggaaacgcgtacgtagggaacggaccgtacgggtcgttaggttacggtttaacttaccggtggttacggtaaccgttaaacgtttaaccgtaccggtaaacgggtaccggaaccggtaaacccgggg

SEQ ID NO: 49333 - DNA, 738 bp, Homo sapiens
  misc_feature: GYAE6OF02IW4XW.52.77.G11.1.454.CMB.1.raw
  modified_base (351)..(351): a, c, t, g, unknown or other
  misc_feature (351)..(351): n is a, c, g, or t
tcagcgcagtacgacacgaccggtgctcgatttagctagtcactcaagggaaagggggggagaggagcccagcactagaagtcggcggtgtttccattcggtgatcagcactgaacacagacggactcaccatggagtttgggcctgagtctggggtttttcctcggttgcttacgtttttaaaggaggtgtccgagtgtcaggtgcagctggtggagtcgtgggggagcgtggtccagccgtggggacggtccctaggacgaccttcgtcctgtcgcacgcctcgtaggtactttccgacctttcgagttcgtactagttgaccattcgcctaacggttcgggggtcccncaggggcctaccgagggacaagggggtctggggaggttgggtgactaggttatacgtacaagtagtgaagtttagggaaaagttaacgaatacttaacgtaggtggaccaagtaccgtccggtaaggaacgggtccgtaagttaccaaccgtatttacccgaaggtaaccgtaaaccgtaaaccgtaaccgaaacgtaaacccgtaaccggtcctttaacggttaactttacggaaacctaaaagtacggaaacctaacgtaccgaacgtaacgggacttaacggacggtaacggaccgtaaacggtcgttaggttacggttaactttaacggtgttacgtaacgttaacttaacgtacggaacgggaacggtaccggtaacccggg

SEQ ID NO: 49334 - DNA, 721 bp, Homo sapiens
  misc_feature: GYAE6OF02I7SV7.52.77.G11.1.454.CMB.1.raw
  modified_base (159)..(159): a, c, t, g, unknown or other
  misc_feature (159)..(159): n is a, c, g, or t
tcagcgcagtacgacacgaccggtgctcgatttagctagtcactcaaggggaagggggagaggagcccagcactagaagtcggcggtgttaccattcggtgatcagcactgaacacgagtaggactcgaccatggagtttgggctgagcgtggtttccncgttgctctttaagaggtgtccagtgtcaggtgcagctggtggagtcgtgggggagcgtggtccagcctgggacgtccctggagactctccgtgtcgacagcctgtggattccaccttgagttgtacctagtcgaacagtcgactaccggttcgggtcccgccgtacggcctaccgagggacccgaagggggtctaggggaggttggggtcggacttaaggtttatacgtcgtaattagtaggtaagttagggaaaagttaagtaagttaacgttaaccttaagtcgaccgtaaggtacccgttaccggtaacgggtaacgggacccgttaacgtttacccgacccttacgtttacccgaaggtaaccgaacctaacgttaacccgaaagaaccgtacgtaccttaggttaactttacggaactaaacgtacggaaactacgtaccgttaggaacgtacgacgtagggaacggtacgtacggtacgttaggttacgttacgttacgtacggttacgaacgttaacttacgtaccggaacgggtaacggtaccgtaacccggg

SEQ ID NO: 49335 - DNA, 556 bp, Homo sapiens
  misc_feature: GYAE6OF02HPQSX.52.77.G11.1.454.CMB.1.raw
  modified_base (302)..(302): a, c, t, g, unknown or other
  misc_feature (302)..(302): n is a, c, g, or t
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
  modified_base (370)..(370): a, c, t, g, unknown or other
  misc_feature (370)..(370): n is a, c, g, or t
tcagcgcagtacgacacgaccggtgctcgatttagctagtcactcaagggaaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggattcaccttcagtgtctatgacatgcacgtcggggtcccnccgaggcctccgaggccaagggggctgggagtggggtgctagttatancaatntgatgggaaagtaanataatactatgactagactccgagaacgggccgattcacctatttccagacgacaactaccaagaacacgctgttattgacaaatgaacagaccttagacgagcgtaggacggactacggacgtggttcgtaacttacgttaggtacgtacgtaacgttaacgtacgacggacggaccgtaacggg

SEQ ID NO: 49336 - DNA, 774 bp, Homo sapiens
  misc_feature: GYAE6OF02HY2DW.52.77.G11.1.454.CMB.1.raw
  modified_base (257)..(257): a, c, t, g, unknown or other
  misc_feature (257)..(257): n is a, c, g, or t
  modified_base (265)..(265): a, c, t, g, unknown or other
  misc_feature (265)..(265): n is a, c, g, or t
  modified_base (279)..(279): a, c, t, g, unknown or other
  misc_feature (279)..(279): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagcgtggtggagtcggtgggggacgcgtggtccagccgtgggacgtcctgagacctctctgtncacgcctntggattccaccttnagtgtctatgacatgctacgtcgggtcccgccgaggcctccgagggccgaagggggccttaggggacggttgggggtacggaccgtaaggttttagtaactccgtaatttaacgtggtaagtacgggtaaaagtaaaggtaattaacttaacgttagtacgactaacggtacccgtaccgggtacggaaaccgggggaccgtaacgttacccgtaacccgttaacgttttaacccgaacggtaacgaacctaaacccgtaaccgtaaaacgaaacctaaccggtaccttacggtttaacgtttacgtaacgtaaaagtaccgtaaaacgtaccggtacccgttaggaaacggtaacggtaccgtagggaaccgggtaaccgtaaccgggtccgttaacggttacggtttaacgttaaccgttcggttacggtaccgttaaaccgttaaaccgttacccggtaacgggtaaccgggtaacccggtaaaccccgggg

SEQ ID NO: 49337 - DNA, 576 bp, Homo sapiens
  misc_feature: GYAE6OF02GFAUI.52.77.G11.1.454.CMB.1.raw
  modified_base (300)..(300): a, c, t, g, unknown or other
  misc_feature (300)..(300): n is a, c, g, or t
  modified_base (340)..(340): a, c, t, g, unknown or other
  misc_feature (340)..(340): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttggctcttttaagaggtgtccagtgtcaggtgcagctggtggagtctgggggagcgtggtccagcctgggagtccctgagactctcctgtgcagcctctggattcaccttcagtgtctatgacatgcacgtgggtccncaggctccgaggcaaggggctggaggtgggtgctagttanatcatatgataggaagtaagactatactatgactagtacctccgtagacgggaccgtatcacctatttaccagtacgactaacctacaacgaacacgctagtatttgactaaagtacgaacacgtaccgtagagacgacgtaggacggacgacggtacgtaggttagttacgttacgtagttacgtacggttaaccgttaacgttaccggtaacgggtacggaaccgtaacccggg

SEQ ID NO: 49338 - DNA, 571 bp, Homo sapiens
  misc_feature: GYAE6OF02I2DN3.52.77.G11.1.454.CMB.1.raw
  modified_base (301)..(301): a, c, t, g, unknown or other
  misc_feature (301)..(301): n is a, c, g, or t
  modified_base (343)..(343): a, c, t, g, unknown or other
  misc_feature (343)..(343): n is a, c, g, or t
  modified_base (350)..(350): a, c, t, g, unknown or other
  misc_feature (350)..(350): n is a, c, g, or t
  modified_base (370)..(370): a, c, t, g, unknown or other
  misc_feature (370)..(370): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagctctcctgtgcagcctctggattcaccttcagtgtctatgacatgcacgtgggtccncgaggcctccgaggcaaggggctgggagtgggtgctagttanatcatangataggaatagatatactangacagaccgtcgtaggaacgggcgtattcaccttatttaccgagacgaactaactccgaaagaaccacgacttagttaactttgaactaaagtcgaactagccgtagaagagtcctagggacgacgacggtctaggttagttagttacgtggtacgtacgtaaccgtttagaccggaacgggtacggaaccgtaacccggg

SEQ ID NO: 49339 - DNA, 550 bp, Homo sapiens
  misc_feature: GYAE6OF02I436I.52.77.G11.1.454.CMB.1.raw
  modified_base (262)..(262): a, c, t, g, unknown or other
  misc_feature (262)..(262): n is a, c, g, or t
  modified_base (277)..(277): a, c, t, g, unknown or other
  misc_feature (277)..(277): n is a, c, g, or t
  modified_base (345)..(345): a, c, t, g, unknown or other
  misc_feature (345)..(345): n is a, c, g, or t
  modified_base (366)..(366): a, c, t, g, unknown or other
  misc_feature (366)..(366): n is a, c, g, or t
  modified_base (436)..(436): a, c, t, g, unknown or other
  misc_feature (436)..(436): n is a, c, g, or t
  modified_base (451)..(451): a, c, t, g, unknown or other
  misc_feature (451)..(451): n is a, c, g, or t
tcagcgcagtacgacacgaccggtgctcgatttagctagtcactcaagggaaaggggggagaggagcccagcactagaagtcggcggtgtttccattcggtgatcagcactgaacacagaggactcaccatggagtttgggctgagtcttgggttttcctcgttgcttcttttaagaggtgtccagtgtcaggtgcagctggtggagtcgtgggggagcgtggtccagcctgggacgtcctgacgactctctgtgcagcctntggactttcaccttnagtgtctatgacatgcacgtcggggtccacgtaggcctccgaaggcgaaggggtctgggagtcggggngactaggttactagtcattangagtaggaaagttaagatatactatgcaagtctcggtagacggcatcactattacagacacactacgaanacacgctagtattanacaagtacgaacagccgtagagacgatcgagacgacgtacgtggtactagttacgtgtacgacgtaacttaagacggaacggtacggacgtaacccggg

SEQ ID NO: 49340 - DNA, 672 bp, Homo sapiens
  misc_feature: GYAE6OF02HBHOE.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtggggagtccctggagactctcctgtgcacgcctctggattcaccttcagttgtctatgacatgctacgtgggtcccgccaggcctccgaggccgaaggggctagggaggtgggtggactaggttatagtcatagtggaagttaggaaagtaaagtataataacttagtgactaagtaccgtaccggtaggtaacggggcccgtagttacccgaaccttacgtttacccgaagtaaccgaaccctaaaccgttaacccgaaacggaaaccctaaccggtcgttaaggttaactttacgaacgtaaaagtacgaaacgtacgtacccgtagaacgtagtacgtagggacggaccgacggtacgtgttacggttaagttacgttacggtacggtaccgttaaaccgttagtaccggaacggtaacgggaacccgttaacccgggg

SEQ ID NO: 49341 - DNA, 608 bp, Homo sapiens
  misc_feature: GYAE6OF02H9O7W.52.77.G11.1.454.CMB.1.raw
  modified_base (158)..(158): a, c, t, g, unknown or other
  misc_feature (158)..(158): n is a, c, g, or t
  modified_base (192)..(192): a, c, t, g, unknown or other
  misc_feature (192)..(192): n is a, c, g, or t
  modified_base (261)..(261): a, c, t, g, unknown or other
  misc_feature (261)..(261): n is a, c, g, or t
  modified_base (320)..(320): a, c, t, g, unknown or other
  misc_feature (320)..(320): n is a, c, g, or t
  modified_base (385)..(385): a, c, t, g, unknown or other
  misc_feature (385)..(385): n is a, c, g, or t
  modified_base (480)..(480): a, c, t, g, unknown or other
  misc_feature (480)..(480): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcacatggagttgggctgagcttgggttttccncgttgcttcttttaagagtgtccagtgtcaggtnacagctggtgagtcgtggggggagcgtggtaccagccgtggggacgtccctaggagtacctctccgtgngccagcccttctggactttccaccttcgagtgtctaatggactatgcacgtcgggtccnccaggcctcgagcgaaggggtctgggagtggggcagtagttacatcatatgagtagaagtaacgntaactatagtgaccagctcggtaggaacggctaatcgactataccagacacaactacgaagacacgtctagttacttagaactaaagcgtaaacncgtacgtagaacgtacgtaacgaggtacggaacccgtgggtccttaggttacggttaacttaaccgtcggtacggtaaccgttaacgttaaacgtccggaaacggtaccgggtaaccgtaaccccggg

SEQ ID NO: 49342 - DNA, 678 bp, Homo sapiens
  misc_feature: GYAE6OF02JXE4E.52.77.G11.1.454.CMB.1.raw
  modified_base (193)..(193): a, c, t, g, unknown or other
  misc_feature (193)..(193): n is a, c, g, or t
  modified_base (280)..(280): a, c, t, g, unknown or other
  misc_feature (280)..(280): n is a, c, g, or t
  modified_base (309)..(309): a, c, t, g, unknown or other
  misc_feature (309)..(309): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtncagctggtggagtcgtgggggagcgtggtccaggccgtgggacggtccctgacgactctcctgtgcagcctcgtggacttcaccttnagtgtctatgacatgcacgtcgggtcccnccgaggcctccgaggaccgaacggggctgggacggtggggtgaccgtaggtttacagtcaattagtgtaacgtagggaaattaaggattaacgtactaagtcggactaacggtaccgtaccggtacggaacgggacctacgtacctactacgtttaccgaaggtaacgaacctaaaccgtaacccgaaacggaacctaccgtacgttacgttacgttacgaactaaacgtacgaacctacgaccgtacgaaggtacgtcgtacggacggaccgacggtaccgttaggttaacgttacgttaaccgtcggttacgtaaccggttaacgttaaacgtccggtaacgggtaccggtaaccggtaaccccggg

SEQ ID NO: 49343 - DNA, 652 bp, Homo sapiens
  misc_feature: GYAE6OF02IZS31.52.77.G11.1.454.CMB.1.raw
  modified_base (284)..(284): a, c, t, g, unknown or other
  misc_feature (284)..(284): n is a, c, g, or t
tcagcgcagtacgacacgaccggtgctcgatttagctagtcactcaaaggggaaagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggagtccctgacgactctcctggtgcacgcctcgtggacttccaccttnagtgtctatgacatcgcacgttgggcccgccaggcctccgaggccgaagggcgtgggagtggggtgtactaggttatactactatatcggaagtaggaaagtaagtaactaagtaactagtacgactaagaccgttacggtaggaaacgggtccctaagttacccgaacttaacgtttaccgaagtaacgaacctaaaccgttaccaaacggaaacccacggtacctttagttaacttacgaaacgaaagttacgaaactacggtacctagggaacgagtaccgtaagggaccgtacgacgggtatcggttagttacgtacgttgacgtacggtaacttacgacggaacggaacggacctaacccggg

SEQ ID NO: 49344 - DNA, 680 bp, Homo sapiens
  misc_feature: GYAE6OF02G9RIB.52.77.G11.1.454.CMB.1.raw
  modified_base (307)..(307): a, c, t, g, unknown or other
  misc_feature (307)..(307): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggaggcgtgggtccagcctgggaggtccctgagactctcctgtgcagcctctggattcaccttcagtgtctatgacatgctacgtcggggtccnccgaggcctccgagggcgaaggggctgggaggtggggtcggctaggttatatcattatgagtaggaagtaagattatactagtcgacgtacgtacgtccggtaggtaacgggtccgtaacttaccgaacctacgtttaccgaagtaacgaaacctaaccgtaacccaaaggaacctaacgtaccttaggttaacttttcgaactaaacgttacggaaactacgtaccttaaggaacggacgtcggtacgggaacgggaccgtaaccggtacgttacgggttacggttaacgtttacgttacgggttacgtaaccggttaaacgtttaacggttaccggtaaccggggtaacgggtaacccggtaaccccgggg

SEQ ID NO: 49345 - DNA, 629 bp, Homo sapiens
  misc_feature: GYAE6OF02FWIX9.52.77.G11.1.454.CMB.1.raw
  modified_base (307)..(307): a, c, t, g, unknown or other
  misc_feature (307)..(307): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggacgtccctgagactctcctgtgcagcctctggattccaccttcagtgtctatgacatgctacgtcgggtcccnccgaggcctccgaggccgaagggggctaggggaggttggggtgctagttactagtcaagtataggagttagggaaaataaggaattacttactagtcgacagtacccgtcggtagggaacgggcctaattccaacctacttccgaagaacaccgaacctaccgaaacgacacgtctagttactttacgaacctaaagtacgaacgagtacctaggaagacgtacgtacggacggacgaccggcgttagttacgttacgttacgttacggtacgtacggttaacctttaacgacggtaacgggaacggtaccgtaacccgggg

SEQ ID NO: 49346 - DNA, 595 bp, Homo sapiens
  misc_feature: GYAE6OF02IOVXD.52.77.G11.1.454.CMB.1.raw
  modified_base (279)..(279): a, c, t, g, unknown or other
  misc_feature (279)..(279): n is a, c, g, or t
  modified_base (351)..(351): a, c, t, g, unknown or other
  misc_feature (351)..(351): n is a, c, g, or t
tcagcgcagtacgacacgaccggtgctcgatttagctagtcactcaaggggaaaggggggggagaggagcccagcactagaagtcggcggtgtttccattcggtgatcagcactgaacacagaggactcaccatggagtttgggctgagctgggttttcctcgttgctcttttaagaggtgtcagtgtcaggtgcagctggtggagtcgtgggggagcgtggtccagccgtgggacgtcctgagactctcctgtgcagcctctggattcaccttcagtntctatgacatcgctacgtcgggtcccgcgaggcctcgagggcgaaggggctgggagtggggtgactagttanatcatatggataggaagtaagtataatactatacgactagacctcggtagggaacgggccgtaacttaccaacctacgtttaccgaagacgtaaccaactaccaacgaacctaccgacttagttattcgtaacctaatacgaacagtacgtagagagcgtaggacggacgacggtacgtggtacgttagttacgtagtacgacttaacgttaacgtacggacgggtacggaaccgtaacccggg

SEQ ID NO: 49347 - DNA, 582 bp, Homo sapiens
  misc_feature: GYAE6OF02IET2N.52.77.G11.1.454.CMB.1.raw
  modified_base (300)..(300): a, c, t, g, unknown or other
  misc_feature (300)..(300): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggtttcctcgttgctcttttaagaggtgtccagtgtcaggtgcagctggtggagtcgtgggggaggcgtggtccagcctgggaggtccctgagactctcctgtgcagcctctggattcaccttcagtgtctatgacatgcactgggtccnccgaggcctccgaggcgaagggggtctagggacggttggggtggcgtaggttatagtcatatgataggaagtaagataatactatgactagacctacgtagaacgggtccctataccactactttaccaagacgaaccaactaccaaacgaacacgtctagtacttcgaacaaatgaaacacgaccgtagagacgcgtagacgaccgacggcgttaggtagttacttacgtagtcgtaccgtaacgttaacgtaccggaacggtacggtaacgtaacccggg

SEQ ID NO: 49348 - DNA, 616 bp, Homo sapiens
  misc_feature: GYAE6OF02HL8I1.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctggggaggtccctgagactctcctgtgcagcctctggattcaccttcagtgtctatgacatgcacgtcgggtccgccgagggcctccgagggccgaaagggggctgggaggtggggtggctagttataatcatagtgagtggaaagtaagatatactatgacagactcggtaggaacgggccgtatcgacctacgtttaccaaggaacgaaccaaaccgtaccgaaacgaacctaccgtacttacgttagtttacgaactaaagtacgaaactacggtacctagaacgtagcgtaggaacggacgacggtcgttagtggttaacttacgtaggtacggtacgttaacgttaacgtaccggtaacgggaccggtaacgtaaccccggg

SEQ ID NO: 49349 - DNA, 852 bp, Homo sapiens
  misc_feature: GYAE6OF02HS7Q8.52.77.G11.1.454.CMB.1.raw
  modified_base (188)..(188): a, c, t, g, unknown or other
  misc_feature (188)..(188): n is a, c, g, or t
tcagcgcagtacgacacgaccggtgctcgatttagctagtcactcaagggaaaggggggaggaggagcccagcactagaagtcggcggtgtttcctattcggtgatcagcactgaacacagaggactcaccatggagtttggctgagctgggtttcctcgttgctctttaagaggtgtccagtgtcgnggtgcagtcgtggtggagtcgtgggggaggtcgtggtccagtccgtagggcggtcctggagtactctccgtggtagccgagtctcgtagggtattcccacttcgtaggtcgtacttatcggtacattcggccctacggtccgggttcccgacccgagggcccctccgaggggaccggtaaaacgggggtctacggggtgggggttacgggtcgggtaccgtaaggtttaagtttaaccgcggttaatttaacgaggttaaggttaggggtaaaacgtaaaggttattaaacgttaccgtagttacggaacgtaccgtaacgtccggtacgggtaacgggacccgttacgtaccctaaccgttacgtttaccgaagaaccgtaccttaaaccgaacccgtaaagtaacccggtaaccgtccgttatttaaacggtttccgtaaaaccgaaaaggtttaccgaaaccgtaccgaacccggttgtaaacccgggtagaacccggttagggtaaccgggtaacccgtacggtccggtttacgggttaaaggtttaaccgtttaaccggtttaaacccgggttgaaacccggtttttaaaccccggttaaaacggttaacccggggttaacccggggaacccgggtaaacccgggttaaacccccgggg

SEQ ID NO: 49350 - DNA, 542 bp, Homo sapiens
  misc_feature: GYAE6OF02FYOPD.52.77.G11.1.454.CMB.1.raw
  modified_base (346)..(346): a, c, t, g, unknown or other
  misc_feature (346)..(346): n is a, c, g, or t
  modified_base (411)..(411): a, c, t, g, unknown or other
  misc_feature (411)..(411): n is a, c, g, or t
  modified_base (470)..(470): a, c, t, g, unknown or other
  misc_feature (470)..(470): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatgggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtgtctatgacatgcactgggtccgcaggctccaggcaaggggctggagtgggtggcagttatatcatangatggaagtaacgatatactaatgacaagacgtcgtagaacgggccgattccactatttccaganacaactacaagaacacgctagtactttacgactaaacgtgaaaccagtcctagaggacncgtagacggacacggtcgtagtagtattacgtggtacgacgtaacttacgtcgacggtagaccgtaacccgg

SEQ ID NO: 49351 - DNA, 737 bp, Homo sapiens
  misc_feature: GYAE6OF02F6CW9.52.77.G11.1.454.CMB.1.raw
  modified_base (690)..(690): a, c, t, g, unknown or other
  misc_feature (690)..(690): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtgggaggtccctgagactctcctgtgcagccctgtgtacttcctaccttcgagttcgtacttagtcgactagtcgaccgtacggttccggggtccccgaccggaccggtccctacccggacgggaaccgggaaccgggggcgttacgggggtaggggttgggggtacggacgttaaggttaagtcgtacgtaagttaggtagaaggtaagggtaaaacgtaaggtaacttaagttaacttagtacgtacgaaacgttacccgttacgggtaaggggaaccgggtaccgttaactttacccgaaacctttaccgtttaaccggaaggtaaacccgtaaccctaaccgtaacccgaaaagaacccgtaccgtacgttagttacgtttacgaaacgtaagtacgaaacgtacgtaccgtagacgtacgtcgaggaacgaccgacgtcgtaggtattagttcgngtacgtacgttaacttacgacggacggtacggtaccgtaaccccggg

SEQ ID NO: 49352 - DNA, 743 bp, Homo sapiens
  misc_feature: GYAE6OF02HIM7Q.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcctctggattcaccttcagtgtctatgacatgcacgtgggtcccgcctagggcctccgagggccgaagggggtcctggggaggtggggtggctaaggtttactaatccgaatagtgaagttagggaaagttaagattagtaactagtgacctaaggtaccgtaccggtaggaaacggggtcccgtaagtttaccaacccgttaacgttttacccgaaacggtaacgaaacccgtaaaccgttaacccgaaaacggtaaacccgtaaccggtaccgtttaacgttaacgttttacgaaacctaaaaacggttacgaaaacctaacggtacccgtaaggtaaacggtacggtaccgtaggaaccgggtaaccgtaaccgggtaccgttagggttacgtttaagtttaaccgttacggttacggtaaccggttaaaaccgtttaacggtaaccggtaaccgggtaacgggtaacccgtaaacccggggg

SEQ ID NO: 49353 - DNA, 591 bp, Homo sapiens
  misc_feature: GYAE6OF02FQMKK.52.77.G11.1.454.CMB.1.raw
  modified_base (276)..(276): a, c, t, g, unknown or other
  misc_feature (276)..(276): n is a, c, g, or t
  modified_base (356)..(356): a, c, t, g, unknown or other
  misc_feature (356)..(356): n is a, c, g, or t
  modified_base (393)..(393): a, c, t, g, unknown or other
  misc_feature (393)..(393): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctggggaggtccctgagactctcctgtgcagcctctggattcacccttnagttgtctatgacatgcacgtgggtcccgccaggcctccgaggtcgaagggggctgggaggttggggtggctaggtttanatcaatagtgaattagggaaagtaagataataactangacagtactcgtaggacgggaccgtacgtacacctactttaccacgtacgacctaacctaccaaacgaaccaccgtacttacgttattagaactaatagaactagacctagagacgtcgacggtagacgacggcgtagtagttacttacgttcgttacgtaacgttaactacgacggacggtacgtaccggtacccgg

SEQ ID NO: 49354 - DNA, 623 bp, Homo sapiens
  misc_feature: GYAE6OF02ID6BE.52.77.G11.1.454.CMB.1.raw
  modified_base (366)..(366): a, c, t, g, unknown or other
  misc_feature (366)..(366): n is a, c, g, or t
tcagcgcagtacgacacgaccggtgctcgatttagctagtcactcaaggggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggacggtccctgagactctcctgtgcagcctctggattccacctttcagtgtctatgacatgcacgtcgggtcccgccgagggtcctccgagggccgaagggggctagggagtgggtggcagttatatcattagngatagggaaataagatatactatgacagtacctcgtaggaacgggccatcactattcagagacactacaagaaccacgctatacgtttagactaaagtacgaaacgtacggtaccgtagaacggtacgtacgtacgggaacggaccggtaccgggtccgttggtttaacgttaacgtttaacgttcggttaacggtaccggttaaacctttaaccggtaccggtaaacgggtaaccgggaaccgtaaaccccggggg

SEQ ID NO: 49355 - DNA, 662 bp, Homo sapiens
  misc_feature: GYAE6OF02IF81A.52.77.G11.1.454.CMB.1.raw
  modified_base (160)..(160): a, c, t, g, unknown or other
  misc_feature (160)..(160): n is a, c, g, or t
  modified_base (278)..(278): a, c, t, g, unknown or other
  misc_feature (278)..(278): n is a, c, g, or t
  modified_base (311)..(311): a, c, t, g, unknown or other
  misc_feature (311)..(311): n is a, c, g, or t
tcagcgcagtacgacacgaccggtgctcgatttagctagtcactcaaggggaaagggggggagaggagcccagcactagaagtcggcggtgtttccattcggttatcagcactgaacacagaggactcaccatggagtttgggctgagctgggttttccncgttgctcttttaagaggtgtccagtgtcaggtgcagctggtggagtcgtgggggagcgtggtccagccgtgggacgtccctgagactcctcctgtgcagcctgtggacttcaccttnagttgtctatgactatgctacgtcggggtcccnccgtacgggcctacgagggaccgaaggggggccttaggggacggtggggtcggtacgtaacggtttagtaatcgtaagttagtggagtagggtaaagtaaagattataactagtcgacacggtacctcggtaggacgggtacctacttaccaccttattaccgaaggtacaacctaacctaccgtaaacgaacctacgtacttagttaacttacgactaaagtacgaacgacgtactcggaagtacgtcgtaggaacggtacgaccggtcgttaggttacgttaacttacggtacgttacgtaacgttactaacgtacggaacggaacggtaccggtaaccggtaccccgg

SEQ ID NO: 49356 - DNA, 716 bp, Homo sapiens
  misc_feature: GYAE6OF02IMIHF.52.77.G11.1.454.CMB.1.raw
  modified_base (311)..(311): a, c, t, g, unknown or other
  misc_feature (311)..(311): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcgtgggttttcctcgttagctcttttaagaggtgtccagtgtcaggtgcagctggtggagtcgtgggggagcgtggtccagccgtgggagtccctgagactctcctggtgcagcctctggattcacctttcgagtgtctagtgacatgacacgtcggggtcccncgaggtcctccgagggccgaaggggggtccttaggggagttgggggtaggcctaaggtttaatatacctaaagttagtggtaagtacgggtaaaagtaaacgtaataagttactaagtcgactaaggtacctccggtaggaaacgggtccgtaagttaccaaccttattcccgaagacgaacctaacctaccgaaaagaacctaccgtacgttacgtttaagttacgaactaaaacgttacggaaacctacggtaccgtagtaaacggtacgtaccgttaacgggaacgggtacccgtacgggtacgttacggttacggtttaacgtttacgttacgggttacgttaaccggttaaacgtttaacgtaaccgggaacgggtaccgggtaaccgtaaaccccgggg

SEQ ID NO: 49357 - DNA, 633 bp, Homo sapiens
  misc_feature: GYAE6OF02JMPS8.52.77.G11.1.454.CMB.1.raw
  modified_base (303)..(303): a, c, t, g, unknown or other
  misc_feature (303)..(303): n is a, c, g, or t
  modified_base (576)..(576): a, c, t, g, unknown or other
  misc_feature (576)..(576): n is a, c, g, or t
tcagcgcagtacgacacgaccggtgctcgatttagctagtcactcaagggaaaggggggagaggagcccagcactagaagtcggcggtgtttccattcggtgatcagcactgaacacagaggactcaccatggagtttgggctgagctgggtttcctcgttgctctttaagaggtgtccagtgtcaggtgcagctggtggagtcgtgggggagcgtggtccaggcctggggagtccctgagacctctcctgtgcagcctgtgattccaccttgagtgtctatgacatcgctacgtcgggtccncgaggtcctccgaggcgaaggggtctagggtacggtggggtcggacgtaagtttagtacgtacgtagttagtcgaaggtttggaaaagttagtattagtaactagtcgacgtagtaccgtacggtaggaacgggtaccgtacgttaccaacgttactttaccgagtaacgaccgaaaccttaccgaaacgaaacctaccggtacttacgttaacgtttacgaactaaacgttacgaacgtacgacgttagacgagtcgtagacggcgacggtntacggtattacgttagtgtacgtacgtaactacgtacgacggtacgaccgtaaccgg

SEQ ID NO: 49358 - DNA, 588 bp, Homo sapiens
  misc_feature: GYAE6OF02FPAM0.52.77.G11.1.454.CMB.1.raw
  modified_base (339)..(339): a, c, t, g, unknown or other
  misc_feature (339)..(339): n is a, c, g, or t
  modified_base (348)..(348): a, c, t, g, unknown or other
  misc_feature (348)..(348): n is a, c, g, or t
  modified_base (375)..(375): a, c, t, g, unknown or other
  misc_feature (375)..(375): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggattcaccttcagttgtctatgacatgcacgtggggtcccgccagggcctccagggcaagggggctgggagtggggnggcagttanatcatatgatggaataagatatactancgacagtacctcgtaggaacgggcgtagttccaacctactttccgaaggacgaacaaccttaccaacgaacaccgtactagttactttagaacctaaatacgaacacgtcctagaacgagcgtaggacggacgacggacgttacggtgttaattaccgtggtacgaacgttaacgtttaacgtaccggacgggtacggaaccggtaacccggg

SEQ ID NO: 49359 - DNA, 658 bp, Homo sapiens
  misc_feature: GYAE6OF02F4O6E.52.77.G11.1.454.CMB.1.raw
  modified_base (269)..(269): a, c, t, g, unknown or other
  misc_feature (269)..(269): n is a, c, g, or t
  modified_base (320)..(320): a, c, t, g, unknown or other
  misc_feature (320)..(320): n is a, c, g, or t
tcagcgcagtacgacacgaccggtgctcgatttagctagtcactcaaggggaaagggggagaggagcccagcactagaagtcggcggtgtttccattcggtgatcagcactgaacacagaggactcgaccatggagtttgggctggagctgggttttcctcgttgactcttttaagaggtgtccagtgtcaggtgcaggctggtgagtcgtgggggaggcggtggtccgagccgtggggacggtcccctggacgactcgtcctagtgcngcctcgtggattcaccgttcgagtcgtctatgacatgacacgtggggtccnctacgtcctcgaggcgaaggggctgggagtgggtggctaaggttctagtcgattaggtcaagtacggaagttaagattactactagtcgactaggaccgtccgaggaccggcgtaatccgaacgtactttacgaagtaacgaacctaacgtccaaagaaccgtacgctttacggtattttacgaacgtaaacgtcggaaacctaggtcccgttaggaacgtacggacgttacggaacggtacccgaaacgggtcttagggttagttaacggttaccgtagtacggtaacgttaaccgtttaacggtcggtaacggtaacggtaacccggtaacccggg

SEQ ID NO: 49360 - DNA, 737 bp, Homo sapiens
  misc_feature: GYAE6OF02IQQ7T.52.77.G11.1.454.CMB.1.raw
  modified_base (263)..(263): a, c, t, g, unknown or other
  misc_feature (263)..(263): n is a, c, g, or t
  modified_base (289)..(289): a, c, t, g, unknown or other
  misc_feature (289)..(289): n is a, c, g, or t
  modified_base (306)..(306): a, c, t, g, unknown or other
  misc_feature (306)..(306): n is a, c, g, or t
  modified_base (323)..(323): a, c, t, g, unknown or other
  misc_feature (323)..(323): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgcttcttttaaggaggtgtccagtgtcaggtgcagctggtggagtcgtgggggagcggtggtccaggtccgtgggacgtccctgacgtactctctggtncgacgtcctcgtgtacttccaccttnagtgtactatcgaactntcgctacgtcgggtccnccgaggcctccgagggccaacggggggtctaggggacggttcggggtggacgtaaggtttatacgtcgtaattagaggtaagttagggaaaaagttagaaagtttaagttaacgttagtacggacgtaacggtaccgttaccgggttaacgggaaacgggtacccggttaactttacccgaaccgttaactttaccgaaacggtaaccgtaaactaaacccgttaaccgaaacgtaaaccgtaccgtacttacggttaacttacgaaccgtaaaagtaccgaaacgtacgtaccgtaggaacgagtacgtaaggacggaccggtacgtcgttagttacgtaacgttacggtacggtacggtaaccgtaacgttaacggtaccggtaacgggtaaccggtaaccggtaacccggg

SEQ ID NO: 49361 - DNA, 642 bp, Homo sapiens
  misc_feature: GYAE6OF02JGAXQ.52.77.G11.1.454.CMB.1.raw
  modified_base (261)..(261): a, c, t, g, unknown or other
  misc_feature (261)..(261): n is a, c, g, or t
  modified_base (353)..(353): a, c, t, g, unknown or other
  misc_feature (353)..(353): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgagctctcctgtgcagcctntggattccacctttcagtgtctatgacatgctacggtgggtccgccaggtcctaccgaggcgaaggggctgggagtgggtcgacgtagttanactcgatagtgagtaggaaagttaagataagttacgtagtgactagtaccgtcggtaggaacgggtccgtaattccgtaaccgtactttaccgaagtaacgaacctaaccgtaccgaaacgaaccgtaccgtacgttagttaacgttacgaactaaacgtaacgaaaccgtaacgtaccgtaagtaacgtagtaccgtaggacggacgtacggtacgtgtacgttacgttacgtacgttacgaaccgttaacgtaccgtacggtacggtacggtaaccggtaacccggg

SEQ ID NO: 49362 - DNA, 733 bp, Homo sapiens
  misc_feature: GYAE6OF02IXAET.52.77.G11.1.454.CMB.1.raw
  modified_base (177)..(177): a, c, t, g, unknown or other
  misc_feature (177)..(177): n is a, c, g, or t
  modified_base (466)..(466): a, c, t, g, unknown or other
  misc_feature (466)..(466): n is a, c, g, or t
tcagcgcagtacgacacgaccggtgctcgatttagctagtcactcaaggggtaaaggggggagaggagcccagcactagaagtcggcggtgtttccgattcggtcgatcagcactgaacacagaggactcaccatggagtttgggctgagctgggtttcctcgttgctcttttaagnggtgtccagtgtcaggtgcagctggtggagtcgtggggagcgtggtccagccgtgggacggtccctggactacctctccgtgtcgcaggtccctcgtcggactttacctaccttcgacggttcgtaccttagtgaactcgtcgcgtacggttcggggtcccaccggacggccctaccggagggacggaaacgggggtctaggggaacgttgggggtacgacgttaagttaactagtctaaataggtagagttagggaaaaacgttaaggtacttaaccgttaagtttanaacggtaccgtaaacggtaccgtttacccggaagggaacgggtaccctattaccgaaccttagttaccgaagtaacgaacctaacgacctaaagaccacgtacgtagttaacttacgaacgtaaactacgaaaccttacggccgttaagacgaacggttaccgtaagggtaaccgacgtacgggtacgtaagggttaaccgtaagttccgttaagggtcgtaaccgtaatttaccgacggtaacggtaccggtaaccgtaacccggg

SEQ ID NO: 49363 - DNA, 631 bp, Homo sapiens
  misc_feature: GYAE6OF02HA1PG.52.77.G11.1.454.CMB.1.raw
  modified_base (305)..(305): a, c, t, g, unknown or other
  misc_feature (305)..(305): n is a, c, g, or t
  modified_base (339)..(339): a, c, t, g, unknown or other
  misc_feature (339)..(339): n is a, c, g, or t
  modified_base (348)..(348): a, c, t, g, unknown or other
  misc_feature (348)..(348): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctctttaagaggtgtccagtgtcaggtgcagctggtggagtcgtggggggagcggtggtccagccgtggggacgtccctgagactctcctgtgcagcctctggattccaccttcagtgtctatgacatgcacgtgggtccnccaggcctccgaggcgaaggggctgggagtgggngctagttanatacatatgataggaaagtaagataacgtaactagtgactaaggtacctccgtaggaaacgggccgtaattccgaacctacgtttaccagaacgactaactaccgaaacgaacaccgacttacgtatttacgaacgtaaattacgaaaccgtacgaccgtagtaacggaacgccgttaggaacggacgtaaccggtagttaggttacgtttaacgtacggttagtaggtaaccgtaaacgtttaaacgtaccggaacggtaacgggtaacccgtaacccgggg

SEQ ID NO: 49364 - DNA, 736 bp, Homo sapiens
  misc_feature: GYAE6OF02I7KUE.52.77.G11.1.454.CMB.1.raw
  modified_base (426)..(426): a, c, t, g, unknown or other
  misc_feature (426)..(426): n is a, c, g, or t
tcagcgcagtacgacacgaccggtgctcgatttagctagtcactcaagggaaagggggggagaggagcccagcactagaagtcggcggtgttccattcggtgatcagcactgaacacagaggactcaccatggagtttgggctgagctgggtttcctgttgctcttttaagaggtgtccagtgtcaggtgcagctggtgagtcgtggggaggcgtggtccagccgtggggacgtccctggagacctctcctgtcgcacgtcctcgtggacttcaccttcagtgtctatgactatgacctaacgttcggggtcccgccgacggccctacccggaaggtaccggaaacgggggtctagggtagggtcgggggtggaccgtaaggtttatacgtcaaattacgtaggtaacgttaggaaaaggttaaanattaagtacttaagtcgacgtaaacgtccgttacgacggtaacgggaccctaacttaccgaaccttacgttaaccgaacggaaaccgtaacctaaacccgttacgaaaacggtaacccgtacgtaccgtttaacgttacggtttaacgaaccttaaaacgtaccggtaaacctaaccggtaccgttagggaaccggtagtacccgtaggaacggaccgtaccggtacggtttcggttaagttacgttaacgttggtaacgtacgttaaacgttacgtacggaaaccgggacggtaaccggtaaccccggg

SEQ ID NO: 49365 - DNA, 454 bp, Homo sapiens
  misc_feature: GYAE6OF02F7Y00.52.77.G11.1.454.CMB.1.raw
  modified_base (221)..(221): a, c, t, g, unknown or other
  misc_feature (221)..(221): n is a, c, g, or t
  modified_base (431)..(432): a, c, t, g, unknown or other
  misc_feature (431)..(432): n is a, c, g, or t
  modified_base (434)..(454): a, c, t, g, unknown or other
  misc_feature (434)..(454): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtcgctcggtgcggacgtctggggccaagggaccacggtnacgcgtcgtcctcgagcctccaccgaagggccccatccggtccttccccccgtgggcctacccctcctcccaagacgccaacctcgtcgggggcctacgacgccggccccgtgggctcggccctgggtaccaaggacctacgttccctaagtaccggtatccggcttcggacggcgggccgtggacgaaggtccgacacgtaggctacgnngnnnnnnnnnnnnnnnnnnnnn

SEQ ID NO: 49366 - DNA, 475 bp, Homo sapiens
  misc_feature: GYAE6OF02HAY03.52.77.G11.1.454.CMB.1.raw
  modified_base (335)..(335): a, c, t, g, unknown or other
  misc_feature (335)..(335): n is a, c, g, or t
  modified_base (427)..(475): a, c, t, g, unknown or other
  misc_feature (427)..(475): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtatactgtgcgaacttaatacacggaggacgaacgtacggaccccgtcccgctcgtcggcggacgtcgtcgggccgaacggaccgaccgtcgagcgtctcctcacgcctccaccaacggaccgctcggtccttccccctcggcacccctccctcaacgagcacctcgtgggggcacaggccggcccgtcggcgtacnccgtcggtacgaagtaaccgttacttcctaactacggactcgtcgtacggaggccggggtcgtacggacaacggggaccgtccaaattaggnnnnnnnnnnnnnnnnnnnnnnnnnnnnnnnnnnnnnnnnnnnnnnnnn

SEQ ID NO: 49367 - DNA, 587 bp, Homo sapiens
  misc_feature: GYAE6OF02HBTGD.52.77.G11.1.454.CMB.1.raw
  modified_base (347)..(347): a, c, t, g, unknown or other
  misc_feature (347)..(347): n is a, c, g, or t
  modified_base (453)..(453): a, c, t, g, unknown or other
  misc_feature (453)..(453): n is a, c, g, or t
  modified_base (465)..(465): a, c, t, g, unknown or other
  misc_feature (465)..(465): n is a, c, g, or t
  modified_base (499)..(499): a, c, t, g, unknown or other
  misc_feature (499)..(499): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctggggaggtccctgagactctcctgtgcagcctctggattcaccttcagtgtctatgacatgcacgtgggtccgccgaggctccgagggccaagggggctgggagtgggtggctagttntatcatatgatggaataagatatactatgcagacctcggtgaacgggccgtattccacctatttccgaagacgaacaacctcaaacgaacacgactgtatttcganaaagtcgaaacncgacctagacggagctaggaacggacgtaccggngttacggtaggtttaacttaaccgttggttacggaacgttaaacgtttaacgtacccgtaacggggtaccggaacggtaaaccccggg

SEQ ID NO: 49368 - DNA, 517 bp, Homo sapiens
  misc_feature: GYAE6OF02GB6DP.52.77.G11.1.454.CMB.1.raw
  modified_base (300)..(300): a, c, t, g, unknown or other
  misc_feature (300)..(300): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcagtgtctatgacatgcactgggtccncaggctccaggcaaggggctggagtgggtgcagttatatcatatgatggaagtaagatatactatgcagactcgtagaacgggcgattcactattccagacgacaactaccaagaacacgctagtatttgacaaatgaacagacctgagagctgacggacacggctgtagttattacgtgtagacgtaacttaagtacgacggaggacgtaaccggg

SEQ ID NO: 49369 - DNA, 694 bp, Homo sapiens
  misc_feature: GYAE6OF02IBQ04.52.77.G11.1.454.CMB.1.raw
  modified_base (365)..(365): a, c, t, g, unknown or other
  misc_feature (365)..(365): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggtttcctcgttgctctttaagaggtgtccagtgtcaggtgcagcgtggtggagtcgtgggggaggcgtggtccagccgtgggacgtccctgagactctcctgtgcagcctcgtggacttccaccttgagtcgtctatgactatcgcgtacgtcgggtccgccgaggtcctaccgaggtaccgaagggggtctgggaggtgggtgacgtagttanactctaagtagtgagttaggaaagtaagataatactagtcgactacggtacctacggacggtaacgggtcccgtaattccgtaaccgttacgtttaacccgaggtaaccgtaacctaaaccgtaacccgtaaacgtaaccgaccgtaccgttagttaacgtttacgaacgttaaacgtacgtaaacctacgtaccgtaaggaacggacggtctaacgggaccggaaccgtaccgggtacgtagggtttaacgttacgttacgttaggttaccgtaacgttaacgttaacggaccgggtaaaccggtaccgggtaacccgtaaccccggg

SEQ ID NO: 49370 - DNA, 552 bp, Homo sapiens
  misc_feature: GYAE6OF02F2T69.52.77.G11.1.454.CMB.1.raw
  modified_base (347)..(347): a, c, t, g, unknown or other
  misc_feature (347)..(347): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctggggaggtccctgacgactctcctgtgcagcctctggattcaccttcagtgtctatgacatgcacgtgggtccgccgaggcctccgaggcgaaggggctgggagtgggtggctagttanatcatatgataggaagtaagatatactatgcagactcgtaggaacgggccgattcacctactttaccagacgaccaactaccaagaacacgactagtattgacaaagtgaacagcctagagagcgtagacggacacggtcgtgttagttacttacgtggttacgacgtaactttaacgaccgaacgggacgtaccgtaacccggg

SEQ ID NO: 49371 - DNA, 557 bp, Homo sapiens
  misc_feature: GYAE6OF02GNS7X.52.77.G11.1.454.CMB.1.raw
  modified_base (300)..(300): a, c, t, g, unknown or other
  misc_feature (300)..(300): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgcagcctctggattcaccttcagtgtctatgacatgcacgtgggtcccnccgaggcctccgaggcaagggggctgggagtgggtggctagttatatcatatgatggaaatagatatactatgcagactcgtagaggccgatcacctattcagacgacaactacaagaacacgctagtattgactaaagtacgaacacgtacctagaacgacgacgtagaacggaccgacggtcgtggttacgttatttacgtaggttacgaccgtaacgtttaaccgacgtaacgggacggtaaccgtaacccggg

SEQ ID NO: 49372 - DNA, 702 bp, Homo sapiens
  misc_feature: GYAE6OF02H16PX.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggaggcgtggtccaggcctggggacggtcccctggacgactctcctgtgcagcctctggattccaccttcagttgtctatgacatgccacgttcgggtcccgcgtaggcctccgaggccgaacgggggctaggggaggttcggggtggactaaggtttatacgtctaattagtgagtaaggtaaagtaagtactaagttaactaagtgaactaacggaccgttccggtaggaacggggtaccctaacgttaccctaaccgttaactttacccgaaggtaccgtaaaccaaacccgttaaccgaaaacggtaacccgaccgtacgttagtacgttttacgaacctaaagtacgaaacgaacgtacccgtaggaacggacggtacgtagggaaccgaccggtaccgggtacgttaaggttagttacgttaaccgttagtacggtacgttaacgttacgtaccggtaacggaccggtaaccgtaacccgggg

SEQ ID NO: 49373 - DNA, 827 bp, Homo sapiens
  misc_feature: GYAE6OF02GPALF.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagccgtggggacggtccctggacgactctcctgtcgcagccttcgtggtactttcctaccctttcaaggttgtaccttagtacgaaccgtaattcgaccgtacgttccgggggttccccgacccgaacgggtcccttacccggaaggggacccggaaacgggggggcccgggtaagggttggggggtcgggaccgtaaggttttaacgtacgttaccgaaagtttaagtaggtaagttaaggggaaaaggttaaagtaagttaacttaaaccgttaagttacggaccgtaacggtaacccgttcccggtaaggggaaacgggtacccggtaactttacccgaacccgttaacgtttacccgaaaggtaaccgtaacccgtaaaccgtaacccgaaaacggtaaacccgtaaccgttaccgttaacggtttaacgttttaccggaaacttaaaacgtaccgtaaacgtaaccggtccgttaacggaaggaacggtacgtaacgggaacggtaccgacgggtcgttaggttacgttaacgttaccgtggtaaccgtaacgttaacttacgtaccggaacggacggtaccgaccggttaccccgg

SEQ ID NO: 49374 - DNA, 694 bp, Homo sapiens
  misc_feature: GYAE6OF02IWIVH.52.77.G11.1.454.CMB.1.raw
  modified_base (259)..(259): a, c, t, g, unknown or other
  misc_feature (259)..(259): n is a, c, g, or t
  modified_base (305)..(305): a, c, t, g, unknown or other
  misc_feature (305)..(305): n is a, c, g, or t
tcagcgcagtacgacacgaccggtgctcgatttagctagtcactcaagggaaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgagtcgtgggggagcgtggtccagccgtgggaggtccctgagctctcctgtgcagcctntggattcaccttcagtgtctatgacagtcgcacggttcgggtcccncagggccctccggagggaccaaggggtctagggagttggggtcgacttaggttactacgtcaattagtggaagtttagggaaaacgttaaggtaattacttaacgttaagtcgaaccgaagttaccgttacggtacggtaacgggccgtactttaccacccgtagtttaccaagggtaacgaaccgtaaccgttaaccgaacggtaaaccgtaccggtaccttacggtttacgtttacgtaacgtaaacgttacggaaaccgtacggtacccgttaggaacggtacggtacgtacgggacggtacgaccggtacgtaggttacgttacgttacgtacggttacgtaccgttaacgttaacgtacgtaacgggacggtaccgtaaccggg

SEQ ID NO: 49375 - DNA, 769 bp, Homo sapiens
  misc_feature: GYAE6OF02GVD07.52.77.G11.1.454.CMB.1.raw
  modified_base (157)..(157): a, c, t, g, unknown or other
  misc_feature (157)..(157): n is a, c, g, or t
  modified_base (191)..(191): a, c, t, g, unknown or other
  misc_feature (191)..(191): n is a, c, g, or t
  modified_base (278)..(278): a, c, t, g, unknown or other
  misc_feature (278)..(278): n is a, c, g, or t
  modified_base (312)..(312): a, c, t, g, unknown or other
  misc_feature (312)..(312): n is a, c, g, or t
tcagcgcagtacgacacgaccggtgctcgatttagctagtcactcaagggaaaggggggagaggagcccagcactagaagtcggcggtgtttccattcggtgatcagcactgaacacagaggactcaccatggagtttgggctgagctgggtttccncgttgctcttttaagaggtgtccagtgtcaggtncagctggtgagtcgtggggagcgtggtccagcctgggagtccctgacgctctcctagtcgcagcctcgtggattccaccttcgagtntccgtatcgactatcggaccacgttcgggtcccnccgaggtccttacccgaaggggtccgaaagggggtccttagggggtacggttacggggtcgtacgttaacgttacgttaacgtcgaatttaacgtcgggtaaactttagggaaaacggttaacgtaaagtttaaccgtaacgttaaacgtcggaaccttaacgggttacccggttaaccgggtaaggggtaacccgggtacccgttaacgtttacccggaaacccgtttacgtttaacccgaacgggtaaccggtaacccttaaaccggtacccgtaaaacggtaacctaccggttacgttagtttaacgtttaccgaacgtaaacgttcggaaaccgtcggtaccgttaggaaccgtgtacgagggtaccggacctgggtaccttaggtaccgttacgttacgtacggttgaaccgttaacgtaccgttaggaacccggtaggaccttaacccggg

SEQ ID NO: 49376 - DNA, 759 bp, Homo sapiens
  misc_feature: GYAE6OF02JV66H.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctggggaggtccccgaggacctctccgtcgtcggcacgcctccgttggacgttctaccttcgtagtgttcgtactaggtacaagtcgtcgtaaccgtcggggtcccgtccgaccggtaccgttcccgaaccgggtccggaacgggggtccgtagggtaggggttcgggtgggtccgtaggttacttaagtccgtaatacgttggattaggggtaaagtaagtagttaatacgttaagtacgacgtaagtaccggtcggttacgaacggggtaccgtaacgttaccgtaacctacgtttaccgaacggttaacggaacccaaaccgttacccaaaacggtaacccgaaccggtcctttaacgggtacttttacgaaacgttaaaccggttaacgaaccgtaaccgcttaccgggaatacgggcctaaggtaccgggaacgtaccgtcggttacgttacggtttattaacggtagtaccggtaccaaggtttaaccgtaaccggacgggtaacgtacgggtaacccgtacccggg

SEQ ID NO: 49377 - DNA, 700 bp, Homo sapiens
  misc_feature: GYAE6OF02IMTNE.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggcctggggagtccctgagactctcctgtgcagcctctggattcacctttcagtgtctatgacatcgctacgtcgggtcccgaccgagggcctcccgaggtccgaacgggggtcttagggggaggttggggtcggactaaggtttactagtcgtaacttagtggtaagtagggtaaaagtaaggtaattaagttaccgtaagttcggactaggtaaccgttaccgggtaagggaaacgggtcccgtaacgttacccgtaaccgttaccgtttaccgaaacggtaacgaaaccctaaaccgttaaccgtaaacgtaaccgtaaccgtacgttacggttactttacgaactaaagttacgaaacgtacgtaccgtagaacggtacgtacgtagggaacggtaccgacggtcgttacggttagttacttacgtgtagtacgtaacttacgtacgaacggtacggaacgtaacccggg

SEQ ID NO: 49378 - DNA, 559 bp, Homo sapiens
  misc_feature: GYAE6OF02HKR2G.52.77.G11.1.454.CMB.1.raw
  modified_base (304)..(304): a, c, t, g, unknown or other
  misc_feature (304)..(304): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctggggaggtccctgagacctctcctgtgcagcctctggattcaccttcagtgtctatgacatgctactgggtcccnccgaggcctaccagggccaagggggcctgggaggtggggtcggcgtagttatatcaatatgagtggaaagtagatatactatgcagactcgtagaggccatccacctattcagacgacaactaccaacgaacacgctagttatttgactaaatagaaccagcctagaagagactaggaggaccacgggactggtacttagttacgttggtaggtacgtaaactttaacgtaccgaacgggtagacgtaacccggg

SEQ ID NO: 49379 - DNA, 637 bp, Homo sapiens
  misc_feature: GYAE6OF02GA58J.52.77.G11.1.454.CMB.1.raw
  modified_base (308)..(308): a, c, t, g, unknown or other
  misc_feature (308)..(308): n is a, c, g, or t
tcagcgcagtacgacacgaccggtgctcgatttagctagtcactcaagggaaagggggggagaggagcacagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagcctgggagtccctgagactctcctgtgcagcctgtggattccaccttcagtgtctatgactatcgcacgtcggggtcccnccgaggcctccgaggcgaagggggctgggaggttggggtcgactagtttatagtcaatagtaggatagggaaagtaagataacttactagtcgactagtacgtaccggtaggaacgggccgtattaccaccttacgtttaccaacgtacgtaaacctaacctaccgaaacgaaccacgtacctagttacttacgaactaaatacggaaacctacgtaccgtaggacgaacgtcgtacgggacggaccgacggtcgttaggttacggttaacgtttacgttcggtacgaacggttaaacgttaacgaccggtaacgggacgtaaacccgg

SEQ ID NO: 49380 - DNA, 396 bp, Homo sapiens
  misc_feature: GYAE6OF02JBJ8N.52.77.G11.1.454.CMB.1.raw
  modified_base (355)..(355): a, c, t, g, unknown or other
  misc_feature (355)..(355): n is a, c, g, or t
  modified_base (376)..(376): a, c, t, g, unknown or other
  misc_feature (376)..(376): n is a, c, g, or t
  modified_base (382)..(396): a, c, t, g, unknown or other
  misc_feature (382)..(396): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcgacggagacaacggtcgacccccgtcgctcggtgcggacgtcgtcggggccaagggccacggtcagcgtctcctcacgccctaccaaccgaacgggcccagtccggtccttcccccgtggccaccctccctccaagacgccacctctgggggcacagcggccctggctgcctgtcaaggctactcctcgtactgcnctgcgcgggctggctaagcgnatacgnnnnnnnnnnnnnnn

SEQ ID NO: 49381 - DNA, 522 bp, Homo sapiens
  misc_feature: GYAE6OF02HVVN8.52.77.G11.1.454.CMB.1.raw
  modified_base (508)..(522): a, c, t, g, unknown or other
  misc_feature (508)..(522): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtcgaccccccgtcgctcggtgcggacgtctgggggaccaaaggggacccacggtacacgacggtccttccgtaccacgaccgtcccctaacccgaaaccgggacccggtacctacggttccgtttccccccttcccggcgacccccttacccccttcccgtaaacaaagggcctaccctaccttcggggggacgggaccaacggccgggccccggtccgggcggtccgtcgtccgggttacgaaaccgggaacttaccctttacccgttacttaaacgtaccgtacgtcccgtgtaagggccggggccgtcggcggaaacggaggccataagcgnnnnnnnnnnnnnnn

SEQ ID NO: 49382 - DNA, 776 bp, Homo sapiens
  misc_feature: GYAE6OF02JU3OR.52.77.G11.1.454.CMB.1.raw
tcagcgcagtacgacacgaccggtgctcgatttagctagtcactcaagggaaagggggggaggaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgttggtccaggcccgttggggacggttcccctggagaccttctccgtggtagccagcccttcgtaggtacttaccaccttcagttgtcttatgacagtcgccgtacgtcgggcccgcgacggtccgtccgaagggccggaaagggggcgttgggaacggttggggtcggtacctaaggttttactaagtccgtaaattgtggaagtagggtaaaggtaaagtaattaacgtacgttagtagtaccgtaggtacccgttacggtacggaaccgggtacccgttaagttacccgaaccttaacgtttcccgaaacggacgtaaaccaaccgttaaccgaaacgtaacctaccgtacgttatttaaccggttagtaaacgaaaacgttcgtaaacccgtaacggtaccgttaggaaacgttaccggacgttaccgggaaacggttaccgtaccgggttaacgttcggtttaacgtttaacgttaacccgttaggttaacgtaaccggttaaacgttacgttaaccccggaagggttacccgtaacgggtaaacccccggg

SEQ ID NO: 49383 - DNA, 818 bp, Homo sapiens
  misc_feature: GYAE6OF02JRL0A.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctctttaagaggtgtccagtgtcaggtgcagctgggtggagtcgtgggggaggcgtggtccaggccctggggacggtccccgtgacggtactcctccgtggtgcaacgtccctgtggtacttccacctttcaggttcgtcttatgaacctagtcgtaccgtacgggtcccggggtacccctaccgggacgtcccgtccggggggggaacctaacgggggggaccggtttcggggaagggtttcggggggttggggtaccgggtaaggttttacttaaagtttccgtaaacttaagtttaggtaaggttacgggtaaaaggttaaaacgtaagttaatttaaacgtaagttacggactaacggaccgttacccggtggggtaaacgggtacccggtaacttttacccgaccttaaccgtttacccgaagtaaccggaaactaaaccctacgaaaacctacgaaaccgtctagggtttactttggaaacctaaagtacggaaaccgtacgttccgagggtaaccgtgggacctaggtaaccgggaccgaccggcgtttaaccggtgttttaaccttaacgtcggttacgtaacggttaaacccttacgttaaccggaaccgggtaaacgggtaccggttaaaccggtacccccggg

SEQ ID NO: 49384 - DNA, 771 bp, Homo sapiens
  misc_feature: GYAE6OF02IAKMJ.52.77.G11.1.454.CMB.1.raw
  modified_base (132)..(132): a, c, t, g, unknown or other
  misc_feature (132)..(132): n is a, c, g, or t
  modified_base (176)..(176): a, c, t, g, unknown or other
  misc_feature (176)..(176): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccanggagtttgggctgagcttgggttttcctcgttgctcttttaagnggtgtccagtgtcaggtgcagcgtggtggagtcggtgggggaggcgtggtccagccgtgggacgtccctgacgactctcctgtgcagcctcgtggacttccaccttcagtgtctagtgctagtcgcacggtcgggtcccgaccgtaggcctaccgagggtacgaacgggggctggggaggttcggggtaggtccgtaaggtttattaacgtacctaagttagtaggtaagtaaggggtaaagttaaaccggatttaaggtaaacttagttacgggacttaaccggtaccgtaccggttaacggggaaccggggtacccgttaactttaccgaaccctttaaccgtttaccgaaacggtaaccgtaaacccgtaaaccttaacccgtaaaaccggtaaacctaaccgggtcctttaacggttacgtttacggaaacctaaaaggttacgtaaaccgtaggtaacccgtaggtaacggacggtaacgtacgggaaccggtaacggaccggttcgttcggttaagttacttaacgggttacgtcggtaaccgttaacttaacgtaccgggaacgggaaccgggtacgtaaccccgggg

SEQ ID NO: 49385 - DNA, 831 bp, Homo sapiens
  misc_feature: GYAE6OF02FEXL8.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggtagtttgggctgagtcttgggttttcctgttgcttctttaagacggtcgtccagtgtacgaggtgcagtcgtgggtggagtcggtggggggacgtcggtacggtccaggtccgtgggacgttccctgaacgtcttcgtccgtggtcgctaccggccttcgtggtacctttctacccgtttagacggtttcgtactagtacgaacctcgttcgacccgttcggtccgggtacccacggtacggtccacgggacggtacgggacggggtggtagggtacgggtcggggttacgtaacgttaggttaactacgtacgttaaggtaggtaaggttaaggtaaacgggttaaaacgtaagtaacgtttaaccgttaaacgtacggtaccggtaaccgttaaccggtaccgggttaacgggtaccgggaaacccggttccgttaaaccgttacccgttaaaccgttaaccggttaaccgtaaacggtaaacccgtaaacccgtaaaccgttaaaccggaaaccggttaaccgtaccgtttacggttaacgtttacgttaaacgaacgtaaacgtaccggacgtacgtaccggtaacgacggtacggtcgtaagggaccgtacggtcgtacgtaggtacgttacgtacgtcggtaaaccgtacgttacgtaccggtcggaacggtaccggacccggtacccggg

SEQ ID NO: 49386 - DNA, 726 bp, Homo sapiens
  misc_feature: GYAE6OF02JW6YO.52.77.G11.1.454.CMB.1.raw
  modified_base (324)..(324): a, c, t, g, unknown or other
  misc_feature (324)..(324): n is a, c, g, or t
  modified_base (612)..(612): a, c, t, g, unknown or other
  misc_feature (612)..(612): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgctcttttaagaggtgtccagtgtcgtaggtgcagctgggtggacgtcgtggggggagcgtggtccagccgtgggaggtccctggagtactctccgtgtgcagcctcgtggacttccacctttcagtcgtacctatcgactattgctacgtggggtcccnccgaggccctacccgaggggcctaagggggcctaggggacgggttcggggtacggacctaaggtttagtaacttccgaaattacgtggtaggtaaggggaaaacgtttaaagacttattaaaccgtgttccggaacaacggttacccgtcccgggttaagggaaccggggtacccttaagtttcccgtaaccgttaaccgttttacccggaagtaaccggaaaccttaacgtaaccccgtaaagaaaccgtacgtacttaagtctttaacgacgtaacgtacgaaacncggtaccaggtacgaacgtgtacggaggtaccgtacggtcgttaggttacgtacgttacgtcgtaagttaccgtaacgttaccttaggaaccgggtacgtaaccggtaaccggg

SEQ ID NO: 49387 - DNA, 679 bp, Homo sapiens
  misc_feature: GYAE6OF02HKO7M.52.77.G11.1.454.CMB.1.raw
  modified_base (177)..(177): a, c, t, g, unknown or other
  misc_feature (177)..(177): n is a, c, g, or t
  modified_base (275)..(275): a, c, t, g, unknown or other
  misc_feature (275)..(275): n is a, c, g, or t
  modified_base (297)..(297): a, c, t, g, unknown or other
  misc_feature (297)..(297): n is a, c, g, or t
  modified_base (369)..(369): a, c, t, g, unknown or other
  misc_feature (369)..(369): n is a, c, g, or t
  modified_base (433)..(433): a, c, t, g, unknown or other
  misc_feature (433)..(433): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgcttcgttttaagnggtgtccagtgtcagggtgcagcgtgggtaggtagtcggtggggggaacgggtcgtgggtaccagccgttggggacggtccctgagtactctcgtgtncagtcctctggacttcaccttnaggtgtctatcgactatcgcacgttcgggtcccgcccagggtcctcccggaggaccgaagggggtctggggnggttacggggtcgactaaggtttaatgtacgaattagtggaaggtaagggtaaaagtaaacggnttaaagtaaccttagcgaacgtacgtaacgtccggtaaggacgggtaccggtaactacctaacgtacttaccgaagaacgtaacaacctaaccgaaacaacgaccgtattagtacgttacgaacctaaatacgtaacaccgtacgtagaacgtagacgtaggaacgacgaccggtgtagttagttacgttacgtacggtacgtaacgtaacgttaactacggacggttaggaacccgtaacccggg

SEQ ID NO: 49388 - DNA, 686 bp, Homo sapiens
  misc_feature: GYAE6OF02HDP9N.52.77.G11.1.454.CMB.1.raw
  modified_base (308)..(308): a, c, t, g, unknown or other
  misc_feature (308)..(308): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtcagtgtcaggtgcagctggtggagtcgtgggggagcgtggtccagccgtggggacggtccctgagacctctcctgtgcagcctcgtggattccaccttcagtgtctatgacatgcacgtggggtcccnccaggcctccgagggccgaaggggctaggggagtggggtggacaggtttatatcaatagtgatagggaaagtaagataatactatgacaggtactccggtaggaacgggtaccgtacttccacccgtaactttacccgaaggaacgtaaccaaaccgtacccgaaagaacccaacggtaccttagttatttacggaactaaaagttcggaaaacacggtacccgttaggaaacgtaacggacgttacgggaacggtaccggacgggtaccgttacgggttacggtttaagttaaccgttcgggttaccgtaaccggtttaaaccgtttaaacggtaacccggtaacggggtaaccgggtaaaccggtaaaccccgggg

SEQ ID NO: 49389 - DNA, 580 bp, Homo sapiens
  misc_feature: GYAE6OF02JZ611.52.77.G11.1.454.CMB.1.raw
  modified_base (335)..(335): a, c, t, g, unknown or other
  misc_feature (335)..(335): n is a, c, g, or t
  modified_base (491)..(491): a, c, t, g, unknown or other
  misc_feature (491)..(491): n is a, c, g, or t
  modified_base (555)..(555): a, c, t, g, unknown or other
  misc_feature (555)..(555): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagtcctctggattcaccttcagtgtctatgacatcgctgtcgggtccaccaggcctccaagggcgaaggggcctagggnggttgggtaggcctaagtttacatcgtatagtggatgggaaattaagactatatatgcacgtcgtacgtggaaacgggcctagtcaaccgtatttccgaagacgaacctaactaccgaaagacctagcttagtacttagaaccaaagttcgaaacncgtcctagaccgtgtactggacgacaggtcgtgtattacgtacgtagtcgacgttaaccgttanacggtacggaacgacgtaacccggg

SEQ ID NO: 49390 - DNA, 739 bp, Homo sapiens
  misc_feature: GYAE6OF02IU980.52.77.G11.1.454.CMB.1.raw
  modified_base (159)..(159): a, c, t, g, unknown or other
  misc_feature (159)..(159): n is a, c, g, or t
  modified_base (313)..(313): a, c, t, g, unknown or other
  misc_feature (313)..(313): n is a, c, g, or t
tcagcgcagtacgacacgaccggtgctcgatttagctagtcactcaaggggaaagggggggagaggagcccagcactagaagtcggcggtgtttccattcggtgatcagcactgaacacagagactcaccatggagtttgggctgagctgggttttccncgttgctcttttaagagtgtccagtgtcaggtgcagctgggtggagtcgtgggggagcgtggtccagccgtggggacgtccctagagaccttctccgtgtgcacgcctcgtggattccaccttcgagtgtctatgacatgcacgtcgggtcccncgaggcctccggaggcgaaggggctgggagtggggtagactagttatacgtacaattatgaagtagggaaaacgttaagtaattaagtactagtacgacgaacgtaccgttcggtaacgggaaacggggtccgtatttacccgaacctttaacgtttccgaaacggtaaaccgtaaccctaaacccgttaacccgaaaagtaaacccgtacggttacccgtttaggtttaacgtttagaaaccctaaaagttacggaaaacctaccggtacgtagggtaacgacggtaaccgggtaggaaccgggtaccgtaaccgggttaccttaggggttaaccgtttaacgttaccggtacggttacggtaaaccgttaacgttttaacgacccggggaaaccgggttaaccggaacccgtaacccccggggg

SEQ ID NO: 49391 - DNA, 608 bp, Homo sapiens
  misc_feature: GYAE6OF02I1P6J.52.77.G11.1.454.CMB.1.raw
  modified_base (298)..(298): a, c, t, g, unknown or other
  misc_feature (298)..(298): n is a, c, g, or t
  modified_base (371)..(371): a, c, t, g, unknown or other
  misc_feature (371)..(371): n is a, c, g, or t
  modified_base (586)..(586): a, c, t, g, unknown or other
  misc_feature (586)..(586): n is a, c, g, or t
tcagcgcagtacgacacgaccggtgctcgatttagctagtcactcaagggaaaggggggagaggagcccagcactagaagtcggcggtgttccattcggtgatcagcactgaacacagaggactcaccatggagtttgggctgagctgggtttcctcgttgctctttaagaggtgtcagtgtcaggtgcagctggtggagtcgtggggagcgtggtccagcctgggagtccctgagactctctagtgcagcctcgtggattccacttcagtgtctatgacatgcacgttcggggcccnccgaggtcctaccgagggacaaggggcgtaggacgggttggggtggactaaggttataacgtcctaagttagngtaagtacggaaagttaaacgatagttactagtcggacagtactccggagaacgggtcattcgacttatcaagacgacaacctacgaagacacgtactagtactttacgaactaaacgtcgaaacgtacgtccgtagaacgtacgtaccgtagaaccggtaccgaacgggttactggttaagttacgttaacgcgttacgacgttaaacttacgngaaccggacgtactaacccggg

SEQ ID NO: 49392 - DNA, 887 bp, Homo sapiens
  misc_feature: GYAE6OF02G5RIM.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagggacgtactaccactaggtaggttagggttcggcgtaggacgttcgggtttttcgggtttttcccgttggttcgttacctttttaacggtttaagggtacgggttccgtaccgtaggttcgtacggtagggtcgacgtacggtcggttggggtagggtacggttcgggggtagggggcggttcggttccggacgcggtcggggtaggggtcccgttccggtaggacgtcctccgtacgtggtcgacgtccgtccgttacggtacggttacctacccgtttacctacggtaggtttccgttacttacgtaccgattacggtcgacccggttacggggttccgggcccaccggacggtcccgtacgggacggtaacggggacgggtcgggtaggggtacggggttggggtacggtacgtttaaggttacttacgacgttaagttacgtaggtaacggttaagggtaaaacggtaattaagttaacttacgtagtacgacgtacgtaccggttacggaacggggtaccggtacttaccgtaacccgtaacctttacgtaacgaacggaacgtaaacccgtaaccgtaaaccgaaacgacccgtacgtacgttagtttacgttaacgaaacttaacgaacgtaaccgccgtagaggaagaccgtagacggaccgtacgggtccgtgttacggtacgtttacgtacggttcggaacgtttaaccgttaactaccggtaacgggaacgggtaaccgtaccgggtaaccccggg

SEQ ID NO: 49393 - DNA, 647 bp, Homo sapiens
  misc_feature: GYAE6OF02GNY30.52.77.G11.1.454.CMB.1.raw
  modified_base (260)..(260): a, c, t, g, unknown or other
  misc_feature (260)..(260): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcggtggtccagccgtgggacgtccctggacgactctcctgtgcngcctcgtgacttcaccttcagtgtctatgacagtgcacgtcgggtcccgcaggcctccgaggcgaaggggctggaggtcgggtgacgtagttatagtcagtagtgaagtaggaaagtaagataagttactagtcgacgtacgtacgtcggtagaacgggccgtacttacacctacgttcaacgtacgactaaccgtacaaacgaacacgtctagttacttacgactaaatcgaaacgacgtaccgtagaacgacgtacgtacggacggtaccgtaccggtacgttacggttaacggttacgtttaacccgttaggttaccgtaaccgttaaaccggtttaacgtacccgggtaaaccggggtaacgggtaacccgttaaccccgggg

SEQ ID NO: 49394 - DNA, 798 bp, Homo sapiens
  misc_feature: GYAE6OF02H9S8V.52.77.G11.1.454.CMB.1.raw
tcagcgcagtacgacacgaccggtgctcgatttagctagtcactcaagggaaaggggggagaggagcccagcactagaagtcggcggtgtttccattcggtgatcagcactgaacacagaggactcaccatggagtttgggctgagcttgggtttcctcgttgctcttttaagaggttgtccagtgtcaggtgcagctggtggagtcgtgggggaggcgttggtccagccgtgggagtccctgaacgtctcgtcctggtcgcgacgtcctcgtcggtaatttccaacctttcgaggttcgtcttaagtcgactagttcgacctacggttccgggtcccgacccgaggtcccctccgacgggaccgtaaacgggggtccgttaggggtaggttacgggggtcggtaccttaaaggttttaaccgtacgtaccgttaagttaagtggtaaggttagggtaaaacggttaaatagtttaaacgttaactttaaggaccgtaacgaaacggttacccgttaccggtaacgggtaaaccgggtccggtaaacgttaccccgtaaccgttaaccgttttaccgggaaacgtaccggtaaaaccgtaaacccgtttaaacccgaaaaccgttaaccggtaaccgtacgttaagtttaaaccgttaacgtaacgtaaacgtacgtaaaccgacgtaaccgtagacggatacgtaggaacgacgtacgtcggtacgttacgttacttacgttcgtaacgttacgtaaccgtagttaaccggaacgggtacgtaaccggtaaccccgg

SEQ ID NO: 49395 - DNA, 731 bp, Homo sapiens
  misc_feature: GYAE6OF02H565K.52.77.G11.1.454.CMB.1.raw
  modified_base (272)..(272): a, c, t, g, unknown or other
  misc_feature (272)..(272): n is a, c, g, or t
  modified_base (281)..(281): a, c, t, g, unknown or other
  misc_feature (281)..(281): n is a, c, g, or t
tcagcgcagtacgacacgaccggtgctcgatttagctagtcactcaaggggaaagggggggagaggagcccagcactagaagtcggcggtgtttccattcggtgatcagcactgaacacagaggactcaccatggagtttgggctgagctgggttttcctcgttgcttcttttaagaggttgtccagtgtcaggtgcagctggtggagtcgtgggggagcgtggtccagccgtgggacgtccctgagactcctcctgtgcagcctcgtaggnttcaccttnagtgtactatgacatcgacacgttcgggtcccgccgagggtcctccgaagggccgaagggggtctgggagtggggtgctagttactatctatatgagtagggaaagttaacggaattaactaacttagtacggacctaacgtaccgtaccggttaggaaacggggtccctaacgtttccgaacccgttactttacccgaagtaaccggtaaccaaaccgttaccaaaacgaaccgtaaccgtaccgtttaacgtttaaccgtttacggtaaccgttaaaacggtacgtaaaacgtacgttaacccggtaaggaaaccgggtacgtaacgtaggtaaaccgggaccgaccgggtacgttggtttacgtttaacgttacggttacggtaacggtaacggtttaacgttaacggttacggtaaaccgggtaccggtaaacggtaaaccccggg

SEQ ID NO: 49396 - DNA, 690 bp, Homo sapiens
  misc_feature: GYAE6OF02HZFJB.52.77.G11.1.454.CMB.1.raw
  modified_base (159)..(159): a, c, t, g, unknown or other
  misc_feature (159)..(159): n is a, c, g, or t
  modified_base (260)..(260): a, c, t, g, unknown or other
  misc_feature (260)..(260): n is a, c, g, or t
  modified_base (273)..(273): a, c, t, g, unknown or other
  misc_feature (273)..(273): n is a, c, g, or t
  modified_base (304)..(304): a, c, t, g, unknown or other
  misc_feature (304)..(304): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttccncgttgctcttttaagaggtgtccagtgtcaggtgcagctggtggagtcgtgggggagcgtggtccagcctggggaggtcctgagactctctgtgcagcctntggattcaccttnagtgtctatgacatcgcacgttgggtacccnccgaggtcctaccgagggcgaacgggggctaggggacgttggggtgacgtaaggtttatacgttacaatttagaggagtacgggaaattaaagattaattaaccgtatgacgacgtaccgtaccggtaggaaacgggtcccgtaagttaccgaaccttacgtttaccaaggtaacgaaacctaaccgttaaccgaaacgtaaaccgaaccgtcttacgttaagtttacgaaactaaacgtaacgtaaacgtacgaccttagaagacgtacgttacggacgggaccgaccggtacgttacggtacgttaacgtttacgtaaggttccggtaaccgttaaacgttaaccgtaacggtaaccgggtacggtaacccgttaaacccgggg

SEQ ID NO: 49397 - DNA, 579 bp, Homo sapiens
  misc_feature: GYAE6OF02I0134.52.77.G11.1.454.CMB.1.raw
  modified_base (262)..(262): a, c, t, g, unknown or other
  misc_feature (262)..(262): n is a, c, g, or t
  modified_base (361)..(361): a, c, t, g, unknown or other
  misc_feature (361)..(361): n is a, c, g, or t
  modified_base (395)..(395): a, c, t, g, unknown or other
  misc_feature (395)..(395): n is a, c, g, or t
  modified_base (493)..(493): a, c, t, g, unknown or other
  misc_feature (493)..(493): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagagtgtccagtgtcaggtgcagctggtggagtctgggggagcgtggtccagcctgggacggtccctgacgactctcctgtgcagccctntggacttcaccttcagtgtctatcgactatgctacgtcgggtacccgccgaggcctccgaggtacgaagggggctgggaggtggggtcggataggttanatcagttatgagtaggaagtaagatagtactagngacagtacctacggtacgacggctatcgacctattacgagagacaactacaagaaccacgcgtagtacttagactaagtgaactagaccgtagaacgngacgtagacggacgtacggtacgtcggtagttacttacgtgtacgtactaacgttacgtacggaaccgggtacgtaacgtaccggg

SEQ ID NO: 49398 - DNA, 615 bp, Homo sapiens
  misc_feature: GYAE6OF02FWQ3J.52.77.G11.1.454.CMB.1.raw
  modified_base (279)..(279): a, c, t, g, unknown or other
  misc_feature (279)..(279): n is a, c, g, or t
  modified_base (308)..(308): a, c, t, g, unknown or other
  misc_feature (308)..(308): n is a, c, g, or t
  modified_base (342)..(342): a, c, t, g, unknown or other
  misc_feature (342)..(342): n is a, c, g, or t
  modified_base (351)..(351): a, c, t, g, unknown or other
  misc_feature (351)..(351): n is a, c, g, or t
  modified_base (374)..(374): a, c, t, g, unknown or other
  misc_feature (374)..(374): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatgggagtttgggctgagctgggttttcctcgttgctcttttaagaggtgtccagtgtcaggtgcagctggtggagtcgtgggggaggcgtggtccaggcctggggagtccctgacgactctcctgtgcagcctctggacttcaccttnagtgtctagtgacatgcacgtgggtcccncgaggcctccgaggcgaaggggctgggagtgggngctagttanatctagtatgagtaggaagtaanatagtactagtgacgtaagccgtacggtaggaacgggtccgtaattccgacctacttaccgaagtaccgaaccaactaccgaaataaccacgtctagttaacttcgaactaaagtacgaaccgacggtcccgaggtaacgagtccgtaaggacggaccgacggtcgttcggtaaggttacttacggtgtacgtacggtaacctttacgaccggtaacgggaacggtacccgtaaacccggg

SEQ ID NO: 49399 - DNA, 819 bp, Homo sapiens
  misc_feature: GYAE6OF02JWUIU.52.77.G11.1.454.CMB.1.raw
tcagcgcagtacgacacgaccggtgctcgatttagctagtcactcaagggaaagggggggaggaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccaggccgtggggacggtccccgtgacgtactccgttccctggtgcagtcccctgtcggtacttccgtaccgtttcgacggttcgtcctaagtgtaacctagtcgcctagtcggggtccctccgagtccgtccgacggtacggaacgggggtctggggtacgggtcgggtaggccggtaaggtttaatagtacccgtaagtcggtagtaagttagggtaaaaggtaaagttataaacttacgtaagtgaccgtaacggtccgtccggtacggaacggggtacccgttacgttacccgtaaccgttaccgtttacccggaggtaacccgtaacgtaaacccgttacccgtaaaaacggaaccctaaaccggttacgtacgttaaacggttttaacgaaccgttaaaaacggtacgtaaacccggaacgtaaccccggttaagaacgggttaacgtaacgtaccgggtaaacggtaacccgggtccgtacgggttacggttaaggtttaccgttaaacgttacgggttacgtaacccggtttaaacttaaaccggtaccggaaccgggttaaccgggaaccccgtttaaacccgggg

SEQ ID NO: 49400 - DNA, 645 bp, Homo sapiens
  misc_feature: GYAE6OF02JX2CE.52.77.G11.1.454.CMB.1.raw
  modified_base (263)..(263): a, c, t, g, unknown or other
  misc_feature (263)..(263): n is a, c, g, or t
  modified_base (312)..(312): a, c, t, g, unknown or other
  misc_feature (312)..(312): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagttctgggggagtcgtgggtccaggcctgggacgtccctgagctctcctgtgcagcctntggacttctaccttcgagttgtctatgacagtcgctacgtcgggtcccnccaggcctccgagggccgtaagggggctggtaggtcggtaggcgtaagtttagactcgtatagttacggattagggaaaattacggtataactaacgttagtaggacgtaacggtccgttaccggtaacgggtaaacgggtcccgttaacttaccgacccttaaagttaccgtaaacggtaacgtaaccctaacgttaaccgaacggaacctaacggtacgttagttagtttacgaactaagtacgaacctagtccgtagacgtgactagacgtacggactcgtagtagtattacgagtagacgtacgttactacgacgggtacacgtaccgg

SEQ ID NO: 49401 - DNA, 557 bp, Homo sapiens
  misc_feature: GYAE6OF02G1E7Y.52.77.G11.1.454.CMB.1.raw
  modified_base (301)..(301): a, c, t, g, unknown or other
  misc_feature (301)..(301): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcctctggacttcaccttcagtgtctatgacatgcacgtgggtccnccaggcctccgaggccgaagggggctgggaggtgggtggctagttatatcatatgatggaataagatatactatgacagtactcgtaggaacggccgtatcgactattccagacgacaactaccaaagacacgctagtatttgactaatgaaacagtacctagagtacgcgtagacggacacggtcgtagttacggttagttacgtggtacgaccgtaacttaacgtaccgaacgggtacggaaccgtaacccggg

SEQ ID NO: 49402 - DNA, 692 bp, Homo sapiens
  misc_feature: GYAE6OF02JK9VY.52.77.G11.1.454.CMB.1.raw
  modified_base (289)..(289): a, c, t, g, unknown or other
  misc_feature (289)..(289): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgcttctttaagaggtgtccagtgtcaggtgcagctggtggagtcgtgggggagcgtggtccaggccgtgggacgtcctgacgactctcctgtgacagcctctggacttcaccttcagtgtctagtnactatgctacgttcgggtacccgtcgaacggtctacccagggtcgaaacggggggctggggaggtgggggttcggactaaggtttatacgtcagttacgttggaacgtagggaaaacgtagtaacttaatacttaggtcgcaggtacctaccggtaggaacgggtccgtacttaccgacctacgtttccaaggtaacgaacctaaccgtaccgaaagtaacccaacgtccgttagtaacgtttagaacctaaagtacgaactaacgtaccgagaacggtacgacgttacgggacggtaccgaccgggtacgttaaggttacgtttaaacgttccggtaggttaccgtacggttaaacgtttaaccgtacggaaccggggtaccggtaaccgttaaccccgggg

SEQ ID NO: 49403 - DNA, 671 bp, Homo sapiens
  misc_feature: GYAE6OF02II7AV.52.77.G11.1.454.CMB.1.raw
  modified_base (263)..(263): a, c, t, g, unknown or other
  misc_feature (263)..(263): n is a, c, g, or t
  modified_base (328)..(328): a, c, t, g, unknown or other
  misc_feature (328)..(328): n is a, c, g, or t
  modified_base (374)..(374): a, c, t, g, unknown or other
  misc_feature (374)..(374): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtggggaggcgtgggtccagccgtggggacggtccctgagactctcctggtgacncgcctcgtggtacttcctaccttcaggttctctaatcgactatcggtacctacgtcggggtcccnccgtacggcctacccggaggcggaacggggcctgggaggttggggngtacgtagttacagtcaagtatgggaagtagggaacgtaaagattaattacgtatcggaatacgtacgtcggtaggtaacgggtccgtactacgtacctacgtttaccagaacgaaccaacgtaaccaaacgaacgtaccgtacgtacgttagttacgtaacgtaaactaacgtaacacgtaactacgacggacgtacggtacgaacgtacggtacgtcggttacgttgttaacgttacgttaggtacgtacgtaacgttaacgtaccggtaacggtacggtaccggtaaacccggg

SEQ ID NO: 49404 - DNA, 683 bp, Homo sapiens
  misc_feature: GYAE6OF02FUK05.52.77.G11.1.454.CMB.1.raw
  modified_base (164)..(164): a, c, t, g, unknown or other
  misc_feature (164)..(164): n is a, c, g, or t
  modified_base (185)..(185): a, c, t, g, unknown or other
  misc_feature (185)..(185): n is a, c, g, or t
  modified_base (200)..(200): a, c, t, g, unknown or other
  misc_feature (200)..(200): n is a, c, g, or t
  modified_base (246)..(246): a, c, t, g, unknown or other
  misc_feature (246)..(246): n is a, c, g, or t
  modified_base (318)..(318): a, c, t, g, unknown or other
  misc_feature (318)..(318): n is a, c, g, or t
  modified_base (381)..(381): a, c, t, g, unknown or other
  misc_feature (381)..(381): n is a, c, g, or t
tcagcgcagtacgacacgaccggtgctcgatttagctagtcactcaagggaaacggggggagacggagcccagcactacgaagtcggcggtgtttccagttcggtgatcagcactgaacacagaggactcaccatggagtttgggctggagcgtgggttttccncgttgctcttttaacgaggtntcccagtgtcaggtncagctggtgatcgtggggagcgtggtccaggcctggggacgtcccngagactctcctgtcgcagcctcgtggattccaccttcgagttgtctatgactagtcgcacgtcggggtcccncgacggcctccgagggcgaagggggctagggaggttgggtgactaggttatatcgaatttagngtaagttagggaagtaacgtattaagtacgttatcggacaaggtacctccggtagggtaaccgggtccgtaacttccgaacccttacttacccgaagacgaacctaaccgtaccaaaggaacaccggtacttagttacgttacgaaccaaagttacgaaaccgtacgtaccgtaagggacgacggtcgttaacggacggaccgtacggtccgttaggtacggtttacttaacggttgtaccggtaacgtttaaaccgttacgtaaccgggtaacgggtaaccggtaacccggtaacccgggg

SEQ ID NO: 49405 - DNA, 705 bp, Homo sapiens
  misc_feature: GYAE6OF02F5A0M.52.77.G11.1.454.CMB.1.raw
  modified_base (275)..(275): a, c, t, g, unknown or other
  misc_feature (275)..(275): n is a, c, g, or t
  modified_base (279)..(279): a, c, t, g, unknown or other
  misc_feature (279)..(279): n is a, c, g, or t
  modified_base (288)..(288): a, c, t, g, unknown or other
  misc_feature (288)..(288): n is a, c, g, or t
  modified_base (303)..(303): a, c, t, g, unknown or other
  misc_feature (303)..(303): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggtccagcctgggagtccctgagactctcctgtgcagcctctggacttcaccttnagtntctatgacntgcacgtgggtaccncaggctccgaggcgaaggggctgggaggtgggtgctagttatagtcaatgtagagttagggaagttaagagttaacttaacgttagtcggacgtaagtacccgtaccgggtacgggaaacggggtcccgtaactttacccgaacccgttaacgttttccgaacggtaacgaaacccgtaaaccgttacccggaaacgtaacccgaccggttaccttacgggtttaaacgttttcggaacctaaaaggttaccggaaaccgtaccgtaccgtagggtaacggtacgacgttagggaacgggtacccgacgggtaccgttaggttacggttaacgtttacggtacggttacgtaccgttaactttaaccggaccggaacgggtaccggaaccggtaacccgggg

SEQ ID NO: 49406 - DNA, 374 bp, Homo sapiens
  misc_feature: GYAE6OF02IZQ1P.52.77.G11.1.454.CMB.1.raw
  modified_base (262)..(262): a, c, t, g, unknown or other
  misc_feature (262)..(262): n is a, c, g, or t
  modified_base (274)..(274): a, c, t, g, unknown or other
  misc_feature (274)..(274): n is a, c, g, or t
  modified_base (355)..(355): a, c, t, g, unknown or other
  misc_feature (355)..(355): n is a, c, g, or t
  modified_base (361)..(374): a, c, t, g, unknown or other
  misc_feature (361)..(374): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtcgctcggtgcggacgtctggggccaagggaccacggtcagcgtctcctcagcctccaccaaggcccatcggtctccccngcacctctccanagcacctctggggcacagcgccctggctgcctggtcaaggctacttcctatacgatcgctgacgcgggctggacaagggcncatagnnnnnnnnnnnnnn

SEQ ID NO: 49407 - DNA, 708 bp, Homo sapiens
  misc_feature: GYAE6OF02FR6FB.52.77.G11.1.454.CMB.1.raw
  modified_base (175)..(175): a, c, t, g, unknown or other
  misc_feature (175)..(175): n is a, c, g, or t
  modified_base (279)..(279): a, c, t, g, unknown or other
  misc_feature (279)..(279): n is a, c, g, or t
  modified_base (307)..(307): a, c, t, g, unknown or other
  misc_feature (307)..(307): n is a, c, g, or t
  modified_base (316)..(316): a, c, t, g, unknown or other
  misc_feature (316)..(316): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtggagtcgtgggggaggcgtggtccagccgtgggacggtccctggagactctccgtgtgcagcctctggattcaccttnagtgtctatgacatgcacgtcgggtccncgaggtccnccgaggcgaaggggtctggggacggtggggtcgctaggttatagtacgatatgaagtaggaaagtaagattaatacttaagtgaccaaggtacctccggttaggaacgggtccgtaactttaccgaacccttacgtttacccgaaggtaaccgaacccgtaaaccgttaacccgaaaacggtaaccctaaccgtacttacggtttaacgttttacgaaacctaaaagttcgaaaccgtagtacccgttaggaacggtacggtaaccgtagggaacgggtaccgtaacgggtacgttaacggttacgtttaagtttaccggtggttaaccggtacgttaaaaccgtttaacgtacccgggtaaacgggtaaccgggtacccgtaaacccgggg

SEQ ID NO: 49408 - DNA, 688 bp, Homo sapiens
  misc_feature: GYAE6OF02HSVNS.52.77.G11.1.454.CMB.1.raw
  modified_base (193)..(193): a, c, t, g, unknown or other
  misc_feature (193)..(193): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtncagctggtggagtcgtgggggagcgtggtccagccgtggggacgtccctgagacctctcctgtgcagcctcgtggacttccaccttcagtcgtctatcgactatcgacacgtcgggtcccgccgacggcctacgacggcgaacggggtctagggagggtgggtaggacgtaagtttatacgtctaattagtggaagttagggaaacgtaagtacttaactacgtagtcgactacgtacctacggtaggaacgggccttactacctacgttacttaccgagaacgtacaaccgttaccgaaagtacacgtacgtagttacgttagaactaaagtacgaaacgtcgtaccgtagaacgtacgtacgtacggaaccggtacggtaccggtaccgttggttaaccgttacgtttaacggttcggtaaccggttaaccgttaaaccggttaaccgtaacccgggtaacgggtaaccggtaaccccggttaaaccccgggg

SEQ ID NO: 49409 - DNA, 639 bp, Homo sapiens
  misc_feature: GYAE6OF02GURPA.52.77.G11.1.454.CMB.1.raw
  modified_base (193)..(193): a, c, t, g, unknown or other
  misc_feature (193)..(193): n is a, c, g, or t
  modified_base (376)..(376): a, c, t, g, unknown or other
  misc_feature (376)..(376): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtncagctggtggagtcgtgggggaggcgtggtccagccgtggggacgtccctgagactctcctgtgcacgcctctggattccaccttcagttgtctatcgacatgctacgtcgggtcccgacgacgggcctccgaagggccgaagggggctagggaggttggggtgcctagttatatcaattagngagtaggaaagtaagattatactagtcgactagtaccgtacggtaggaacgggtccgtattaccaccttactttaccgagtaacgaccaaccgtaccaaacgaaccacgtacttagttacttacgaactaaagtacgaacacggtacctagaacgtacgacgtagacggaccgacggtacgttaggttacgttaacgttacgttacggtacgtaccgttaacgttaacgtacggtaaccgggacggtaaccggtaaccccggg

SEQ ID NO: 49410 - DNA, 710 bp, Homo sapiens
  misc_feature: GYAE6OF02IMW7L.52.77.G11.1.454.CMB.1.raw
  modified_base (632)..(632): a, c, t, g, unknown or other
  misc_feature (632)..(632): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcgttgggttttcctcgttgcttcttttaagaggtgtccagtgtcaggtgcagctggtggagtcgtgggggagcgtcggtccagccgtgggacgtccctgagcctctccgtgtcgcgagtccctgttggatttccaccctttcgaagttcgtacctaagtcgtaactagtcgcctacggttcggggtcccgccgaggccctccgaggcgaaaggggctagggagggttggggtcggacttaacggtttaatattcgtaattagttaggaagttaaggaaagttaagtaagttaacttaacgtagtacgacgaagtacccgttccggtaaggaaccggacctataccctacttacgttaccgaagtacgtaaacctaaccgttaacgaaaacgtaacgaacccgttattacgttaatttacgaacctaaagttacgaaaccgtcgtaccgttagaaacgtggaactaggaaccggtactaacccggngtttagttacgttacttaacgtacggttacgaacgttaacgttaactacggtaacgggtaaccggaaccgttacccgg

SEQ ID NO: 49411 - DNA, 597 bp, Homo sapiens
  misc_feature: GYAE6OF02IJ4A1.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctgggtggagtcgtgggggagcgtggtccagcctggggacggtccctgagacctctcctgtgcagcctctggattccacctttcagtgtctatgacatgcacgtcggggtcccgccgtagggcctccgagggccgaaggggggcttggggaggttggggtggcgtaaggttatagtcaattatgagtaggaaagtaagactaatactatgacagtactccgtaggaaggcctatacactattaccagaacgacaactaccgaaagaccgacgctagtattacgaactaaagtcgaaacagtcctagacgagtccgtaggacggacacggtcttggttagttaattacgtgtacgtaccgtaactttaacgaccggtaacgggacgtaaccgtaacccggg

SEQ ID NO: 49412 - DNA, 584 bp, Homo sapiens
  misc_feature: GYAE6OF02G15PA.52.77.G11.1.454.CMB.1.raw
  modified_base (313)..(313): a, c, t, g, unknown or other
  misc_feature (313)..(313): n is a, c, g, or t
  modified_base (347)..(347): a, c, t, g, unknown or other
  misc_feature (347)..(347): n is a, c, g, or t
  modified_base (356)..(356): a, c, t, g, unknown or other
  misc_feature (356)..(356): n is a, c, g, or t
  modified_base (388)..(388): a, c, t, g, unknown or other
  misc_feature (388)..(388): n is a, c, g, or t
tcagcgcagtacgacacgaccggtgctcgatttagctagtcactcaaggggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggaggcgtggtccagccgtggggacggtcccctgagactctcctgtgcagcctcgtggattccaccttcagtgtctatgacatgacacgtcgggtcccncgaggcctccgaggcgaaggggctgggagtgggnggcagttanatcatatgagtaggaagtaagattaatactangactacgactacggtaggacgggtacgtactacactacttaccagacaacaacctacaacgaacacgcttagtattagactaatacgaacacgtacgtagagacgcgtaggacggaccgaggtcgtggtacgttagttacgttaggtacgtacgttaaacgttaacgacggtacgggtacggtaaccgtaaccggg

SEQ ID NO: 49413 - DNA, 766 bp, Homo sapiens
  misc_feature: GYAE6OF02I7HUP.52.77.G11.1.454.CMB.1.raw
tcagcgcagtacgacacgaccggtgctcgatttagctagtcactcaagggaaaggggggagaggagcccagcactagaagtcggcggtgtttccattcggtgatcagcactgaacacagaggactcaccatggagttggctgagctgggttttcctcgttgcttcttttaagaggtgtccagtgtcaggtgcagctggtggagtcgtggggagcgtggtccagccgtgggacgtccctgacgactctcctgtcgcagcctgtaggactttcaccctttcgagttgttactaagtcgaactattacggcctaaccggttcgggggtaccccctaccggtaacggggcccttaacccggaacgggacccggaaaaggggggtcctaacgggggtaggttcggggaggacccttaaggtttaaacgtactaccgtaaagttaagtggtaaacgtttagggaaaaacggtaaagtaacttaaagtaaccgttaattaccggaacttaaggtacccgttacccgggtaaggaaaccggggtaccgtaacgtttacctaaaccttaacgtttacccgaaaggtaacgtaaacctaaaccgtaaaccgtaaacgaaaccgtaaccgtacgttagttaatttacgaactaaactacgaaacgtacgtaccgtagaacgtagacgtacgaacggaccgtaccggtagtagttacgtacgttaagtacgtacgtaacgttaacgtaaccgtacgtaacggtacgaaccgtaaccgg

SEQ ID NO: 49414 - DNA, 737 bp, Homo sapiens
  misc_feature: GYAE6OF02HPSE3.52.77.G11.1.454.CMB.1.raw
  modified_base (304)..(304): a, c, t, g, unknown or other
  misc_feature (304)..(304): n is a, c, g, or t
  modified_base (341)..(341): a, c, t, g, unknown or other
  misc_feature (341)..(341): n is a, c, g, or t
  modified_base (397)..(397): a, c, t, g, unknown or other
  misc_feature (397)..(397): n is a, c, g, or t
tcagcgcagtacgacacgaccggtgctcgatttagctagtcactcaagggaaaggggggaggaggagcccagcactagaagtcggcggtgtttccattcggtgatcagcactgaacacagaggactcaccatggagtttgggctgagctgggttttcctcgttgctcgttttaagaggtgtccagtgtcaggtcgcagctggtaggagtcgtgggggaggcgtggtccagcctggggacggtccctggagactctcctgtgacagtcctctggattctaccttctagtcgtctatgacatgtcnctcggtccgcgtacgctccgagcgaacgggcgtaggngtgggtggcgagtttttagactcgatagtgagtggaagtaagataactactatcgnaacgtactaccgtaggaacgggtccgtataccgtaacctacgtttaccgaacgtacggaaactaaacgttacccgaaagaaaccgtaaccgtaccgttaggtttaactttacggtaacgtaaaacgttaccggtaaaaccgacggttaacccgttaaggaaccgggtaacgttaccgggttaacgtaagggaacccggtacccggggtaacgttcccgggttaaggtttaaccgtttaaaccggttaacggtttaccggggtaaccgttaaaccggttttaaaacgtttaccccggggaaacgggtttaaccgggaaaccggtttaaaaccccccggggg

SEQ ID NO: 49415 - DNA, 746 bp, Homo sapiens
  misc_feature: GYAE6OF02JMJPC.52.77.G11.1.454.CMB.1.raw
  modified_base (554)..(554): a, c, t, g, unknown or other
  misc_feature (554)..(554): n is a, c, g, or t
  modified_base (566)..(566): a, c, t, g, unknown or other
  misc_feature (566)..(566): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttatcgacggaggacaacggtcgacccccgtcgctcggtgcggacgtcgtgggaccaagggaccacggtcacggcgtcctcctcgacgtccctccaaccgaaacggggcccctagtccgggttcccttccccccgtgggacccctaacccccttcccgtacccgaaaggaccgtcccgtaacctccggttccggggggaccaaaccgttaccgggccccggccccgtttacggggcccgttaccggtcccgttacggggttaccaaaacggggtcccttttaacccgtttacccgtaacgtttaaaccggaccttccgggttaccgttacgggaacgggtcccggggttccgttacgggtaacccgtaaacgggggccgtacccgtaaggttaaacccggngtcgtacgtacncgtacgacgacgtcgacgcgcgacgtacgtacgtcgtacgacgtcgtcgtcgtacgtcgtacgtcgcgtcgacgtacgtcgacgtagtacgcgtacgtacgtacgtacgtcgtcgacgcgacgtacgacgacgtacgtagtacgcgtagtacgtacgtcgtacgtactctacgtagtacg

SEQ ID NO: 49416 - DNA, 864 bp, Homo sapiens
  misc_feature: GYAE6OF02I8S2H.52.77.G11.1.454.CMB.1.raw
  modified_base (266)..(266): a, c, t, g, unknown or other
  misc_feature (266)..(266): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagtcggtgtaccagccgtgggacgtccctgacgtacctcctccgtgtcgacncgtccgtactggtacttcctacccttgtacggttcgtctaacgtcgaactactgacctaccgtcggggtccccgtaccgaggtcccgtaccggaaggtccggtaaggggggtcctaggggtagggttcgggggtcggtacgttaacggttacttacgtaccgtaaagttacggttaggtaaggttaacgggtaaaaagttaagtaaacgtttaaccgttaaaccgttaaggttacggtaacccgtaaagggtttccccgttaacccggggttaaacgggaaacccggggtcccgggtttaacttaacccgtaacccggttaaccgttttacccgaaaagggttaaacccggaacccgttaaaacccgttaaccgaaaaacccggtaaccgtaacccggtttaaccgtacggttttaacgttttaacccggaaattaaaaccggttaacgaaaccgttacgtacccggttaggtaaccggaacggttccgtaacgggaccgttacgacggttacgttacggtttacttaacgttcggtacggttaacgtaccggttaaacttaacggtccggaacggttaccggaacgttaaccccggg

SEQ ID NO: 49417 - DNA, 377 bp, Homo sapiens
  misc_feature: GYAE6OF02F1YX7.52.77.G11.1.454.CMB.1.raw
  modified_base (365)..(365): a, c, t, g, unknown or other
  misc_feature (365)..(365): n is a, c, g, or t
  modified_base (371)..(377): a, c, t, g, unknown or other
  misc_feature (371)..(377): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgcattactgtgcgaacttaatcacggaggacaacggtgacccccgtccgctcggtgcggacgtctggggccaaggggaccacggtcagcgtctcctcagcctccaccaagggcccaatccggtcttcccccctggccaccctcctccaagagcacctctggggcacagcggccctgggctgcctggtcaaggactactcatacgatcgctgagcgggctggcaaggcncatagnnnnnnn

SEQ ID NO: 49418 - DNA, 704 bp, Homo sapiens
  misc_feature: GYAE6OF02GBFCF.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctggagactctcctgtgcagcctctggtattcaccttcagtgtctagtgacatgctacgtcgggtcccgccaggcctaccgagggtcgaagggggtctagggaggttggggtcggacgtaggtttattacgtactagttagtcgtaagttagggaaaaggttaaagtaagtttaataaccgttaatcggtaccaacgggtacctttacccggtagggtaaaccggggacccgttaacgtttacccgaacccgttaacgttttacccgaaaggtaacgaaccctaaaccgttaacccgaaacgtaaacccgtaccgttacgttacgttttaacgttaaccgtataaaacgtacgaaaccgtacgaccgttaggaacgagtcgtagtaacggacgacggtacgttgtacttacgttacgtagtacgtacgtaacttaagtaccgtaacggacgtaccgtaacccggg

SEQ ID NO: 49419 - DNA, 596 bp, Homo sapiens
  misc_feature: GYAE6OF02IW824.52.77.G11.1.454.CMB.1.raw
  modified_base (159)..(159): a, c, t, g, unknown or other
  misc_feature (159)..(159): n is a, c, g, or t
  modified_base (309)..(309): a, c, t, g, unknown or other
  misc_feature (309)..(309): n is a, c, g, or t
  modified_base (353)..(353): a, c, t, g, unknown or other
  misc_feature (353)..(353): n is a, c, g, or t
  modified_base (367)..(367): a, c, t, g, unknown or other
  misc_feature (367)..(367): n is a, c, g, or t
  modified_base (446)..(446): a, c, t, g, unknown or other
  misc_feature (446)..(446): n is a, c, g, or t
  modified_base (478)..(478): a, c, t, g, unknown or other
  misc_feature (478)..(478): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttccncgttgctcttttaagaggtgtccagtgtcaggtgcagctggtggagtcgtgggggaggcgtggtccagcctgggacgtcctgagctctcctgtgacagccttcgtggacttcgacctttcgaggtgtctagtgtacatgcactgggtccncaggctccgaggcaagggctggagtgggtgcagttacagctatntgatggaagtaagnttaagactatggcaagtccgtacgtgaacgggccgtatccaactacttccgagtaacgtacaaccgtacgaacgtaacncgtcttagtaactttcggaactaatcggaacnggtcctaggaaccgtagtaccgagtaacggacaccgggtgtacggttagttaacttacgtccggttagtacccggttaaattacgtaccggtaacgggtaagtacgtaaaccccgggg

SEQ ID NO: 49420 - DNA, 796 bp, Homo sapiens
  misc_feature: GYAE6OF02HWWHG.52.77.G11.1.454.CMB.1.raw
  modified_base (446)..(446): a, c, t, g, unknown or other
  misc_feature (446)..(446): n is a, c, g, or t
tcagcgcagtacgacacgaccggtgctcgatttagctagtcactcaagggaaagggggggaggaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggaggcgtggtccagcctggggacgtcctggagactcttccgtgtgacacgtcctcgtggacttcacttcagtgtcttatgacatgcgtacgtcgggtccgccacggctccgacggacgtaagggggccgtgggaggttgggggtacggaccgtaaggtttaatacgttacgtaagttacgtaggtaaggtaaggtaaaaggtaaaggtaactttaacttacgtttaaacgngtaccgtaacggttaccgtttacccggtaacgggtaaacggggtacccgttaaccgtttacccgtaaaccgttaacccgttttaccgaaacggtaacggtaaacctaaaccgttaaccgaaaacgaaccgaaccgttaacgttacgtttaagttacgtaaacgtaaaacgtacgaaaccgtacgtaaccgttacgtaacggaggtaccgttaacgggacggtacccgggttaacgggtaccgttgggttaaccgtttaggttaaccgtttacgggttacgtaaccgggtttaaaccgttaccggttaacccggtaacgggtaaccgggtaaccgggttaaacccccgggg

SEQ ID NO: 49421 - DNA, 780 bp, Homo sapiens
  misc_feature: GYAE6OF02IGVJC.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctgttgctcttttaagaggtgtccagtgtcaggtgcagctggtgagtcgtgggggagcgtggtccagccgtgggacgtccctgagacctctctgtgcagcctcgtggtacttccacctttcagttgtctaatgactatcgacacgtcggggtcccgaccgaggcctccgagggcgaagggggtcctaggggaggttggggtcgacttaggttaatacttcgaagttacgtaggaagtagggtaaaagtaaaggattaaaagttacctagtacgaccgtaacgtaccgttcccggtaagggtaaaccggggtaccgtaacgttaccctaaccgttaacgtttacccgaacggtaacgtaaaccctaaaccgttaacccgaaaacgtaaacccgaacccggttacctttaggtttaacgtttacggtaaaccctaaaagttaccgaaaaccgtaaccggtacccgttaagggaaaccggtacggtaccgttaacgggaaccggaaccggtaccgggttaccgttaggttacggtttaacgtttaaccggttacggttaaccggtacgttaaaccgtttaacgtacccggtaaaccggggtaccgggtaacccggtaaccccgggg

SEQ ID NO: 49422 - DNA, 447 bp, Homo sapiens
  misc_feature: GYAE6OF02IAQAD.52.77.G11.1.454.CMB.1.raw
  modified_base (396)..(396): a, c, t, g, unknown or other
  misc_feature (396)..(396): n is a, c, g, or t
  modified_base (403)..(403): a, c, t, g, unknown or other
  misc_feature (403)..(403): n is a, c, g, or t
  modified_base (406)..(447): a, c, t, g, unknown or other
  misc_feature (406)..(447): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtccgctcggtgcggacgttcgtggggccaaagggccacggtcagcgtctccctcagcctccaaccaagggccccattccggtccttccccctggccaccctcctccaagacgcacctcgtgggggcaccgagccggcccgtgggctcgcctggttcaagggcttaccgttcctaactacgatccgctgaacggcgggtcgtcggcgaaggccgngactagnagnnnnnnnnnnnnnnnnnnnnnnnnnnnnnnnnnnnnnnnnnn

SEQ ID NO: 49423 - DNA, 746 bp, Homo sapiens
  misc_feature: GYAE6OF02GWQ8P.52.77.G11.1.454.CMB.1.raw
  modified_base (194)..(194): a, c, t, g, unknown or other
  misc_feature (194)..(194): n is a, c, g, or t
  modified_base (262)..(262): a, c, t, g, unknown or other
  misc_feature (262)..(262): n is a, c, g, or t
  modified_base (296)..(296): a, c, t, g, unknown or other
  misc_feature (296)..(296): n is a, c, g, or t
  modified_base (302)..(302): a, c, t, g, unknown or other
  misc_feature (302)..(302): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgcttcttttaagaggtgtccagtgtcaggtncagctggtggagtcgtgggggagcgtggtccagccgtgggacgtccctggacgacctcgtcctggtcncacgtccttcgtggacttccaaccttcgaggttntcctancgactagtcgcacggttcggggtaccccacgacggtcctaccgagggtaccggaaggggtctaggggacggttggggtacgacgtaaggtttactacgtacaagtttagtagaagttagggaaaagtacgtaattaactaactagtgactaaggtaccctacgggtacggaacgggtaccgtacttccgtaacctacgtttaccgaagtaacgtaaaccaacgttaacccgaaagtaacccacgtacgttaacgttaagtttacgtaaccgtaaagtacgaaacgtaaccgtaccgtaagtaaccgtacgtaacgttaacgggaaccgtaccggtaacggtacggttacggtaacgtttaaacgttacggttacgttacggtaaaccgtttaacgttaaaccggtaccggtaaacgggtaccggtaaaccggttaaccccgggg

SEQ ID NO: 49424 - DNA, 524 bp, Homo sapiens
  misc_feature: GYAE6OF02G1DLC.52.77.G11.1.454.CMB.1.raw
  modified_base (276)..(276): a, c, t, g, unknown or other
  misc_feature (276)..(276): n is a, c, g, or t
  modified_base (302)..(302): a, c, t, g, unknown or other
  misc_feature (302)..(302): n is a, c, g, or t
  modified_base (400)..(400): a, c, t, g, unknown or other
  misc_feature (400)..(400): n is a, c, g, or t
  modified_base (423)..(423): a, c, t, g, unknown or other
  misc_feature (423)..(423): n is a, c, g, or t
tcagcgcagtacgacacgaccggtgctcgatttagctagtcactcaagggaaaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcctctggattcaccttnagtgtctatgacatgcactgggtccnccaggctccgaggcaaggggctggagtgggtgcagttatatcatatgatggaagtagatatactatgcagactcgtagaggcatcacctattacaganacactacaagacacgctgtattnactaaatcgaacacgcctagacgagactagaggacgacggcgtaggtagttacttagtgtagacgtaacttaagtacgaacgggtacgaacgtaacccggg

SEQ ID NO: 49425 - DNA, 633 bp, Homo sapiens
  misc_feature: GYAE6OF02JLXXK.52.77.G11.1.454.CMB.1.raw
  modified_base (313)..(313): a, c, t, g, unknown or other
  misc_feature (313)..(313): n is a, c, g, or t
  modified_base (345)..(345): a, c, t, g, unknown or other
  misc_feature (345)..(345): n is a, c, g, or t
  modified_base (365)..(365): a, c, t, g, unknown or other
  misc_feature (365)..(365): n is a, c, g, or t
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
  modified_base (514)..(514): a, c, t, g, unknown or other
  misc_feature (514)..(514): n is a, c, g, or t
tcagcgcagtacgacacgaccggtgctcgatttagctagtcactcaagggaaagggggggaggaggagcccagcactagaagtcggcggtggtttccattcggtgatcagcactgaacacagaggactcaccatggagtttgggctgagctgggttttcctcgttgctcttttaagaggtgtccagtgtcaggtgcagctggtcgagtctgggggagcggtggtccagccgtgggaggtccctgacggactcctcctgtgcagcctctggattccgacttcgagtcgtctatgacagtcgctacgtggtcccncgtaggcctccgaggccgtaaggggctagggngtgggtggctaggttacatnaacttgtgagtaggaaatacgatacgtnttanacgcagtacctacgtcgaagggaccgtactccgtaacctactttaccagacgactaaccgtaccgtaaacaacccgaacgtccgttagtacgttttagaaccgtaaataaccgtaanaccgtacgtaggaaacgagtccgtagaacgaccgtaacgggtcttaacggtagttacttaaggtcgttacggaacgttaacgtaacgtaccggaacgggtacgtaaccggtaacccggg

SEQ ID NO: 49426 - DNA, 676 bp, Homo sapiens
  misc_feature: GYAE6OF02JK6MY.52.77.G11.1.454.CMB.1.raw
  modified_base (174)..(174): a, c, t, g, unknown or other
  misc_feature (174)..(174): n is a, c, g, or t
  modified_base (350)..(350): a, c, t, g, unknown or other
  misc_feature (350)..(350): n is a, c, g, or t
  modified_base (365)..(365): a, c, t, g, unknown or other
  misc_feature (365)..(365): n is a, c, g, or t
tcagcgcagtacgacacgaccggtgctcgatttagctagtcactcaagggaaagggggggagaggagcccagcactagaagtcggcggtgttccattcggtgatcagcactgaacacagaggactcaccatggagtttgggctgagctgggttttcctcgttgctcttttaagnggtgtccagtgtcaggtgcagctggtggagtcgtgggggagcgtggtccagccgtgggacgtcctgagactctcctgtcgcgacgcctcgtggtacttccaccttcgaggttctctaatcgactagtcgctacgtgggtcccgcgacggctaccgaggcgaagggctggagtgggngactaggttatactntagtagtcgagtacggaaatagtaatatactagtcgtagacgtacgtcgtaggtaacggccgttaactaccgtaccgtacgttaccgaggtaacgaacctaaacgtaccgtaaagaactccgtaacttacggttacgtttacgaacttaaaggtaacgaaccgtacgtaccgtaaggaacgtaacggccgtaacgggtaaacggtaccgaacgggtccgttaagggttactttaacggttaccgttacggttacccggtagttaaaccgttaacgtaacggtacccgggaacggtaacccggtaacccggg

SEQ ID NO: 49427 - DNA, 740 bp, Homo sapiens
  misc_feature: GYAE6OF02JZGV1.52.77.G11.1.454.CMB.1.raw
  modified_base (173)..(173): a, c, t, g, unknown or other
  misc_feature (173)..(173): n is a, c, g, or t
  modified_base (287)..(287): a, c, t, g, unknown or other
  misc_feature (287)..(287): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggtttcctcgttgctctttaagnggtgtccagtgtcaggtgcaggctggtggagtcgtgggggaggcgtgggtccagtcctgggacggtccctggacgtacctctccgtggtgcagcctcgtggattccgtaccttntagtgtctagtcgactagtcgtcagttcgggtacccaccgtaggtcctaccggtaggaccggaacgggggtctaggggaggttggggtacggtaccctaaggtttacgtaagtacctaggttataggtaaggttagggaaaactaaggtaaattacgttaaccttaagcgttacgaaacggtacccgtaaccgggttacgggaaaccgggtaccgttaacgtcccgtaaaccgttacgttttacccgaaaggtaaccggtaaaccctaaccgttaaccgtaaacgaaacccgtacggttacttacgtttaagttcgtaaactaaggttaacgaaaccgacgtacgtaacgaggtaacggacctaacgggatacggtacggtacgttcgttattaacgttacgtagtacgaccgttaataaccgtaggaccggtaacggtaccgtaaccccggg

SEQ ID NO: 49428 - DNA, 574 bp, Homo sapiens
  misc_feature: GYAE6OF02I5BLN.52.77.G11.1.454.CMB.1.raw
  modified_base (177)..(177): a, c, t, g, unknown or other
  misc_feature (177)..(177): n is a, c, g, or t
  modified_base (179)..(179): a, c, t, g, unknown or other
  misc_feature (179)..(179): n is a, c, g, or t
  modified_base (181)..(181): a, c, t, g, unknown or other
  misc_feature (181)..(181): n is a, c, g, or t
  modified_base (184)..(184): a, c, t, g, unknown or other
  misc_feature (184)..(184): n is a, c, g, or t
  modified_base (186)..(186): a, c, t, g, unknown or other
  misc_feature (186)..(186): n is a, c, g, or t
  modified_base (188)..(188): a, c, t, g, unknown or other
  misc_feature (188)..(188): n is a, c, g, or t
  modified_base (190)..(190): a, c, t, g, unknown or other
  misc_feature (190)..(190): n is a, c, g, or t
  modified_base (192)..(192): a, c, t, g, unknown or other
  misc_feature (192)..(192): n is a, c, g, or t
  modified_base (194)..(194): a, c, t, g, unknown or other
  misc_feature (194)..(194): n is a, c, g, or t
  modified_base (196)..(196): a, c, t, g, unknown or other
  misc_feature (196)..(196): n is a, c, g, or t
  modified_base (198)..(198): a, c, t, g, unknown or other
  misc_feature (198)..(198): n is a, c, g, or t
  modified_base (200)..(200): a, c, t, g, unknown or other
  misc_feature (200)..(200): n is a, c, g, or t
  modified_base (202)..(202): a, c, t, g, unknown or other
  misc_feature (202)..(202): n is a, c, g, or t
  modified_base (205)..(205): a, c, t, g, unknown or other
  misc_feature (205)..(205): n is a, c, g, or t
  modified_base (207)..(207): a, c, t, g, unknown or other
  misc_feature (207)..(207): n is a, c, g, or t
  modified_base (209)..(209): a, c, t, g, unknown or other
  misc_feature (209)..(209): n is a, c, g, or t
  modified_base (211)..(211): a, c, t, g, unknown or other
  misc_feature (211)..(211): n is a, c, g, or t
  modified_base (213)..(213): a, c, t, g, unknown or other
  misc_feature (213)..(213): n is a, c, g, or t
  modified_base (217)..(217): a, c, t, g, unknown or other
  misc_feature (217)..(217): n is a, c, g, or t
  modified_base (222)..(222): a, c, t, g, unknown or other
  misc_feature (222)..(222): n is a, c, g, or t
  modified_base (232)..(232): a, c, t, g, unknown or other
  misc_feature (232)..(232): n is a, c, g, or t
  modified_base (234)..(234): a, c, t, g, unknown or other
  misc_feature (234)..(234): n is a, c, g, or t
  modified_base (236)..(236): a, c, t, g, unknown or other
  misc_feature (236)..(236): n is a, c, g, or t
  modified_base (256)..(256): a, c, t, g, unknown or other
  misc_feature (256)..(256): n is a, c, g, or t
  modified_base (259)..(259): a, c, t, g, unknown or other
  misc_feature (259)..(259): n is a, c, g, or t
  modified_base (261)..(261): a, c, t, g, unknown or other
  misc_feature (261)..(261): n is a, c, g, or t
  modified_base (263)..(264): a, c, t, g, unknown or other
  misc_feature (263)..(264): n is a, c, g, or t
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (283)..(283): a, c, t, g, unknown or other
  misc_feature (283)..(283): n is a, c, g, or t
  modified_base (288)..(288): a, c, t, g, unknown or other
  misc_feature (288)..(288): n is a, c, g, or t
  modified_base (290)..(290): a, c, t, g, unknown or other
  misc_feature (290)..(290): n is a, c, g, or t
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
  modified_base (296)..(296): a, c, t, g, unknown or other
  misc_feature (296)..(296): n is a, c, g, or t
  modified_base (302)..(302): a, c, t, g, unknown or other
  misc_feature (302)..(302): n is a, c, g, or t
  modified_base (309)..(309): a, c, t, g, unknown or other
  misc_feature (309)..(309): n is a, c, g, or t
  modified_base (312)..(312): a, c, t, g, unknown or other
  misc_feature (312)..(312): n is a, c, g, or t
  modified_base (314)..(314): a, c, t, g, unknown or other
  misc_feature (314)..(314): n is a, c, g, or t
tcagcgcagtacgacacgaccggtgctcgatttagctagtcactcaagggaaagggggagaggagcccagcactagaagtcggcggtgtttccattcggtgatcagcactgaacacagaggactcaccatggagttttgggctgagcggtgtttcgcgtaggcgtacttaagaggtncngngangngngngngngngngngnggngngngngngcgngcgcngcgctctcgngngngcgcgcgcgtatcgctctgngtntntnntgcgngngcgcgcgacgcncgcgngngngngngtgtgngtagtangtntntagagagagtaagtagtagtagtagtagtatacgtacgtacgtacgtacgacgtacgtacgtacgtagacgtacgaacgacgtaacgtaacgaacgaacgaacgtacgtaacgtagttacgttaacgtaacgtaacgtaacgtaaacgtaaccggtacgacgtacggtcgtacgtacgacggacgtacggtcggttacggtagttacgtaacgttacgttacgtacgtaacgttacgtacgtaacggtacgacggtaccg

SEQ ID NO: 49429 - DNA, 874 bp, Homo sapiens
  misc_feature: GYAE6OF02IBJV4.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagtctggtggagtcgtgggggagtcgtggtccagtccgtgggacgtccctgagactccgtcctgtgcacggcctcgtggacttccacctttcgagttgtacctatagacctagtcgtaccgtacggtcggggtcccgaccgacggtcctccggagggcggaacgggggtcctggggtagggttcggggtggtacgtacggtttaatagtaacgtatttagacggtaagttagggtaaaaagttaaaggtaatttaaacgttaaccgtttaagtccggtaccgtaacgttaccccggtttaccgggttaacgggaaacgggggtaccccgttaaacgtttacccgtaaaccctttaacgtttaccccgaaaggtaaccggaaacccgtaaaccgttaacccaaaaaccggtaacccaaccgggttaccgtttaacgggtttttaacgttttacccgaaacgttaaaaacgttacgggtaaaaaccggtaccggtacccggtttaaggaacgggtaacggtacccgttaggggtaccgggaacccggtaacggggttaccgtttaacgggtttacggtttaaccggttttacgttaaccgggtttacggaaacccggtttaaacgtttaaaccggtacccggtaaacggggtacccggggaaacccgtttaacccccgggg

SEQ ID NO: 49430 - DNA, 709 bp, Homo sapiens
  misc_feature: GYAE6OF02H00A4.52.77.G11.1.454.CMB.1.raw
  modified_base (137)..(137): a, c, t, g, unknown or other
  misc_feature (137)..(137): n is a, c, g, or t
  modified_base (207)..(207): a, c, t, g, unknown or other
  misc_feature (207)..(207): n is a, c, g, or t
  modified_base (373)..(373): a, c, t, g, unknown or other
  misc_feature (373)..(373): n is a, c, g, or t
  modified_base (433)..(433): a, c, t, g, unknown or other
  misc_feature (433)..(433): n is a, c, g, or t
tcagcgcagtacgacacgaccggtgctcgatttagctagtcactcaagggaaaggggggagaggagcccagcactacgaagtcggcggtgtttccattcgggtgatcagccactgaacacagaggactcaccatggngtttggctgagcttgggttttcctcgttgctcttttaagaggtgtccagtgtcaggtgcagcgtggtggngtcgtgggggaggcgtggtccagccgtggggacggtcctggagtacctctccgtgtcgcacgtcctcgtgggtacttcacctttcaggtgttacctatcggtaaccagttcgactaccgttgggtaccccgcgacggcctaccggaggtcgaacgggggctagggnggttcggggtcgacgtaggtttaattcgtactagttatggagttaggtaaagtaaacgtnttaaacttaacgttagtgtaacgtacgtaacccgttcggtaaggtaccggggaccgttacgttaccgtaaccttactttaccgaagacgtaacctaaccgttaccgaaacgaaccgtaacgtaccgtagttacgtttagaactaaagtacgtaacaaccggtcctaggtacgaagtaccgtaggaaccggtacgacggtacgttggttacgttaacgttccgtaggttcgtaccgttaacgttacgtaccggaacgggtacgaaccgtaacccggg

SEQ ID NO: 49431 - DNA, 658 bp, Homo sapiens
  misc_feature: GYAE6OF02HA3MI.52.77.G11.1.454.CMB.1.raw
  modified_base (260)..(260): a, c, t, g, unknown or other
  misc_feature (260)..(260): n is a, c, g, or t
  modified_base (303)..(303): a, c, t, g, unknown or other
  misc_feature (303)..(303): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggaggtccctgagactctcctgtgcagcctntggattcaccttcagtgtctatgacatgcctacgtcgggtccnccgagggcctaccgagggccgaagggggtcctgggaggtggggtcgcgtaagttactactcaagttactgaagtagggaaaagtaacgtattaataactagtacgacaagtaccgttccggtaggaaacgggtccgtaacttaccgtaacctactttaccgaagtaacgtacaaaccgttacgaaacgaaaccgtacgtacgttagtaactttaggaactaaagttcgaaactagtacccgtagaacgtacgtcgtaggacggaccgtacggccgttaggtagttacgtttacgtacggttacgaaccggttaaacttaaccgtaccgggaacgtacgggtaaccgtaacccggg

SEQ ID NO: 49432 - DNA, 652 bp, Homo sapiens
  misc_feature: GYAE6OF02FUC4X.52.77.G11.1.454.CMB.1.raw
  modified_base (318)..(318): a, c, t, g, unknown or other
  misc_feature (318)..(318): n is a, c, g, or t
  modified_base (366)..(366): a, c, t, g, unknown or other
  misc_feature (366)..(366): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatgggagtttgggctgagctgggttttcctcgttgctcttttaagaggtgtccagtgtcaggtgcagctggtggagtcgtgggggagcgtggtccaggcctggggacgtccctgagactctccgtgtggcagcctctggacttcaccttcgagttcgttctatggacctatgctacgtcggggtcccnccaggtcctcgagggcaacggggcttgggaggtcgggtgctaagttanactacatatgagtaggaagtaagtatatactagtcgacagtacgtcgtaggaacgggtctacttcaccttattaccgagtaaccgactaacctaccgaaagaactccggacttacgttaactttaggaacctaaagttcggaaaaccacggtaccgttaggaacgtacggaccggtaggtaacgggacccgtagggtacgttcgggttattaacggttacgttagggttaccgtaccgttaaaccgttaaaggtcccgtaacggggtaccgaacgtaaccccgggg

SEQ ID NO: 49433 - DNA, 691 bp, Homo sapiens
  misc_feature: GYAE6OF02HTWI7.52.77.G11.1.454.CMB.1.raw
  modified_base (273)..(273): a, c, t, g, unknown or other
  misc_feature (273)..(273): n is a, c, g, or t
  modified_base (305)..(305): a, c, t, g, unknown or other
  misc_feature (305)..(305): n is a, c, g, or t
  modified_base (309)..(309): a, c, t, g, unknown or other
  misc_feature (309)..(309): n is a, c, g, or t
  modified_base (330)..(330): a, c, t, g, unknown or other
  misc_feature (330)..(330): n is a, c, g, or t
  modified_base (378)..(378): a, c, t, g, unknown or other
  misc_feature (378)..(378): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcggttgctctttttaagaggtgtccaggtgtcaggtgctagcgtgggtggagtcgtggggggagcggtggtccaggccgtggggacggttccctgagacctctcctggtcgcncgcctcgtaggtctctaccttcagtgtcttangacngtagccgtagtcggggtcccnccggacggcctacgaggacggaaggggtccgttagggagggttcgggnggtacgtaaggtttaatacgtacgtaatagtcggagttaagggaaaggtaagattaacgttatagtgaccgtaacggtaccgtaccgggtagggacgggtaccgtaacgttaccgaaccgttacctttaccgacgacgtaaacaaccgttaaccgaaacgacgaccgtacgttacgtatttagaactaagacgacgaacggtctaggaggatacgagggcggacttccgggtacgttaggtacgtttacttacgtaggttccggaacttacggttaccgaaccggtacggtaccggggtaacgtaaccccggg

SEQ ID NO: 49434 - DNA, 852 bp, Homo sapiens
  misc_feature: GYAE6OF02H5K22.52.77.G11.1.454.CMB.1.raw
  modified_base (178)..(178): a, c, t, g, unknown or other
  misc_feature (178)..(178): n is a, c, g, or t
  modified_base (196)..(196): a, c, t, g, unknown or other
  misc_feature (196)..(196): n is a, c, g, or t
tcagcgcagtacgacacgaccggtgctcgatttagctagtcactcaaggggaaagggggggagaggagcccagcactaggaagtcggcggtgtttccattcggtgatcagcactgaacacagaggactcaccatggagtttgggctgagctgggttttcctcgttgcttcttttaagnggtgtccagtgtcaggtncagctgggtggagtcgtgggggaggcgtggtccagccgtggggacgtccctggacgtacctcgtcctgtcgacgacgccttcgtggtacttcacccgtttcgaagtcggtacctagtacgacactcggactaccgtcggggtccccaccgtaggcccttaccgacggggccggaaacggggggtcctaagggggtacgggttacggggggtggtaaccgttagggtttaactaagttccgaaagtttacggtgggtaacgtaaggggtaaagttaaacgagtttaacttaacttacgtcggaccgaagggttaacccgttccgggtaacggaaaccgggggtccgtaaacgtttacccgaaccgttacggtttacccgaaggaaaccgaacccgttaaacgaacccgtaaaacgggtaacccaaccggttacgttaacgtttaacgttttacggaaacctttaaaacgttacggaaaaccgtacgtaccgtaacgggtaaacggaacgggttactagggtaaccgaccgggtaacccggggtaccgtttaaggggttaccgttttaacggttaaccggttagggttaacgtaaccggttaacggtttaaacgtaccgggtaaaccggggttacccggaaacggttaacccccgggg

SEQ ID NO: 49435 - DNA, 680 bp, Homo sapiens
  misc_feature: GYAE6OF02IVS7B.52.77.G11.1.454.CMB.1.raw
  modified_base (291)..(291): a, c, t, g, unknown or other
  misc_feature (291)..(291): n is a, c, g, or t
  modified_base (308)..(308): a, c, t, g, unknown or other
  misc_feature (308)..(308): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgcttcgttttaagaggtgtccagtgtcaggtgcagctggtggagtcgtgggggagcgtggtccagcctgggacgtcctgacgctctctgtgcagcctgtaggacttcaccttcagtgtctagtgacntgacacggtcgggtccnccgaggccttaccgagggcctaagggggtctggggagttcggggtacgctaagttagtactcgaagtttaggtgaattaggggtaaaataaagtaagttaactacgttatcgggaactaacggtcgttaccggtaagggaaccggtacgttactacaccttacgttaccgaagtaaccgactaaaccgtaccgtaaacgaaccgtcgtaccgttagtttaacgttcgaaccgtaaattacgaacgactaccgtaggaacgtacggtacggtaggaacggaccgtacggtacggttgttaacgtttacgttaacgtcggttacgaacgtttaacgtaacgtacggtaaccgggtacgtaacccgggtacccgg

SEQ ID NO: 49436 - DNA, 567 bp, Homo sapiens
  misc_feature: GYAE6OF02GT5CF.52.77.G11.1.454.CMB.1.raw
  modified_base (246)..(246): a, c, t, g, unknown or other
  misc_feature (246)..(246): n is a, c, g, or t
  modified_base (302)..(302): a, c, t, g, unknown or other
  misc_feature (302)..(302): n is a, c, g, or t
  modified_base (336)..(336): a, c, t, g, unknown or other
  misc_feature (336)..(336): n is a, c, g, or t
  modified_base (347)..(347): a, c, t, g, unknown or other
  misc_feature (347)..(347): n is a, c, g, or t
  modified_base (484)..(484): a, c, t, g, unknown or other
  misc_feature (484)..(484): n is a, c, g, or t
  modified_base (509)..(509): a, c, t, g, unknown or other
  misc_feature (509)..(509): n is a, c, g, or t
tcagcgcagtacgacacgaccggtgctcgatttagctagtcactcaagggaaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgagtctgggggagcgtggtccagcctgggagtccctgagctctccngtgcagcctgtggattccgaccttcgagttgtctatgacagtgcacgtgggtcccnccaggcctccgaggcgaaggggctgggagtgggngcgagtatacncagtatgagtaggaagtacgattatactatgactagctcgtaggaacggcctagtcacctactttcgagtacgaccaacttacaaacgaaccacgtcgtagttattgaacgaaatacgaacgagtcgtagtaacggngacgcgacggacgacggtacgtgtnttaacgtacgtagtacggacttaacgttacgtaccgtacggacggaacgtaacccggg

SEQ ID NO: 49437 - DNA, 684 bp, Homo sapiens
  misc_feature: GYAE6OF02JZGPT.52.77.G11.1.454.CMB.1.raw
  modified_base (165)..(165): a, c, t, g, unknown or other
  misc_feature (165)..(165): n is a, c, g, or t
  modified_base (205)..(205): a, c, t, g, unknown or other
  misc_feature (205)..(205): n is a, c, g, or t
  modified_base (210)..(210): a, c, t, g, unknown or other
  misc_feature (210)..(210): n is a, c, g, or t
  modified_base (219)..(219): a, c, t, g, unknown or other
  misc_feature (219)..(219): n is a, c, g, or t
  modified_base (249)..(249): a, c, t, g, unknown or other
  misc_feature (249)..(249): n is a, c, g, or t
  modified_base (273)..(273): a, c, t, g, unknown or other
  misc_feature (273)..(273): n is a, c, g, or t
  modified_base (325)..(325): a, c, t, g, unknown or other
  misc_feature (325)..(325): n is a, c, g, or t
  modified_base (369)..(369): a, c, t, g, unknown or other
  misc_feature (369)..(369): n is a, c, g, or t
  modified_base (429)..(429): a, c, t, g, unknown or other
  misc_feature (429)..(429): n is a, c, g, or t
  modified_base (437)..(437): a, c, t, g, unknown or other
  misc_feature (437)..(437): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcgtggtttctcgtagctntttaagaggtgtccagtgtcaggtgcagctggtgagtcgnggggngcgtggtcngccgtggaggtccctgagactctctgtgcncgccttcgtggacttcctaccttntaggtgtacctatcggatactgtcctacggtgggtaccccgccagggttccnccggaacgggtcgaaacgggggtccgttagggacgggttggggngtaccggttatttaaactgtctaaaggtcttaggaattggaaacggtaatacttaaagtntaagtcgngaaacgtccgtacggtacggacggacgtactacccgtattaaccgttaccgtaagtaaccgaacgtaacctaaccgaaaacgaaccgaccgtacgttacgtaacgtttagtaaccgtaaacagtaaccgtacgacgtaactacggtacgacgtacgaagtaccgacggtacggtacgttaccgttagttaacccgtgttacgacgttaacgtaaccttacggtaacggtacggaacccgtaaccggg

SEQ ID NO: 49438 - DNA, 731 bp, Homo sapiens
  misc_feature: GYAE6OF02IAZLV.52.77.G11.1.454.CMB.1.raw
  modified_base (385)..(385): a, c, t, g, unknown or other
  misc_feature (385)..(385): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgagtcgtgggggagcgtggtccagccgtgggacgtccctgacgactctctgtgcagcctctggattcaccttcagtgtctagtgacagtgcaccgtggggtccccgccgagggccttaccgagggcgaaagggggtctgggggacggttgggggtcggactaggtttaactagtcgtaagttanaggtagtagggtaaaaggttaacgattaacgttaacgtagtacggacctaaggtaccgttaccggtagggtaaacggggtacccgtaacgttacctaaccgttactttacccggaaaggtacggaaacctaaaccctaccgaaaacggaacctaccggtacctttagggttaattttacggaactaaaacggttcgaaaaccgtcgtacccgtaagggacggtaacgacgttacggaacgggacccgtaaccgggtcgttaacggttaggttacttaacgttcggtaacgtccggttaaaactttaacgaccggtaacgggtaacggacccggttaaaccccgggg

SEQ ID NO: 49439 - DNA, 492 bp, Homo sapiens
  misc_feature: GYAE6OF02G75ZS.52.77.G11.1.454.CMB.1.raw
  modified_base (150)..(150): a, c, t, g, unknown or other
  misc_feature (150)..(150): n is a, c, g, or t
  modified_base (454)..(454): a, c, t, g, unknown or other
  misc_feature (454)..(454): n is a, c, g, or t
  modified_base (456)..(492): a, c, t, g, unknown or other
  misc_feature (456)..(492): n is a, c, g, or t
tcagcgcagtacgacacgaccggtgctcgatttagctagtcactcaagggaaagggcccgattcaccatttccagagacaactccaagaacacgctgtatttgcaaatgaacagcctgagagctgaggacacggctgtgtattactgtgngaacttatcacggaggacaacggtgaccccccgtccgctcggtgccggacgtcgtggggccaagggccacggtcagcgtctcctcacgccctccaaccgaacgggcccctagtccggtccctccccccgtggcccacccctccctcccaaagcgacctacctcggtcggggggaccaccgacggccggtccccgtgggcctcggccctttcgggcgaaaccggtaccttaccgtttccctaagtaccgacttccggcctggacggccgggtacgtcgggacgaacggggccgacgtaggacgcngnnnnnnnnnnnnnnnnnnnnnnnnnnnnnnnnnnnnn

SEQ ID NO: 49440 - DNA, 517 bp, Homo sapiens
  misc_feature: GYAE6OF02HJVYI.52.77.G11.1.454.CMB.1.raw
  modified_base (159)..(159): a, c, t, g, unknown or other
  misc_feature (159)..(159): n is a, c, g, or t
  modified_base (376)..(376): a, c, t, g, unknown or other
  misc_feature (376)..(376): n is a, c, g, or t
  modified_base (403)..(403): a, c, t, g, unknown or other
  misc_feature (403)..(403): n is a, c, g, or t
  modified_base (440)..(440): a, c, t, g, unknown or other
  misc_feature (440)..(440): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttccncgttgctcttttaagaggtgtccagtgtcaggtgcagctggtggagtctgggggagcgtggtccagcctgggaggtcccctgagactctcctgtgcagcctctggattcaccgttcagtgtctatgacatgcaactgggtccgccaggcctccaggcaaggggctggatgggtgcagttatagtcatatggatgggaataagatatacatgcagacnccgtgaaggccagttcaccatttccanagacaactccaaagaacaacgctgtatttgacaaatnaaacagcctgacgagctgaggacaacggctgtgtattacgtagtggcgtaaccttactacgacggtacgacaacggg

SEQ ID NO: 49441 - DNA, 741 bp, Homo sapiens
  misc_feature: GYAE6OF02JG5TX.52.77.G11.1.454.CMB.1.raw
tcagcgcagtacgacacgaccggtgctcgatttagctagtcactcaagggaaacgggggggagaggagcccagcactagaagtcggcggtgtttccattcggtgatcagcactgaacacagaggactccaccatggacgtttgggctgagctgggttttcctcgttgctcttttaagaggtgtccagtgtcaaggtgcagctggtggagtcgtggggaggcgtggtcagcctgggagtcctgacgactctcctgtgcacgcctcgtaggtacttccgaccgtttccgaggttcgttacctagtcgaactcgtctccgtacgtcggggtccccaccgaggtccgtcccgtaagggccggtaacgggggtccttaggggaagggttcggggtacggaccgtaacggttaacctaacgtctaagttaatcggtaagtacgggtaaaacgttaaaggtctaacttacgttaacgtcgtaccgtaacgtacttaccgggttagggaaacgggttccgtaacttacctaaccgtacctttaccgaagaccgtaactaaccgttacccgaaagaacccgtagtacttacggttacttaacgactaaaccgtagtaaccgtaaccgtccgtaagtaacgacggtaccagggtaaccgaccgaacggccggttagttagttaacttaccggtaggttaccgacttaaccggttccttaaacggaccggtaacggtacccgttaacccggg

SEQ ID NO: 49442 - DNA, 699 bp, Homo sapiens
  misc_feature: GYAE6OF02IWVRQ.52.77.G11.1.454.CMB.1.raw
  modified_base (193)..(193): a, c, t, g, unknown or other
  misc_feature (193)..(193): n is a, c, g, or t
  modified_base (251)..(251): a, c, t, g, unknown or other
  misc_feature (251)..(251): n is a, c, g, or t
  modified_base (283)..(283): a, c, t, g, unknown or other
  misc_feature (283)..(283): n is a, c, g, or t
  modified_base (317)..(317): a, c, t, g, unknown or other
  misc_feature (317)..(317): n is a, c, g, or t
  modified_base (669)..(669): a, c, t, g, unknown or other
  misc_feature (669)..(669): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctacgttgctcttttaagaggtgtccagtgcaggtncagctggtgagtcgtgggggagtcgtggtccaggccgtgggagtccctgagctctccngtgacacgcctcgtggattcaccttgacgttntctagtcggactatcggaccctaggtcgggtccncgaggcctaccggaggccggaaggggtcctagggacggttgggtcggagtacgtttatactactatacgttcggtaagttacgggtaaaaggtaggaaatttacttaaccgttaggtaccgaccgtaagtaccccttaccgggttaggaaccggggtaccgtacttttacccgaaccgttacgtttacccggaaggtaaccgtaacctaaccgttaaccgaaacgtaaccgtcggtaccttagttaacgttacaacgtaactacggaactacggccttagacgtgtacgacggacggtacacgggtatcggtttacgtacgttacgttagtaaccgttacgtaacgttaacnccggaacggtaccggaacgtaaccccgggg

SEQ ID NO: 49443 - DNA, 569 bp, Homo sapiens
  misc_feature: GYAE6OF02G794I.52.77.G11.1.454.CMB.1.raw
  modified_base (163)..(163): a, c, t, g, unknown or other
  misc_feature (163)..(163): n is a, c, g, or t
  modified_base (210)..(210): a, c, t, g, unknown or other
  misc_feature (210)..(210): n is a, c, g, or t
  modified_base (503)..(503): a, c, t, g, unknown or other
  misc_feature (503)..(503): n is a, c, g, or t
  modified_base (516)..(516): a, c, t, g, unknown or other
  misc_feature (516)..(516): n is a, c, g, or t
  modified_base (519)..(521): a, c, t, g, unknown or other
  misc_feature (519)..(521): n is a, c, g, or t
  modified_base (523)..(531): a, c, t, g, unknown or other
  misc_feature (523)..(531): n is a, c, g, or t
  modified_base (533)..(569): a, c, t, g, unknown or other
  misc_feature (533)..(569): n is a, c, g, or t
tcagcgcagtacgacacgaccggtgctcgatttagctagtcactcaaagggaaagggccgattcaccatttccagagacaactccaagaacacgctgtatttgcaaatgaacagcctgagagctgaggacacggctgtgtattacgtgtgacgtaaacttaancgacggaggacaacggtcgacccccgtcgcgtcggtgcggacgtcgngggccaagggccacggtcagcgtcctcctcgacgccctaccaaccgaacgggcccctagtccggttacccttccccccgtggacccctaacccccgtccttacccgaaaggccgtacctaacccgtggttacggggggccaaccggaggccccgggtccctgggggtccctacggtcccgtggtaaccgaaacgggtacctttacctttacccgtagtaacccggtattacccggccgttaggaacggggtccggtcgtacggaccgaaacgggtcgaccgtaaagtcggctncgagctgcatcgngannncnnnnnnnnncnnnnnnnnnnnnnnnnnnnnnnnnnnnnnnnnnnnnn

SEQ ID NO: 49444 - DNA, 694 bp, Homo sapiens
  misc_feature: GYAE6OF02FM6UW.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagcgtggtggagtcgtgggggagcgtggtccagccgtgggacgtccctgacgactctcctggtgcagcctgtggacttcaccttgagttgtctagtgactatcggctacgtcgggtcccacgtacggcctccgaagggcgaacgggggcgtagggacgggttggggtacggactaggttttaactacgttactaagttagtaggagttaagggtaaaagtaaagtataaccgttaaagtcgtgacgtaagtacccgttccggtaggaacgggtccgtaagttaccaaccgttacgttaccgaagaacgacctaacctaaccgaaacgaaccacgtacgttagtacgttagaacctaagtacgaacgacgtaccgtaagacggacgacggttacggaacggtaccgtacggtacgttcggttacgttaacgtttacgtacggttacgtaaccgttaaggttaaccgtccggaaacggtacccgggtaggtaacccccggg

SEQ ID NO: 49445 - DNA, 795 bp, Homo sapiens
  misc_feature: GYAE6OF02H6TVX.52.77.G11.1.454.CMB.1.raw
  modified_base (201)..(201): a, c, t, g, unknown or other
  misc_feature (201)..(201): n is a, c, g, or t
  modified_base (538)..(538): a, c, t, g, unknown or other
  misc_feature (538)..(538): n is a, c, g, or t
tcagcgcagtacgacacgaccggtgctcgatttagctagtcactcaaggggaaagggggggagaggagcccagcactagaagtcggcggtgtttccattcggtgatcagcactgaacacagaggactcaccatggagtttgggctgagcgttgggttttcctgttgtcttcgttttaaggaggttgtccagtgtcgaggtnacagtcgtggtggtagtcggtgggggacgtcggttggtccgaggtccggtaggggaccggttcccgtaggtaacgtaccttccgttccgtggtcgaccgtacggtccccgttagtacggttacctttaccccgtaccgtttaccggtaaggttccgttacgttaaacgtcggtaaacctaggttccggacccgttaccggttccgggtaccccgacccggaggtccctaccggacgggacgggtaagggggtctagggggtcggtacggggtgtaccgttagttaagtaacgtcgtaaatagtacgagtaaagggttaaacagttactaagttacgngtacgtaactacggtacgtacggtacggtacggtacgtacgtacctaaccgttacgtacgaacgtaacgtaacctaaccgtaacgaaacgtaacgtaccgtacgtacgttacgttaacgttaacgtaacgtaacgtaacgacgtaccgtacgtacgacgacgtacggacgaccgtacgtacggacgtttttttacgagttacgttacgtacgtacgtaacgtaccgtaacggtacggtaccggtacggtaacccggg

SEQ ID NO: 49446 - DNA, 675 bp, Homo sapiens
  misc_feature: GYAE6OF02JC45J.52.77.G11.1.454.CMB.1.raw
  modified_base (233)..(233): a, c, t, g, unknown or other
  misc_feature (233)..(233): n is a, c, g, or t
  modified_base (310)..(310): a, c, t, g, unknown or other
  misc_feature (310)..(310): n is a, c, g, or t
tcagcgcagtacgacacgaccggtgctcgatttagctagtcactcaagggaaaggggggagaggagcccagcactagaagtcggcggtgtttccattcggtgatcagcactgaacacagaggactcaccatggagtttgggctagagtctgggttttcctcgttgcttcttttaagaggtcgtccagtgtcaggtgcagcgtggtgagtcgtggggagcgtggtccagtccgngggtacgtccctgacggtactcgtccgtgtcgcacgtcctctaggtcgttccaccttcgagtcgtctagtcgaactntcgtacaccggtcgggtacccgtcgaaccggtcctaccggaccggaggaacggggttcgtaggggacgttggggtacggtaaccgtagttacgttacgtacgtaagttagtagtagtaacgggtaaaagttagaacttaagtacgttagtcgacgtaacggtcgtaccggtacggaacggtacgtactactacttacgtacacggtaacgacctaactacgtaaacgtaacgacgtacgtactacgtttacgaactaagaccgtaagacctagtacgaagacgacgtacgagacgtaagtcgtaagtacgtacgtacgtgtacgtacgtaacgttacgacggtaaccgacggtaccgtaacccgg

SEQ ID NO: 49447 - DNA, 714 bp, Homo sapiens
  misc_feature: GYAE6OF02IFD86.52.77.G11.1.454.CMB.1.raw
  modified_base (270)..(270): a, c, t, g, unknown or other
  misc_feature (270)..(270): n is a, c, g, or t
tcagcgcagtacgacacgaccggtgctcgatttagctagtcactcaagggaaagggggggagaggagcccagcactagaagtcggcggtgtttccattcggtgatcagcactgaacacagagactcaccatggagtttgggctgagctgggttttcctcgttgcttcttttaagaggtgtccagtgtcaggtgcagctgggtggagtcgtgggggagcggtggtccagccgtggggacgtcctggacgtactctccgtgtgcacgtcctntggatttccaccttcagttcgtactagtgactagtgacgaccgttcggggtcccaccggtaggccctccgagggcggaaagggggtctacggggaggttcggggtcgctaaggttacagtcaatagtaggaagttagggaaaagttaagtacttaataacgtatacggactaacggtacgtccggtagggaaccgggtaccgtaatacccgtaacctacgtttacccgaacggaacgtaaacccaaaccgttaacccaaacggaaacctaaccgttacgttaggtttaactttacgaaacgtaaagttaacggaaaccgtacggtaaccgtggaacggagtaaccgtaggaccggtacggtacggtaacgttaggtacgtttacgttacgttggtacgtacgtaaactttaacggacggtaacgggtacggaccgtaacccggg

SEQ ID NO: 49448 - DNA, 788 bp, Homo sapiens
  misc_feature: GYAE6OF02I2DCE.52.77.G11.1.454.CMB.1.raw
  modified_base (179)..(179): a, c, t, g, unknown or other
  misc_feature (179)..(179): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagtctgggttttcctcgttgcttcttttaaaggnggtcgtccagtgtcagggtgcagcgtgggtggagtcggtggggggagcggtggtccagccgtggggacggtccctggacgtctctccgtgtcgccacggtccttacgtggtacttcccgacctttgacgttgtacctatcgaactgtacgccgtacggtcgggtcccaccgacggtcctaccggagggaccggaacggggtcgtaggggaggttggggtacgggattaagttaactacgtacgtaagttagtacggaagttaagggtaaaaggtaaccgttaattaacgtaactacgtacgaacggtacgttaaccggtaccgggtaacgggaaccgggtaccgtaccgttacccgtaaccgtttacgtttaacccgaacggtaaaccgtaaacctaaccgtaaaccgtaaaccgaacctaacccggtattacgttaagttacgaaacgtaaacttacgaaccgtaaccgcgtacggtaaacgacgtacggtaaggaccggtaaccgtcgggtaacgttcggttaacgttacgttaccggttaggtaccgtaaccggttaacgttaaccggtaccggaaaccgggtaccgggaacccgtaaccccgggg

SEQ ID NO: 49449 - DNA, 607 bp, Homo sapiens
  misc_feature: GYAE6OF02IW1YY.52.77.G11.1.454.CMB.1.raw
  modified_base (477)..(477): a, c, t, g, unknown or other
  misc_feature (477)..(477): n is a, c, g, or t
  modified_base (505)..(505): a, c, t, g, unknown or other
  misc_feature (505)..(505): n is a, c, g, or t
  modified_base (511)..(511): a, c, t, g, unknown or other
  misc_feature (511)..(511): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagcttggtggagtcgtgggggaggcgtggtccagccgtgggacgtccctgacgactcgtcctgtcgcacgcctgtggtattccaccttcgagttcgttactatacgacagtcgcacgtcggggtcccacgacggcctccggaggccgaaggggcgtgggacggttgggtggcgtaaggttacttacgtctaagtacgtggtaagtagggtaaagtaaagtattaagtaactagtgacagtacgtcggtagacgggctattccactattcagacacactacaanacacgtctgtattcgacaaagtcgaacncgtacngaagacgtacgtaggacgacgtacgtcgtaggttagttagtacgtaggttacgtacgtaacgtttaagacgaacggggtaacgacggtaacccggg

SEQ ID NO: 49450 - DNA, 705 bp, Homo sapiens
  misc_feature: GYAE6OF02H787F.52.77.G11.1.454.CMB.1.raw
  modified_base (159)..(159): a, c, t, g, unknown or other
  misc_feature (159)..(159): n is a, c, g, or t
  modified_base (186)..(186): a, c, t, g, unknown or other
  misc_feature (186)..(186): n is a, c, g, or t
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (216)..(216): a, c, t, g, unknown or other
  misc_feature (216)..(216): n is a, c, g, or t
  modified_base (245)..(245): a, c, t, g, unknown or other
  misc_feature (245)..(245): n is a, c, g, or t
  modified_base (273)..(273): a, c, t, g, unknown or other
  misc_feature (273)..(273): n is a, c, g, or t
  modified_base (301)..(301): a, c, t, g, unknown or other
  misc_feature (301)..(301): n is a, c, g, or t
  modified_base (333)..(333): a, c, t, g, unknown or other
  misc_feature (333)..(333): n is a, c, g, or t
tcagcgcagtacgacacgaccggtgctcgatttagctagtcactcaagggaaaggggggagaggagcccagcactagaagtcggcggtgtttccattcggtgatcagcactgaacacagaggactcaccatggagtttgggctgagcttgggttttccngttgcttcgtttaagaggtgtccagtntcgaggtgcngctggtggngtcggtggggngcgtcggtccaggccgtgggacggtcccnggacgctctaccgtgtcgcacgtcctgnggtacttccacttcgagtcgtaccttancgaactgtcacgaccggttgggcccgtaccgngtccgtaccaggaacggtaacggggtccttggggaacggtttcggggcggtaactagtttagaactacgttaagttcgtaggtactaagggtaaaaggtaatcgttaaatacgtagtcgtacgaacggtcccgtacggtaggtaccgggtaccgtacgtcctaaccttagttaaccgtacgtaacgtactaacccttaaccgaaacgtacgtaccgtaacgttgttaacttcgaaactaacgtagtaacgtcgtaacgtagaacgttacggagttacgacggtacggacggttacgtcggttacgttacgtacgttacgacggtacgttaacgttaaccgacggtacgggtaaccggtacggtaaccccggg

SEQ ID NO: 49451 - DNA, 476 bp, Homo sapiens
  misc_feature: GYAE6OF02IJENU.52.77.G11.1.454.CMB.1.raw
  modified_base (207)..(207): a, c, t, g, unknown or other
  misc_feature (207)..(207): n is a, c, g, or t
  modified_base (226)..(226): a, c, t, g, unknown or other
  misc_feature (226)..(226): n is a, c, g, or t
  modified_base (235)..(235): a, c, t, g, unknown or other
  misc_feature (235)..(235): n is a, c, g, or t
  modified_base (291)..(291): a, c, t, g, unknown or other
  misc_feature (291)..(291): n is a, c, g, or t
  modified_base (418)..(418): a, c, t, g, unknown or other
  misc_feature (418)..(418): n is a, c, g, or t
  modified_base (422)..(422): a, c, t, g, unknown or other
  misc_feature (422)..(422): n is a, c, g, or t
  modified_base (426)..(476): a, c, t, g, unknown or other
  misc_feature (426)..(476): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtatactgtgcgtaacttaatcaacgggaggaacaacggtcgaccccccgtcgcgtcggtgcggacgtgngggccaaagggacacggtnagcgtctcnctagcctcacgaacgggccagtccgtcctccccctgaccaccctcctacgaaagcncctacctacggtcggggacacgaggtccggcccgtgggctcgccgtggtaccaaaggccttaacttccgaatacgaacttccgacgtggaaggtccgggacgttggaacgaggccggaatagtaagnactnacgnnnnnnnnnnnnnnnnnnnnnnnnnnnnnnnnnnnnnnnnnnnnnnnnnnn

SEQ ID NO: 49452 - DNA, 767 bp, Homo sapiens
  misc_feature: GYAE6OF02F4D1W.52.77.G11.1.454.CMB.1.raw
  modified_base (177)..(177): a, c, t, g, unknown or other
  misc_feature (177)..(177): n is a, c, g, or t
  modified_base (252)..(252): a, c, t, g, unknown or other
  misc_feature (252)..(252): n is a, c, g, or t
  modified_base (470)..(470): a, c, t, g, unknown or other
  misc_feature (470)..(470): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgcttcttttaagnggtgtccagtgtcaggtgcagcgtggtggagtcgtgggggaggtcggtggtccagccgtggggacggttccccgnggacgaccttccgtcctggtcgcacgtcccgttcgtggtacttcctaccgtttcgagttcgtactagtcgactagtcggacctacggtcggggtccccgaccgacggtcctccggaggaccggaaggggtctgggtacgggtggggtacgacgtaaggtttactaactcgaagttagtggtaagttaggaaaacggttaaagacttaataacggttangtacctaacggtccgttacggtaacgggaacggtaccgtacgttacgaacccttaattaccgaacgtaacgtaacctaacgtaaccgaaagtaaccgtacgtacgtacgttaagtttaacgaactaaagtacgaaacgtacgtacctaggaacgtacggtacgtaggaaacccggtacgtaaccggtacggtttaacgggttaacgtttaaccggtttaccgttagggtaaccggttaacgttaaacggttaaccgtaccggtaaaccgggttaaccggaaacccggtaaccccggg

SEQ ID NO: 49453 - DNA, 825 bp, Homo sapiens
  misc_feature: GYAE6OF02IDPXE.52.77.G11.1.454.CMB.1.raw
  modified_base (193)..(193): a, c, t, g, unknown or other
  misc_feature (193)..(193): n is a, c, g, or t
  modified_base (259)..(259): a, c, t, g, unknown or other
  misc_feature (259)..(259): n is a, c, g, or t
  modified_base (263)..(263): a, c, t, g, unknown or other
  misc_feature (263)..(263): n is a, c, g, or t
tcagcgcagtacgacacgaccggtgctcgatttagctagtcactcaagggaaagggggggagaggagcccagcactagaagtcggcgtgtttccattcggtgatcagcactgaacacagaggactcaccatggagtttgggctgagcttgggtttcctcgttgcttcttttaagaggtgtccagtgtcaggtncagctggtgagtcgtgggggagcgtggtccagcccgtgggacgtcctagacgtactccgtctagtnccgngtccctcgtaggtacttccacctttcgaggttcgttactaagtgaacctagtcgactaccggtcggggttcccaccgacggtccttccggaagggccgtaaagggggtcctaggggtacggttggggtacggtaccgttaaggtttactaacgttactaaggttaagtcgggtaaacgttaagggtaaaaacggttaagtaacttaaagttacgtaagttcggtaaaccgtaacgggtaccgtttaccgggtaggtaaaccggggtacccgtaaagtttacccgtaacccgttaacgtttacccgaaacggtaacggttaaaccctaaaccgttaacccgaaacggtaaacccgtaccggttaccttacggtttaaagttaaccggaaccttaaaacgtacgaaaaccgttaccggtacccgtaaggtaacggtaacgtacgtaacgggtaccggtaccgaaccgggttacgtaggtttaacggttaacgttacgtacgttacggtaaccgttaacgtttaacgaaccggttaaccgggtaacggtacccgtaaccccgggg

SEQ ID NO: 49454 - DNA, 646 bp, Homo sapiens
  misc_feature: GYAE6OF02HR1FU.52.77.G11.1.454.CMB.1.raw
  modified_base (308)..(308): a, c, t, g, unknown or other
  misc_feature (308)..(308): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctggggacgtcctgagactctcctgtgcacgcctctggacttcaccttcagtgtctagtgacatgctacgtcggggtcccnccgaggcctccgaggacgaggggtctgggacggtgggtgactagttatacgtcgaattagtgagtagggtaaagtaaggtattaataactatagactaacgtaccgtccggtaaggaaccgggccgttaacttccaaccgttactttaccgaagtaaccaacctaaaccgtaccaaaacgaaccgtaacgtcttagtttaacgttacgaacgtaaagtacgaaacctcggtcctaggagacgtccgtaaggacggacgtacggtacttagggttacgttaattaccgtggtacgttaacgtaacgttacgacggaacggtacggtaacgtaacccggg

SEQ ID NO: 49455 - DNA, 803 bp, Homo sapiens
  misc_feature: GYAE6OF02JVVH9.52.77.G11.1.454.CMB.1.raw
  modified_base (276)..(276): a, c, t, g, unknown or other
  misc_feature (276)..(276): n is a, c, g, or t
  modified_base (281)..(281): a, c, t, g, unknown or other
  misc_feature (281)..(281): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgcttcttttaagaggtgtccagtgtcgaggtgcaggcgtgggtggagtcgtggggggacggcggtcgggtccaggcccgtggggacggtccctaggacgtcctcgtccgtgngtacncggccttcgtggacttcaccttcgagtgtctatggacagtgctagtcggtccgcgacggcctccgagggcgaacggggtcgtgggaacgtcgggggttagacgtagtttaacacgttcgaagtttacgtggaaacgtggtaaaaaggttaataaacgttaatttaacctaaggtacggtaactaccggtaccgttacgggtacggaaacgggtacccgttaacgtaaccgtacccttaggtttacccgaacgtaaacgtaaccgaaaccgttaaccgaaagaacccgtacggtccttaggttaccttacggtaaacgtaaactacgggtaaaattccggtaccgttagggaacgaccggacggtttaacggaaaccgggccgtttaaaccgggggtccgtttacggggttttaacctttaacggttaacccggtttacggtttaacccgggtaaacgttaaccgtttaaacccggttaacccgggggtaaacgtaaccggggttaaccccggtaaaccgggg

SEQ ID NO: 49456 - DNA, 625 bp, Homo sapiens
  misc_feature: GYAE6OF02GC72D.52.77.G11.1.454.CMB.1.raw
  modified_base (173)..(173): a, c, t, g, unknown or other
  misc_feature (173)..(173): n is a, c, g, or t
  modified_base (191)..(191): a, c, t, g, unknown or other
  misc_feature (191)..(191): n is a, c, g, or t
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
  modified_base (308)..(308): a, c, t, g, unknown or other
  misc_feature (308)..(308): n is a, c, g, or t
tcagcgcagtacgacacgaccggtgctcgatttagctagtcactcaagggaaaggggggagaggagcccagcactagaagtcggcggtgtttccattcggtgatcagcactgaacacagaggactcaccatggagtttgggctgagcttgggtttcctcgtgctcttttaagnggtgtccagtgtcaggtncagcgtggtgngtcgtgggggagcgtggtccagcctgggagtccctganctctcgtgtgcagcctcgtggacttcaaccttcagtgtctatcgacagttgcctacggtcgggtcccncgaggcctaccgaggccgaagggggctaggggacggttgggcggtactaggttactaatcgaattaagtggtaagttacgggaaaagtaagtattaagtctaagtggacacgtacctcggtagacggtcctagttccacgtcttacagtacgacacctacgaaacgacctacgtacgttctagttacgataaagtcgtaacgtagacccgttagacggtaacgtacgagtaccgggactcggtacgttggtaccttagtaccgttgtaacggtacctaacggtttaacacgggtacggaccggtaccggtaacccgg

SEQ ID NO: 49457 - DNA, 843 bp, Homo sapiens
  misc_feature: GYAE6OF02F97MZ.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcgtgggttttcctcgttgctacgttttaagaggtgtccagtgtcaggtgcagcgtgggtggagtcggtgggggagcgtggtccagccgtgggacggtcctgacgtactctccgtgcgcacgtcctcgtaggtacttccgtaccttcgtaggttcgttactagtacggaacctagttcgaccgtacgggttccggggtccccaccggtacgggtccctacccgggaacggggtaccggaaacggggggtccgttagggggtaacggggttcgggggttacgtaaccggttaagttttaacgtaattaccgtaagttaagtagtaaaggttagggtaaaacgtaaaggttaacttaaacgttaacgttagtacgaaccgtaagttacccgttaccgggtaacgggtaaaccgggtaccgttaacgttaacccgtaacccgtttaacggttacccgaaaggtaaacccgtaaacctaaacccgttaaaccgaaaacggtacccgtaacgttccgtttaagtttacgtttaacgaaactaaacgttacgaaacgtacgacgttaacggaagtacggtaacgtagggtacggaacgtacgggtcgtttaacggttaacgtttaacgtaggtttcgggtaacgtaacggttaacgttaacggaaccggtaacccgggtaaacgggaacccggtacccccggg

SEQ ID NO: 49458 - DNA, 599 bp, Homo sapiens
  misc_feature: GYAE6OF02I04SS.52.77.G11.1.454.CMB.1.raw
  modified_base (175)..(175): a, c, t, g, unknown or other
  misc_feature (175)..(175): n is a, c, g, or t
  modified_base (307)..(307): a, c, t, g, unknown or other
  misc_feature (307)..(307): n is a, c, g, or t
  modified_base (345)..(345): a, c, t, g, unknown or other
  misc_feature (345)..(345): n is a, c, g, or t
  modified_base (352)..(352): a, c, t, g, unknown or other
  misc_feature (352)..(352): n is a, c, g, or t
  modified_base (361)..(361): a, c, t, g, unknown or other
  misc_feature (361)..(361): n is a, c, g, or t
  modified_base (390)..(390): a, c, t, g, unknown or other
  misc_feature (390)..(390): n is a, c, g, or t
  modified_base (439)..(439): a, c, t, g, unknown or other
  misc_feature (439)..(439): n is a, c, g, or t
  modified_base (483)..(483): a, c, t, g, unknown or other
  misc_feature (483)..(483): n is a, c, g, or t
  modified_base (500)..(500): a, c, t, g, unknown or other
  misc_feature (500)..(500): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagnggtgtccagtgtcaggtgcagctggtggagtcgtgggggagcgtggtccaggccgtgggacggtccctgagactctcctgtgcacgcctctggtattcaccttcagtgtactatgacatgcactggggtccnccgaggcctcgagggcaaggggctgggaggtgggtagntagttanactctaatntggataggaaagtaagaatataactagtnacgagtaccgtcgtagggaacggcctatacactacttaccgatacgaanaacctacaaagaacctacgactggtaattgaacaaatacgaacngtaccctaggagtacgngtaagaggacgccggtagttaggttgttaaacgtttagtggttacggaaccttaacgttaaacgtccggaaacgggttacggaccggttaaacccgggg

SEQ ID NO: 49459 - DNA, 781 bp, Homo sapiens
  misc_feature: GYAE6OF02HV4EY.52.77.G11.1.454.CMB.1.raw
  modified_base (161)..(161): a, c, t, g, unknown or other
  misc_feature (161)..(161): n is a, c, g, or t
  modified_base (177)..(177): a, c, t, g, unknown or other
  misc_feature (177)..(177): n is a, c, g, or t
  modified_base (181)..(181): a, c, t, g, unknown or other
  misc_feature (181)..(181): n is a, c, g, or t
  modified_base (220)..(220): a, c, t, g, unknown or other
  misc_feature (220)..(220): n is a, c, g, or t
  modified_base (342)..(342): a, c, t, g, unknown or other
  misc_feature (342)..(342): n is a, c, g, or t
  modified_base (414)..(414): a, c, t, g, unknown or other
  misc_feature (414)..(414): n is a, c, g, or t
  modified_base (449)..(449): a, c, t, g, unknown or other
  misc_feature (449)..(449): n is a, c, g, or t
  modified_base (471)..(471): a, c, t, g, unknown or other
  misc_feature (471)..(471): n is a, c, g, or t
tcagcgcagtacgacacgaccggtgctcgatttagctagtcactcaagggaaagggggggagaggagcccagcactagaagtcggcggtgtttccattcggtgatcagcactgaacacgagaggactcaccatggagtttgggctgagcttgggttttccncgttgctcttttaagnggtntccagtgtcaggtgcagcgtggtcggagtgtggggggancggtggtccaggccgtggggacgtccctggagacctctcctggtagccagcccttgtaggtacttccgccttcgaggttctactatcgactagttcgacctacgttccggggccccgaccgngggtcccctacggacgacgggaacgggggtcttgggggaacggtgggggttcgacgtagggtttacacttanagtagttggaagtttaggggaaagttaaaccggtnttaaccgttaacctagttacgngtaaccggtacgtcggtaacgggacggtccgtactaccgtaccttaacgttccgaaagtacgtaacctacaaccgtaaacgacgtacgtaacgtttcgaacgttttacgaaaccgtaagttaaccgaaccgttaccggacccgtttaaggacgggttaacgacccggttagggaacccggtaccggaaccggtttcgggtacgttttaaacggttcgtttacccggtttagggtaaccgttaacggttaaacccggttacgttaaaccccgggacgggttaaacccggaacccgggttaaacccccgggg

SEQ ID NO: 49460 - DNA, 822 bp, Homo sapiens
  misc_feature: GYAE6OF02JF641.52.77.G11.1.454.CMB.1.raw
  modified_base (445)..(445): a, c, t, g, unknown or other
  misc_feature (445)..(445): n is a, c, g, or t
  modified_base (498)..(498): a, c, t, g, unknown or other
  misc_feature (498)..(498): n is a, c, g, or t
tcagcgcagtacgacacgaccggtgctcgatttagctagtcactcaagggaaaggggggagaggagcccagcactagaagtcggcggtgtttccattcggtgatcagcactgaacacagagactcaccatggagtttgggctgagcttcgggttttcctcgttgtctacttttaaggaggtcgtcctaggttgtcgaggtgcagcgtgggtggtagtcgtgggggaggccgtcggtaccaggcccgtaggggcggttccccgtggacgtcttcctccgtggtacgccgacgccgttacgtggtaaccttccaccctttgagttcgtaccttatagacctagtccgtacgtccggtcggtccccaaccggtcgtcccgtaccggtaacgggaccgggtaagggggtcgtggggtacgggtgggtacggtaccgtaggtttaacgtnttacgaattggttacggaacgggttaaggtaaaaggtaagtaacgttaacttntaaccgtagtaccgaaggtacccgtacgggtacggaacgggtccgtaacgttacccgtaactttaccgttacccggtaaagaacgtaaaccccgtaaccttaaaccggaaaccgtaaccgtaccgttccgttagtttaaccttacgaaaccgttaagtacggtaaccgcggtaccgttagaggtaacgtacgtaacgggacggtacgtaccggtagtttaaccgggtacgttaagttacggttaacgggtaccgttaaaccggtttaagaacccccggttaaggtaacccggggtaacccggggttaaccggtaacccccgggg

SEQ ID NO: 49461 - DNA, 431 bp, Homo sapiens
  misc_feature: GYAE6OF02IQVLD.52.77.G11.1.454.CMB.1.raw
  modified_base (202)..(202): a, c, t, g, unknown or other
  misc_feature (202)..(202): n is a, c, g, or t
  modified_base (266)..(266): a, c, t, g, unknown or other
  misc_feature (266)..(266): n is a, c, g, or t
  modified_base (288)..(288): a, c, t, g, unknown or other
  misc_feature (288)..(288): n is a, c, g, or t
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
  modified_base (383)..(383): a, c, t, g, unknown or other
  misc_feature (383)..(383): n is a, c, g, or t
  modified_base (385)..(386): a, c, t, g, unknown or other
  misc_feature (385)..(386): n is a, c, g, or t
  modified_base (391)..(391): a, c, t, g, unknown or other
  misc_feature (391)..(391): n is a, c, g, or t
  modified_base (393)..(431): a, c, t, g, unknown or other
  misc_feature (393)..(431): n is a, c, g, or t
tcagcgcagtacgacacgaccggtgctcgatttagctagtcactcaaagggaaagggccgattcaccatttccagagacaactccaagaacacgctgtatttgcaaatgaacagcctgagagctgaggacacggctgtgtattactgtgcgaacttaatcacggaggacaacggtgacccccgtccgctcggtgcggacgtntggggccaagggaccacgggtcagcgtctcctcagcctccaccagggcccatcggtcctccccngcacccctcctccagcgcaccncgtggggcacagccggcccctgggctcgcctcggtcaaggcctacttccactacgatcgctggacggcgggctcggnaacgggcnccgaataggntnnctgcnannnnnnnnnnnnnnnnnnnnnnnnnnnnnnnnnnnnnnn

SEQ ID NO: 49462 - DNA, 668 bp, Homo sapiens
  misc_feature: GYAE6OF02IVIWH.52.77.G11.1.454.CMB.1.raw
  modified_base (103)..(103): a, c, t, g, unknown or other
  misc_feature (103)..(103): n is a, c, g, or t
tcagcgcagtacgacacgaccggtgctcgatttagctagtcactcaagggaaagggggggagaggagcccagcactagaagtcggcggtgtttccattcggtnatcagcactgaacacagaggactcaccatggagtttgggctgagctgggttttcctcgttgctcttttaagaggtgtccagtgtcgaggtgcagctgggtggagtcgtgggggagcgtggtcagccgtgggagtccctgagtactctccgtgtgcacgtcctctggattccgaccttcgagtcgtactagtgacattgcacgtggggtacccgccgaggcctccgaggccgaaggggctgggaggtgggtcgactagttatgtacatatggatagggaacgtaaagacttataacgtatcgactagcgtacgtaggaacggccgtacttaccgaccttaactttccgaacgtagaaacctaaccgttacaaacgaaaccgaaccgttacgttagttactttacggaactaaagttacggtaaacctaacgtaccgttacggtagaacgcggtaacgtaacggaccgtacgggtacgttacggttacgttaaacggtttacttacgggtaacgttaaccgtaatttaaaccggacggtaacggggtaggaaccgttaaccccgggg

SEQ ID NO: 49463 - DNA, 871 bp, Homo sapiens
  misc_feature: GYAE6OF02FTUDN.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgacgacctctccgtgtcgcacgtcctctggtacttccaccctttcaaggttcgttcctaagttcggaacctagttcggacctaaccggttccgggggttacccccgaccggtaacgggtcccttaccccggaaggggaccggtaaacgggggggtccttaggggggtaacggggttcggggggtcgggtaaccgttaagggttttaaacgttacgttaccgtaaagtttaacgtgggtaaagggttaaacgggggtaaaaaggttaaaacggtaagtttaaaacgttaaaccgttaaggtaccggtaaccgaaaccggttaccgtttacccggggtaacgggaaaccggggtacccgttaacgtttacccgtaaacccgtttaaccgttttaacccggaaggtaaaccgaaccccgtaaaccgttaaacccgaaaacgtaaaccccgtaaccgtacgttaaccggtttaacgtttacgaacctaaaagtacgtaaaccgacgtaacccgttagggaacgacggtaccgtagggaacggaccgtacggtacgttaggttacgttaacgttcgtaggtacgtaaccggttaacgttaacgaccggtacggtaacgggtaaccgtaacccggg

SEQ ID NO: 49464 - DNA, 677 bp, Homo sapiens
  misc_feature: GYAE6OF02FSY5J.52.77.G11.1.454.CMB.1.raw
  modified_base (243)..(243): a, c, t, g, unknown or other
  misc_feature (243)..(243): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggccgtgggacggtcccngagactctccgtgtcgcagcctcgtggtacttcaccctttgagttcgtctatggactagtcgactacgtcggggtccccgccgacgggcctaccggagggaccgaacgggggtccttggggacgggttggggtcggacgtaggtttatatcgaatagtgaagtagggaaagtaagattaactactagtcgactaagtaccgtaccggtaggaacgggtcctaagttccacctactttaccgaacgacgaaccgtaacctaaccgaaacgaacctaccggtctagttactttcgaactaaagttacgaacgacgtaccgtagaacggacgtcgtacggacggtacgaccggtacgttcggtacgttaacgttacgttggtaacggtacgttaaccgttaacgtaccggtaacgggtaccggaacgtaaccccggg

SEQ ID NO: 49465 - DNA, 686 bp, Homo sapiens
  misc_feature: GYAE6OF02IYIDS.52.77.G11.1.454.CMB.1.raw
  modified_base (282)..(282): a, c, t, g, unknown or other
  misc_feature (282)..(282): n is a, c, g, or t
  modified_base (296)..(296): a, c, t, g, unknown or other
  misc_feature (296)..(296): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagtcttgggttttcctcgttgccttcttttaagaggttgtccaggtgtcaggtgcaggcttggtggagtcgtgggggacggcgtggtaccaggtccgtggggtacgtccctgacgtcctctcctgtcgacagtcctntgacttcaaccttnaggtcgttctatcgactatcgctacggtcgggtccaccgtaggtcctaccggaggaccggaaggggtcgtgggtagggtcgggtaggacgttaagttagtaacttctaagttacgtaggagtaagggtaaaacgtaagtaactttagtaactacgtggactaacggtaccgtacggaggtaacggacgtactaccgtactacttaccgaagacgaactaaccactaaacgaactacctagtacgttagttacgaactaaacgtacgaacgtccgtaacgcgtaaggacgacgtaagtaaccgggacgtacggttacggtcgttacgttacgttacgttagtacgtacgttaacgttaacgtaccggaacgggtaccgtaaccgtacccgg

SEQ ID NO: 49466 - DNA, 413 bp, Homo sapiens
  misc_feature: GYAE6OF02H8LF6.52.77.G11.1.454.CMB.1.raw
  modified_base (392)..(393): a, c, t, g, unknown or other
  misc_feature (392)..(393): n is a, c, g, or t
  modified_base (396)..(413): a, c, t, g, unknown or other
  misc_feature (396)..(413): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtccgctcggtgcggacgtctggggccaagggaccacggtcagcgtctcctcagcctccaccaacgggcccatccggtcttcccccctggcccaccctccctccaagacgcacctcgtgggggcacgagcggccctggctgcctggtcgaaggtctacttcctactacgatcgctggaggcgggctcggacgaaagggccgacgacgtagnngcnnnnnnnnnnnnnnnnnn

SEQ ID NO: 49467 - DNA, 923 bp, Homo sapiens
  misc_feature: GYAE6OF02JT7TT.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggagcgtggtccagccgtgggacgtccctgagacctctccgtgtgacacgcctcgtggtacttccgaccgttcaggttcgttacttatacggactagttcgaccgtaccggttcggggtccccacgacggtaccctccggtaacgggacggtaacgggggcttagggggtacgggttcgggggttacgggaccgttaaaggttttaacgacgttaccgtaaaggtttaaggtaggttaaacgggttaagggtaaaaaggtttaaacgggtaaactttaaacgttaacctttagggtacccggtaaacccgttaagggttaaacccgggtttcccgggttaaaggggtaacccggggtacccggtttaaacgtttacccgtaaaccccgttaccgttttaaaccgggaacggtaaaccggttaaacctaaacccggttaaaccaaaacggggtaaccctaaaccggttcccgtttaaggtttaacggtttaaccggtaaaaccttaaaaccggttacggtaaacccgtaaccggtaaccgtaacgggtaaccgtaggtacccggttagggtaaccggaccggtaacgggttacccggttaggttaacgttttaacggtttaacccgtagggtttaaccggtaaccgttaaaccgtttaaccggtaaaccggtaacggggtaacccggtaaacccggttaacccccgggg

SEQ ID NO: 49468 - DNA, 867 bp, Homo sapiens
  misc_feature: GYAE6OF02JPMD3.52.77.G11.1.454.CMB.1.raw
  modified_base (159)..(159): a, c, t, g, unknown or other
  misc_feature (159)..(159): n is a, c, g, or t
  modified_base (179)..(179): a, c, t, g, unknown or other
  misc_feature (179)..(179): n is a, c, g, or t
  modified_base (267)..(267): a, c, t, g, unknown or other
  misc_feature (267)..(267): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttccncgttgctcttttaagaggtntccagtgtcaggtgcagcttggtggtagtcgtgggggagtcgtggtccaggcctggggacgtaccctgacgtacctcttccgtgtacnccgacgtccctcgtaggtacttccacctttcgagttcgtactatgactagtcgctacggtcggtccgaccgaaggtcctaccggaggaccggtaacgggggtcctagggtacgggttcggggtacggaccgtaggtttaactataccgtaagttaaggtgtaaacggtttaggaaaaggttaaagaggtttaaacttacgtaacggtaccgtaacgtaaacggttacccgttacgggtaacgggtaaacgggtcccgtaaacgttacccgtaaaccgttactttaaccgggaacgtaaacggaacccgttaaaccgtaacccggtaaaaccgtaaacggtaccgttaaccgtttaggtttaaaccgtttaaccgaaacgttaaaaccgttacggtaaaaccgttaaccgggtaccgttaaacggaacggttacggtaaccggttaaggggtaacccggaacggttaacccgggttacggtttaaacgggttaacgttttaaccggtaaagttcccgggttaaagggtaacccggtttaaacccgttaaaagtcccggggtaaaacccggggttaacggaaccccggttaaaaccccgggg

SEQ ID NO: 49469 - DNA, 748 bp, Homo sapiens
  misc_feature: GYAE6OF02HM4KZ.52.77.G11.1.454.CMB.1.raw
  modified_base (293)..(293): a, c, t, g, unknown or other
  misc_feature (293)..(293): n is a, c, g, or t
  modified_base (302)..(302): a, c, t, g, unknown or other
  misc_feature (302)..(302): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggaggcggttggtccaggcccgtggggacggttcccctggacgaccttctcctgtcgcacgcctctggatttccaccttnagtgtctangacatgctacgtcggggtcccgccagggcctccgagggccgaaaggggggtctaggggaggttgggggtcggacgtagtttaatacgtctaattagtaggagttacgggtaaaagttaaacgtaagttaaacgttacctttaaagtcggaacctaacggtaccgtacccggttaacgggaaacgggggacccgttaaacgttcctaaacccgttaactttacccgaaggtaacggtaaaccctaaaccgttaacccgtaaaacgaaacccgtaacggtacttacggtacttttagaacctaaaagtacgtaaacacggtacccgtagaacggtaagaccgtagaacggtaccgacggtaccgttacggttacgttaacgttacgttagtacggtaaccgttaacgttaacgtaccggaaccgggtacggtaaccggtaaccccggg

SEQ ID NO: 49470 - DNA, 731 bp, Homo sapiens
  misc_feature: GYAE6OF02GG1G4.52.77.G11.1.454.CMB.1.raw
  modified_base (448)..(448): a, c, t, g, unknown or other
  misc_feature (448)..(448): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcgtgggttttctcgttgcttcttttaagaggtgtcagtgtcaggtgcagcttggtggagtcgtggggggaggcggtggtccagccgtaggggacggttccctgaacgtacttccgtccgtagtgccagcccttacgtggacttcacctttcgagttcgtactatcgaacagtcgctacggtcgggtccccgccgaacggtccgtaccgaggggaccgtaaaggggggtccttagggggacggttggggtacgggtctaaggtttactacgtctaagttagtgaacgtagggaaaggttaanaagttaatacgtagcgactaaggaccgttggtaacggaacgggccgtaactttaccaccttaacttaccgaagaacgtaacctaaaccgtaaccgaaagtaaccgccgtaacgtttaggtaacttaggaactaaacgtacgaaccgtaacggtcgtaaggacggtacgtacggtaggtaacggaccgtacggtaccgttaggttaacgttaacgttacggtacgttacggtaacccgttaacttaacggtaacccggtaaccgggtacggaaccggtacccgg

SEQ ID NO: 49471 - DNA, 528 bp, Homo sapiens
  misc_feature: GYAE6OF02GG40Y.52.77.G11.1.454.CMB.1.raw
  modified_base (303)..(303): a, c, t, g, unknown or other
  misc_feature (303)..(303): n is a, c, g, or t
  modified_base (348)..(348): a, c, t, g, unknown or other
  misc_feature (348)..(348): n is a, c, g, or t
  modified_base (361)..(361): a, c, t, g, unknown or other
  misc_feature (361)..(361): n is a, c, g, or t
  modified_base (398)..(398): a, c, t, g, unknown or other
  misc_feature (398)..(398): n is a, c, g, or t
  modified_base (487)..(487): a, c, t, g, unknown or other
  misc_feature (487)..(487): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctggggaggtccctgagactctcctgtgcagcctctggattcaccttcagtgtctatgacatgcacgtgggtcccnccaggctccgaggcaaggggctggagtgggtgcagttatatcatngatggaagtaagntatactatgctagctccgtggaacgggccagtcactnttaccagacacaactcaagaacacgctgtattgactaaatgaacacgccgtagacgagcgtgacggcacggtcgtgtagttacttacgngtacgacgtaacttagccgtacggacggtacgtaacccggg

SEQ ID NO: 49472 - DNA, 860 bp, Homo sapiens
  misc_feature: GYAE6OF02I8C0N.52.77.G11.1.454.CMB.1.raw
tcagcgcagtacgacacgaccggtgctcgatttagctagtcactcgaagggaaagggggggagaggagcccagcactagaagtcggcggtgttccattcggtgatcagcactgaacacagaggactcaccatggagtttgggctgagctgggttttcctgttgcttacttttaagaggtgtccagtgtcaggtgcagcgtggtggaggtcgtggggggaggcggtcgggtccgacggtccgtgggggaaccggtcccctaggacgaccttcgtcccgtggtcgcacgtcctcgtaggtacttcctaccttcgagttgtcctaagtcgaactagtcgctacggttcggggtcccacgtacggccgtccggaggtacggaacgggggccttagggggacgggttcgggggtacggacgtttaagttttaacgaggttaccgtaagtttaacgtacgggtttaaaggtacggggtaaaaaggttaaacggaactttaacggtttaaaccggtaaggtttacgggaaccggtaccggttaacccggtttaaccggggtaacggggtaaacccggggttcccgttaaacgtttaaccccgtaacccttaaccgtttacccggaaaggtaacccggtaaccctaaaacccgttaaaccggaaaaccgtaacccgtaaccggttaacttacgggtttaacgtttaacgaaaccgtaaacgtaccggaaacgtacgtacccgtagggaacgtaacgtacggtaggaaccggtaccgaacggttacgtcggttaagttaccgttacggttacggaccgttacgttaacgttaacgtaccgggaaccggtacggaacccggtaacccggg

SEQ ID NO: 49473 - DNA, 696 bp, Homo sapiens
  misc_feature: GYAE6OF02H2OYL.52.77.G11.1.454.CMB.1.raw
  modified_base (252)..(252): a, c, t, g, unknown or other
  misc_feature (252)..(252): n is a, c, g, or t
  modified_base (273)..(273): a, c, t, g, unknown or other
  misc_feature (273)..(273): n is a, c, g, or t
  modified_base (283)..(283): a, c, t, g, unknown or other
  misc_feature (283)..(283): n is a, c, g, or t
  modified_base (444)..(444): a, c, t, g, unknown or other
  misc_feature (444)..(444): n is a, c, g, or t
  modified_base (515)..(515): a, c, t, g, unknown or other
  misc_feature (515)..(515): n is a, c, g, or t
  modified_base (586)..(586): a, c, t, g, unknown or other
  misc_feature (586)..(586): n is a, c, g, or t
tcagcgcagtacgacacgaccggtgctcgatttagctagtcactcaaggggaaaggggggagaggagcccagcactagaagtcggcggtgtttccattcggtgatcagcactgaacacagaggactcaccatggagtttggctgagcttgggttttcctcgttgccttgttttaagaggtcgtccagttgtcaggtgcagtcgtggtggacgtggtgggggaggcgttggtccgagccgtaggggcgttccngacgacttctcctggtcgacncggtcctcgnggtactttccgaaccttgacggttcttccgtagtacgacctagttgacacggttcggccccgtacgacgtcgttacccggaggtcggaagggtcgtagggaggtgggtcgagtagttacatacgtaatgtgagtaaggaaacgtaagattaacgtactaancgactacgtacgtcggagtacgggccgtactacgaccttaatccgaagacgtaacaaccgtaaaccgtaanaaccgacgtacgttacgtttatacggaacttaaaagtacgaaccgtagtacccgtaagaacgggataccgngggttaaacgcgggtaaccttggaacgtttgttaagttaccgttggtaaaccggtaacgttaaacgtttaaccgacggggtaaccggttaaggaacccggtaacccgggg

SEQ ID NO: 49474 - DNA, 677 bp, Homo sapiens
  misc_feature: GYAE6OF02IYXH7.52.77.G11.1.454.CMB.1.raw
  modified_base (180)..(180): a, c, t, g, unknown or other
  misc_feature (180)..(180): n is a, c, g, or t
  modified_base (225)..(225): a, c, t, g, unknown or other
  misc_feature (225)..(225): n is a, c, g, or t
  modified_base (240)..(240): a, c, t, g, unknown or other
  misc_feature (240)..(240): n is a, c, g, or t
  modified_base (315)..(315): a, c, t, g, unknown or other
  misc_feature (315)..(315): n is a, c, g, or t
  modified_base (375)..(375): a, c, t, g, unknown or other
  misc_feature (375)..(375): n is a, c, g, or t
  modified_base (484)..(484): a, c, t, g, unknown or other
  misc_feature (484)..(484): n is a, c, g, or t
tcagcgcagtacgacacgaccggtgctcgatttagctagtcactcaaggggaaagggggggagaggagcccagcactagaagtcggcggtgtttccattcggtgatcagcactgaacacagaggactcaccatggagtttgggctgagcgtggtttcgcgttagctctttaagagtgtcngtgtcaggtgcagcgtggtggagtcgtgggggagtcgtgggtccngcgtgggacgtcccnggagctctccgtgtgacacgcctgtgtacttcctaccttcgagttgtactatgaccatgctacgttcggggcccnccggaggtcccaccgagggaccgaaggggtctaggggtaggtgggtagacctaggttaanacgtctaagttgagtagttaggaaaagttaagacgttaatacgtagtcaacgtagtaccgtaccggtaggtaaacggtacccgtacttaccgacttaactttaccgganaaccggtaacctaacctaaaccgaaagtacccgtaacttgtacggttactaacggtaacgaattaaccgtaacgacgtacgacgtagagacgtaggaaccgacgacgttcgtagtttaacgtcgttaaacgtcgtaaggttaaccgttaacgttacggaaccggtacgggtaacccggaacgtaaccccgggg

SEQ ID NO: 49475 - DNA, 789 bp, Homo sapiens
  misc_feature: GYAE6OF02GTRLA.52.77.G11.1.454.CMB.1.raw
  modified_base (303)..(303): a, c, t, g, unknown or other
  misc_feature (303)..(303): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcacatggagtttgggctgagcttgggttttcctgtttgcttacttttaaggaggtgtccagtgtcaggtgcagcgtggtggagttcggtgggggaggcgttggtccaggccgtggggacggtccctgacgacctcgtcctgtgcacgtcctgtggtacttccaccttcgagttcgtntagtgacagtgcctacggtcgggtcccgacgacggtcctaccggaggtaccggaaggggtctaggggtagggttgggtcggtaacgtaggtttaatacggtactaaggttagtcgtaaaggtacggggtaaaaagttaacggtaactttacgttaacgttagtacggaccgtaaacgttccggttaaccgggacggggtaaaccgggtccgttaaactttcccgaactttaccgtaacgtaaggaacctaacccgtaaccctaacgaaaccggtaacctacggttccgtttaatttacgttacgaacttaaagtacgaaacgtcgtaccgtaggaacggtaacgtacggtaggaaccggtaccgtacggttaccgttggtttaaccgtttacggtttaaccggtcggttaacggttaaacccggtttaagtttaaaccccggtacggaaacccgggggttaccggtaaaccccggtaaccccgggg

SEQ ID NO: 49476 - DNA, 626 bp, Homo sapiens
  misc_feature: GYAE6OF02IMI9I.52.77.G11.1.454.CMB.1.raw
  modified_base (159)..(159): a, c, t, g, unknown or other
  misc_feature (159)..(159): n is a, c, g, or t
  modified_base (195)..(195): a, c, t, g, unknown or other
  misc_feature (195)..(195): n is a, c, g, or t
  modified_base (249)..(249): a, c, t, g, unknown or other
  misc_feature (249)..(249): n is a, c, g, or t
  modified_base (263)..(263): a, c, t, g, unknown or other
  misc_feature (263)..(263): n is a, c, g, or t
  modified_base (378)..(378): a, c, t, g, unknown or other
  misc_feature (378)..(378): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttccncgttgctcgttttaagaggtgtccagtgtcagggtncagctggtggagcgtgggggagcgtggtccagcctgggaggtccctgacgactntcctgtgcagcctntggattccactttcagtcgtctagtagactatgacctacgtgggtccgccaggcctaccgacggcaaacgggggtcttagggaggtggggttgaaaggttacttagctaataagngagtaggaagtaagataagtactagtagacaacgtacgtacggagaacggtacgtattccactacttacgaagacaaccaaagtaccaaacgtaaccgacgtacgttagtacttacgaactaaacgtacgaaacgtacgaccgttagaacgagtacgtaaggacgtaacacggtagttagtaaggttacttacgtagtacgtaacgtaaacgttacgacgaacgggaaggtaccgtaaccggtacccg

SEQ ID NO: 49477 - DNA, 894 bp, Homo sapiens
  misc_feature: GYAE6OF02F86JP.52.77.G11.1.454.CMB.1.raw
  modified_base (266)..(266): a, c, t, g, unknown or other
  misc_feature (266)..(266): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggagcgtggtccagcctgggacgtccctagacgactctcctggtgtacgtccgtntggacttccgacctttgagttcgtctagtagacagtcggactacgtcggggttaccccgccgtacggtccttcccgaagggaccggtaaacgggggtccttaggggaacggttgggggtacggtacgttaacggtttaatacgttaccgaagtttacggtacggtaacggttaaggggtaaaagttaaaggtaacttaaacgttaacgttaaggtacggaccgtaaacgtacccggttaccgggtaacgggtaaaccggggtaccccgttaaacggtttaacccctaaaccccgtttacgtttacccggaaaacggtaaccgtaaacccgtaaaaccgtaaccccgaaaaacggtaaacccgtaccgttaacggttaacggttttaaccgtttaaccggaaacgttaaaaggtaccggtaaaccgtaaccgtaccggttaacggaagggttaacgtacccggtaagggtaaccgggtaccgtacggttaccggtttacgggttaaccgtttaaaccggtttaacgggttaccgttaaccgggttaaccgtttaaaccgtttaaaccgggtacccggtaaacccggggtaaaccggtaaccccgggttaacccgggtaacccccccggg

SEQ ID NO: 49478 - DNA, 871 bp, Homo sapiens
  misc_feature: GYAE6OF02IFYL4.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggtttcctcgttgctcttttaagaggtgtccagtgtcaggtgcagctggtggagtcgtggggaggcgtggtccgagccgtggggacggtccctggagactctccgtgtgcgagtcctcgtggtacttccaccttcagtcgtacgttagtagtactatcggactacgttcggggtccccgtccgaacggtccaccccggagggccggtaaacggggtcgtaggggtaggttgggggtcggtaccgaaggttttagtacctcgtaagttacgttaggagttaaggggtaaagtaaaggaatttaaacgttacgttaactacggggtaccgacggttaacccgtaccgggttaagggaaaccggggggtaccccttaacgttacccgaacccgtttaaccggttacccgtaaaagggtaccgtaaaacccgtaaacccgtaccgtaaaaccggaaaccgtaacccggtagtttaacgttaaacgttttaacggtaaccgtaaaagtaccggtaaaccgtaacggtacccgttaaacggtacgggtaacggtaccggttaacgggtaacggggtaacccttacccggggggttacgttaccgggtttaaacggttaaaccggttttaaccgttagggtttaacccggttaaacccgggttaaacttttaaccgggtaaacccggtttaacccggggaacggtaaccccggttaaacccccggggg

SEQ ID NO: 49479 - DNA, 842 bp, Homo sapiens
  misc_feature: GYAE6OF02HT2GK.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgctcttttaagaggtgtccagtgtcgaggtgcagtcgtgggtggagtcgtggggggaggcggtggtccaggccgtggggaggtcccctggacgacctcttccgtggtgccacgtcctcgtggtacttctacccttcgagttcgtaccttagtagactatgacctcgtcggggtcccacggacgtcctaccggaggtaccggaacgggggtctaggggacggttggggtcggacctaaggtttactagtctaaattagtacggagttaagggaaagtaaagtaatttactaaactgtaggactaaacggtccgtaccgggtaacgggaaccggggtaacccgtaacgtttacccgtaaccttacgttttaacccaaggtaacccgaaaccgtaaacccgttaacccgaaaacgtaaaccgaaccggtttaccgttaacggtttaacgttttaaccgtaaaccgtaaaattaaccggtaaaccgtaaccggtaccgttaaacggtaaggaaccggttacgaacgggtaaccgggtaaccgtacggtaccggtttaacgggtttaacgtttaccgtttaaacggtttaaccgggttacggaaccggtttaaaaccggtttaaaccgttaacccgggggttaaccggtaacccggggtaaaccggtttaaaccccccggggg

SEQ ID NO: 49480 - DNA, 701 bp, Homo sapiens
  misc_feature: GYAE6OF02IE4Q6.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtcagtgtcaggtgcagctggtggagtcgtgggggagcgtggtccagcctgggaggtcctgagactctctgtgcagcctctggattcaccttcagtgtctatgactatcgctaccgtcggggtcccgccgaggcctccgaggcgaagggggctgggaggtggggtggacgtagttaatatctatagtagtaagtaggaaagtaagtattaataactagtgacgtacgaccgttcggtaaggaacgggaccgtagtcctactacttaccgaagacgaacaacctaccaaacgaaccgaccgtactaggttaactttacgaacttaaacgtacgtaaaccgacgtaccgttaggaacgtacggtacgtaacgggaaccggtacggtaaccgggttaccggttaacggtttacggtttaacgttttaaccggttacgggttaaccggtaaaccggtttaaaccgttttaaaccgtacccgggtaaacggggtaaacccgggtaacccgggttaaacccccgggggg

SEQ ID NO: 49481 - DNA, 751 bp, Homo sapiens
  misc_feature: GYAE6OF02HHLC4.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtgagtcgtggggagcgtggtccagccgtgggacgtccctgacgacctctccgtgtgcacggtcctgtggaactttccaacccgtttcgagttgtaccttagtcgactatcgactacggtcgggcccacgtacgggcctaccgaggtaccggaaacgggggtccttaggggtacgggttcggggtcgggaacttaaagggttttaacacgttacgaaatttacgtaggtaaggtttaagggaaaagttaaaaggtaacttaacgttaaacctaggtacgaactacgggtaacccgttacggtaacggaaccgggtaccgttaacctaacccgtacccgttaacgtttaccgaagtaaccgtaaaccgtaaacccgtaccgaaaacgtaacccgacgttacgttagttacgtttaacgaactaagtacgaacacgtcgaacgagtacgcgtacgaacggtacgacggttcggttaacgttacggttacttaaccgtggtaaccgtaacgttaacgtaacgttacccggaaggtaccgtaaccggtaacccgg

SEQ ID NO: 49482 - DNA, 579 bp, Homo sapiens
  misc_feature: GYAE6OF02GXEIY.52.77.G11.1.454.CMB.1.raw
  modified_base (352)..(352): a, c, t, g, unknown or other
  misc_feature (352)..(352): n is a, c, g, or t
  modified_base (454)..(454): a, c, t, g, unknown or other
  misc_feature (454)..(454): n is a, c, g, or t
  modified_base (487)..(487): a, c, t, g, unknown or other
  misc_feature (487)..(487): n is a, c, g, or t
tcagcgcagtacgacacgaccggtgctcgatttagctagtcactcaagggaaaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggccgtggggacgtccctgagactctcctgtcgcagcctctggacttcaccttcagtgtctatgacatcgctacgtggggtcccaccgaggcctaccgagggcgaagggggctggggaggtggggnggactaggttatactcaattagtagagtaggaaagtaaggattaagtactatgactagtcgtcgaggacggctatcactatacagacactacacaagacacntgtacttagactaagagaacagtctagagacgngtaggacggacgacggtactaggttacgttactacgttaggtacgtaacgttaacgttaacgacgggaacggtacggtaaccgtaacccggg

SEQ ID NO: 49483 - DNA, 695 bp, Homo sapiens
  misc_feature: GYAE6OF02FN3Q4.52.77.G11.1.454.CMB.1.raw
  modified_base (158)..(158): a, c, t, g, unknown or other
  misc_feature (158)..(158): n is a, c, g, or t
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
  modified_base (248)..(248): a, c, t, g, unknown or other
  misc_feature (248)..(248): n is a, c, g, or t
  modified_base (263)..(263): a, c, t, g, unknown or other
  misc_feature (263)..(263): n is a, c, g, or t
  modified_base (278)..(278): a, c, t, g, unknown or other
  misc_feature (278)..(278): n is a, c, g, or t
tcagcgcagtacgacacgaccggtgctcgatttagctagtcactcaagggaaagggggggagaggagcccagcactagaagtcggcggtgttccattcggtgatcagcactgaacacagaggactcaccatggagtttgggctgagctgggttttccncgttgctctttaagaggtgtccagtgtcaggtgcagctggtagngtcgtgggggagcgtggtccagccgtgggagtcccnggacgactcnccgtgtgcagcctcnggtacttcacctttnagttcgtactatgacatcgcacgtcgggtcccgacacgggtctccgacggccgaagggcgtagggaggtggggtgacgtagttatagtacaatagtacggaattagggaaagttaagtataagttaacctagtcgacgaagtcccgtaccggtaggaaacgggccgtaacgtaccgtaaccgtactttaccgaagtaacgtaaccaaaccttaccgaaacgaaccacggtacttagttaacgtttgaaccgtaaacgtaacgtaaaccgaacgtaccgtaagaaccggtaacgtaacgtacgaccgggtaaccgacggtcgtaacgggttacgtttaacttacggttacggtacggtaaccgttaaaccgttaaccgtaaccgggaaccgggtacggtaacccggtaaaccccgggg

SEQ ID NO: 49484 - DNA, 543 bp, Homo sapiens
  misc_feature: GYAE6OF02IIHX8.52.77.G11.1.454.CMB.1.raw
  modified_base (439)..(439): a, c, t, g, unknown or other
  misc_feature (439)..(439): n is a, c, g, or t
  modified_base (446)..(446): a, c, t, g, unknown or other
  misc_feature (446)..(446): n is a, c, g, or t
  modified_base (452)..(452): a, c, t, g, unknown or other
  misc_feature (452)..(452): n is a, c, g, or t
  modified_base (473)..(473): a, c, t, g, unknown or other
  misc_feature (473)..(473): n is a, c, g, or t
  modified_base (477)..(477): a, c, t, g, unknown or other
  misc_feature (477)..(477): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcgacggaggacaacggtcgaccccgtcgcgtcgtgcggacgtcgtgggccaaggacacggtcagcgtctcctcacgcctcaccgaacggcccatccggtccttcccccgtggccacccctcctacaacgagccaccgtcgtggggacacgacggccgcccggtcgggtctcggccgtggtacgaacggtacctttaccgtccgttaacgtaacgtacgtaccggtcgtaaggaccggccggggtcgtacggaccgtaaacgggtccgaccgaaggtaacgngagtagngagagngagcgtcgcgagacgtagtancgancgtacgcgacgtacgacgacacgacgacgtaccgtacgaccgttagacggtagtacggtaacgtac

SEQ ID NO: 49485 - DNA, 643 bp, Homo sapiens
  misc_feature: GYAE6OF02GFMSM.52.77.G11.1.454.CMB.1.raw
  modified_base (301)..(301): a, c, t, g, unknown or other
  misc_feature (301)..(301): n is a, c, g, or t
  modified_base (319)..(319): a, c, t, g, unknown or other
  misc_feature (319)..(319): n is a, c, g, or t
  modified_base (354)..(354): a, c, t, g, unknown or other
  misc_feature (354)..(354): n is a, c, g, or t
  modified_base (367)..(367): a, c, t, g, unknown or other
  misc_feature (367)..(367): n is a, c, g, or t
  modified_base (375)..(375): a, c, t, g, unknown or other
  misc_feature (375)..(375): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagcgtggtggagtcgtgggggaggcgtggtccaggccgtggggacgtccctgacgctctcctgcgcacgcctcgtggacttccaccttgagttcgtctagtgactntcgctacgtcgggtcccncgaggcctccgaggcgaagggctagggaggtgggngcgttagttatantaattagngtagttagggaagtaacaatagttaactagtcgacgaacgtacgtccggtaaggaacgggtcctaacttaccacgttacttaccgagtaacgacctaacgtaccaaacgaactaccgtctacgttacgttacgacgtaaatcggaaacaggtcctaagaacgtacgtagtacggaacggaccgtaccggtcgttaacggtgttaacgttcgttaggacgtaaccgttaactttacgacggaaccgggtaccgaaccggtaaccccggg

SEQ ID NO: 49486 - DNA, 402 bp, Homo sapiens
  misc_feature: GYAE6OF02F5UN1.52.77.G11.1.454.CMB.1.raw
  modified_base (382)..(402): a, c, t, g, unknown or other
  misc_feature (382)..(402): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtccgctcggtgcggacgtctggggccaagggaccacggtcagcgtctctcagcctccacacggcccatccggtcctccccctggccacccgtcctacccaagacgccacctctcgggggcacgagccggccctgggctgccgtggtcaaggactaccttcctatacgatcgctgagcgggtctggcgaaggccgcatagnnnnnnnnnnnnnnnnnnnnn

SEQ ID NO: 49487 - DNA, 727 bp, Homo sapiens
  misc_feature: GYAE6OF02GE4PB.52.77.G11.1.454.CMB.1.raw
  modified_base (183)..(183): a, c, t, g, unknown or other
  misc_feature (183)..(183): n is a, c, g, or t
  modified_base (215)..(215): a, c, t, g, unknown or other
  misc_feature (215)..(215): n is a, c, g, or t
  modified_base (257)..(257): a, c, t, g, unknown or other
  misc_feature (257)..(257): n is a, c, g, or t
  modified_base (263)..(263): a, c, t, g, unknown or other
  misc_feature (263)..(263): n is a, c, g, or t
  modified_base (286)..(286): a, c, t, g, unknown or other
  misc_feature (286)..(286): n is a, c, g, or t
  modified_base (298)..(298): a, c, t, g, unknown or other
  misc_feature (298)..(298): n is a, c, g, or t
  modified_base (326)..(326): a, c, t, g, unknown or other
  misc_feature (326)..(326): n is a, c, g, or t
  modified_base (336)..(336): a, c, t, g, unknown or other
  misc_feature (336)..(336): n is a, c, g, or t
tcagcgcagtacgacacgaccggtgctcgatttagctagtcactcaagggaaagggggggagagggagcccagcactagaagtcggcggtgtttccagttcggtgatcagcactgaacacagaggactcaccatggagtttgggctggagcgtgggttttccgcgttggctctttaagaggtntccagtgtcaggtgcagtctgggtggagtcgngggggagccgtggtcagccgtgggacgtccctgagctcctcngtcgancgcctacgtggacttccaccttnagtcctatacgngactatcgccgtacgtcggggtaccccngacggtcccnccgaagggtccgaagggggtcctagggggtcggtggggcgaaccgttattacgtaaccgtgaattttaggacgaggttaaggtaaaagtccgaaaagttttaccaacttgtacggacctaagggtacccgtcggtaaggaaccgggtcgtaacttacccggtaaccttaacttacggaacgtaacgtaacccgaaccgttaaccaaacgtaacgtaaccgtgtaccttagttaccgaataaacgtaacgaaccgtaacgtcgaacggaacgtaccgaggaaggaaccgggtacgaccgggttagttcgtacgtttaacgttaacgtgttaacccgggtattaaacggttaccgttaacgggaaccgggtaacgacccggttaaccccgggg

SEQ ID NO: 49488 - DNA, 603 bp, Homo sapiens
  misc_feature: GYAE6OF02G9R9I.52.77.G11.1.454.CMB.1.raw
  modified_base (287)..(287): a, c, t, g, unknown or other
  misc_feature (287)..(287): n is a, c, g, or t
  modified_base (293)..(293): a, c, t, g, unknown or other
  misc_feature (293)..(293): n is a, c, g, or t
  modified_base (310)..(310): a, c, t, g, unknown or other
  misc_feature (310)..(310): n is a, c, g, or t
  modified_base (393)..(393): a, c, t, g, unknown or other
  misc_feature (393)..(393): n is a, c, g, or t
  modified_base (574)..(574): a, c, t, g, unknown or other
  misc_feature (574)..(574): n is a, c, g, or t
tcagcgcagtacgacacgaccggtgctcgatttagctagtcactcaagggaaagggggggagaggagcccagcactagaagtcggcggtgttccattcggtgatcagcactgaacacagaggactcaccatggagtttgggctgagctgggttttcctcgttgctcttttaagaggtgtccagtgtcaggtgcagctggtggagtcgtggggggaggcgtggtccaggccgtggggacgtcccgtgagacctctccgtgtcgcacgcctctggattcaccttcagtntctatnacatgcacgtgggcccnccaggcctccgaggacgaaggggctgggaggtgggtaggctaaggttatactcaatatggaataggaagtaagatataactangacacgtacctccggagggaacgggcgtacttaccaccttaactttccaaggtaccgaactaacctaaccaaagaaccgacgtactagttactttagactaaagtgaaacctgacctagaagatacgagacggacgacggtacgtggttacttacgttacgtgtacgtacgtaacgttaanaccggtaagggacgtaacggtaacccggg

SEQ ID NO: 49489 - DNA, 780 bp, Homo sapiens
  misc_feature: GYAE6OF02FFPK0.52.77.G11.1.454.CMB.1.raw
  modified_base (286)..(286): a, c, t, g, unknown or other
  misc_feature (286)..(286): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggtttttcctcgttgcttcttttaaggaggtgtccagtgtcaggtgcagctgggtgagtcgtgggggagcgtggtccagccgtggggacgtccctggacgactctcctgtcgcagccttctggacttcacccgttnagttcgtactagtcgactagtcgccgtacgtcggggtcccaccgtacgggtcctacccggaagggcggtaaacggggggtcttagggggacgggttcgggggttacggactaacgggttttaatacgttaccgtaattacgtaggtaacgtagggtaaaagttaacgaatttaacgtaacttagtcggactaacggtaccgttaccggtaagggaaccgggtccgtaacgtttaccgaaccgttacgtttaccgaaggtaaccgaacctaaaccgtaacccgtaaaacggaacctaccggtacgtttacggtttaacgtttacgaaacgtaaagtaccggaacgtacggtaccgtaggaacgtacggtaccgtagggaaccggtacggaacggtcggttaacggttacggttaacgtttacggtacggttaccgaaccggtttaacttaaccggtaccgggaaccgggtaccggtaacccggttaaccccgggg

SEQ ID NO: 49490 - DNA, 717 bp, Homo sapiens
  misc_feature: GYAE6OF02JJVUW.52.77.G11.1.454.CMB.1.raw
  modified_base (123)..(123): a, c, t, g, unknown or other
  misc_feature (123)..(123): n is a, c, g, or t
  modified_base (167)..(167): a, c, t, g, unknown or other
  misc_feature (167)..(167): n is a, c, g, or t
  modified_base (253)..(253): a, c, t, g, unknown or other
  misc_feature (253)..(253): n is a, c, g, or t
  modified_base (558)..(558): a, c, t, g, unknown or other
  misc_feature (558)..(558): n is a, c, g, or t
  modified_base (571)..(571): a, c, t, g, unknown or other
  misc_feature (571)..(571): n is a, c, g, or t
  modified_base (600)..(600): a, c, t, g, unknown or other
  misc_feature (600)..(600): n is a, c, g, or t
  modified_base (665)..(665): a, c, t, g, unknown or other
  misc_feature (665)..(665): n is a, c, g, or t
tcagcgcagtacgacacgaccggtgctcgatttagctagtcactcaagggaaagggccgattcaccatttccagagacaactccaagaacacgctgtatttgcaaatgaacagcctgagagcngttttttttaggacacggctgtgtattactgtgcgtaacttaancgacggtacggacaacggtcgacccccgtcgctcgggtgccggacgtcgtaggggccaagggacccacgggtcaggcgtctccgtnacgcctaccaacccgaagggcccctattccggttacccttcccccgtggccaccccttcctaccaacggacgccgaaccgttcggtaccgggggcctaaccgacggtcccggggtcccgtacggggtccttacgggccgttacggtaaaccgaacggttaaccctttacccgtttaccgttaacggttaaccggtaacgtttacccgggtaccgttaggggaccgggtaccgggggtaccgtttaaccggggacccgtaaaccgggggaccggtaaccgttaaccgtaagggtaccacgtaacgngtacgactggtcncgtagcgtacgtcacgctagcgtatctgngtgacgtcgtcgtcgcgacgtcgtcgcgcgcacgtcgtgtacgacgtcgtcgtcgtacgtcgtcncgtcgtacgactcgacgtcgtacgtacgtcgtacgtcgtcgtcgtacgtacg

SEQ ID NO: 49491 - DNA, 808 bp, Homo sapiens
  misc_feature: GYAE6OF02HZQZP.52.77.G11.1.454.CMB.1.raw
  modified_base (264)..(264): a, c, t, g, unknown or other
  misc_feature (264)..(264): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgcttcgttttaagaggtgtccgtagtgtcgaggtgcagtctggtggagtcgtgggggagtcgtggtccagccgtggggacgtccctgagtacctctcctgngcgagcctgtcggtattaccaccgttgtagtcgttactagtcgaactagtcgaccgtacgttccggggtacccgcccgaaggggtcccttaacccggaggggtacccggaaacgggggtccggttaggggacgggtttcgggggtacggtacgttaaaggtttacgtaacgttacgtaagtttaagtggtaaggttagggtaaaaaggttaaaaacgtattttaacgtaaacgttaggtacggtaaccgtaacgttaaacccggtttacggtaacggggtaaacggggtacccgttaacgtttaccctaacccgtttaaaccgtttaccggaaacggtaaaccggtaaacctaaacccgttaaaccgtaaaccggtaaaccgtaaccgttacgtttacgtaactttacgaaactaaacgtacgaaacgtcgtaccgtagtaacggtagtacgtacggtacgacgtacggtactaggttacgttacttacgtacggtacgtacgttaacgttacgtacggtaacggtacggtaccgtaacccggg

SEQ ID NO: 49492 - DNA, 827 bp, Homo sapiens
  misc_feature: GYAE6OF02JNDJE.52.77.G11.1.454.CMB.1.raw
  modified_base (756)..(756): a, c, t, g, unknown or other
  misc_feature (756)..(756): n is a, c, g, or t
tcagcgcagtacgacacgaccggtgctcgatttagctagtcactcaagggaaagggggggagaggagcccagcactagaagtcggcggtgttccattcggtgatcagcactgaacacagaggactcaccatggtagtttggggctggagtcgttgggttttccctcggttgcttcgtttttaaaggaggtgtccgaggtgtcgaggtcgcgagctgggtggaagttcggtaggggggaggcggtggtaccgagccgtaggggacggtcccctggacgtaccgtctccgtgtcgcacggtcctgtggtacttccgaccttcgagtcgttactatggactagtccgtcgaccggttggggcccgcgtaccgggtcccgtaccggaacgggtacggtaaacggggggtcctaggggtacgggtttcggggggtaggtaccggtaaacggtttacgttaactaggtaagttaacggttacggtaaggttaacggggtaaaacgttaaagttaacggttaacttaacggttacggttaccggccggtaaccggttaaacccggttcccggggtaaacgggtaaaccgggtaccgtaaacgttacccggtaaccttaccgttaacggtacgtaaacgtaaccgtaacccgtaacccgaaacggtaaacccgtaccggtcttaacgggttacttaaccgtaactaaagtacgtaaccgtacgtaccgtaggtaacgtacgtagacgggtacgacggaccggtntaacggtattaaccggtgttaccgtacgtacgttaacttaaccggtaggtaacgtaggtaccggtaaccgg

SEQ ID NO: 49493 - DNA, 927 bp, Homo sapiens
  misc_feature: GYAE6OF02HCWP9.52.77.G11.1.454.CMB.1.raw
  modified_base (449)..(449): a, c, t, g, unknown or other
  misc_feature (449)..(449): n is a, c, g, or t
tcagcgcagtacgacacgaccggtgctcgatttagctagtcactcaaggggaaagggggggagaggagcccagcactagaagtcggcggtgtttccattcggtgatcagcactgaacacagaggactcaccatggagtttgggctggagcgttggggtttttccctcggtttgcttacgtttttaaaggacggttcgttcccaaggttggttccaggggttgaccgaaggtcgttggggtgggacggttccgggtggggggggacgggtcggttcgggtacccgagggtcccgttggggggaccggttccccctagggaaccgtaccttcccgtcccgtggtacggaccgtaccggtcccttcggttggtaactttccccgtaacctttcgaaggttcgtacctagtacggactagtcgacctacggtcggggtcccgaccgaggtccnccggaacgggtcggaacgggggtctagggggaggtgggggtacgtacgtaggtttactacgtaacaagtttacgtaggtaacgttaagggaaaagtttagaatttaacgttaacgtaagtaccggtacgtaacccgtacgggttaaccggtaaccgggtaacggggttaccccggtttaaccgttaacccgtaacccgttaacgttttaacccgaaacggtaacccgtaaaccgttaaacccgttaacccgaaaacgtaacccgtaaccgttacgttacgtttaacgttacgtaaacgttaaagtaaccgtaaacctaccggtaccgttaaggtaaaccggtaggtaacggtaccggggtaacggtaccgggtacggtacggtttaacggtacggtttaacgttacggtacgttaacggtaaccgttaaacgttaaccggtacggtaacgggtaccggtaaccggttaacccccgggg

SEQ ID NO: 49494 - DNA, 758 bp, Homo sapiens
  misc_feature: GYAE6OF02FZWOR.52.77.G11.1.454.CMB.1.raw
  modified_base (247)..(247): a, c, t, g, unknown or other
  misc_feature (247)..(247): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggccgtggggacgtccctgganactcgtcctggtcgcacgcctctggacttccaccttcagttcgtcttagtgacatcgctacgttcggggtcccgccgaggccctccgagggccggtaagggggcctggggtaggtggggtcggacgtaggtttaatacgtactaagtattggaagttagggaaaaggttaaagtaattagtttaaccttaaggttcggaccgtaaggtacccggttacccgggttaacgggaaaccggggtacccgtaagttttaccccgaaaccctttaaccgttttacccgaaggtaaacggtaaccctaaaccgttaccccgaaaacggaaacccgttaccgtaaccgtttaggtttaacgtttaacgaaacctaaagtacgtaaaccgcggtaccgttagaagacggtaccgtaggaacgggtaccgacggtcgttagggttacgttaacttacggttagttaccggtacggttaaccttaacgtacggtacgggtacggtaccgttaaccccgggg

SEQ ID NO: 49495 - DNA, 676 bp, Homo sapiens
  misc_feature: GYAE6OF02JLAD4.52.77.G11.1.454.CMB.1.raw
  modified_base (172)..(172): a, c, t, g, unknown or other
  misc_feature (172)..(172): n is a, c, g, or t
  modified_base (265)..(265): a, c, t, g, unknown or other
  misc_feature (265)..(265): n is a, c, g, or t
  modified_base (354)..(354): a, c, t, g, unknown or other
  misc_feature (354)..(354): n is a, c, g, or t
  modified_base (455)..(455): a, c, t, g, unknown or other
  misc_feature (455)..(455): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctggtttcctcgttgctctttaagngtgtccagtgtcaggtgcagctggtggagtcgtgggggagcgtggtccagcctgggacgtccctgacgacctctaccgtgtgccagccttcgnggtacttccaccgtttcgaggttgttctacgtgactatgacctacgtcggggtcccaccgtaggtcctaccgaggccggaaaggggtcncgggtaggttcggggtcgacgttagttactacttcgtaagttagtcggtagtaggtaaagtaacgtattacgtactagtaccgagtacgtacctaccgggnggtaaacgggcctaacttccgaaccttagttaccgaagtacgtaaccaactaccgaagtaaccgctacgttagtacttagaacttaacgcgtaacgtacggacctagacgtacggtgtaccggacggtacctacgggtcttaaggttacgttaaacttccgacggtttacgaaccgttaacgttaccggacggaacgggtaccggtaccgtaaccccgggg

SEQ ID NO: 49496 - DNA, 766 bp, Homo sapiens
  misc_feature: GYAE6OF02HOVQ7.52.77.G11.1.454.CMB.1.raw
tcagcgcagtacgacacgaccggtgctcgatttagctagtcactcaagggaaaggggggagaggagcccagcactagaagtcggcggtgtttccattcggtgatcagcactgaacacagaggactcaccatggagtttgggctgagcttgggttttcctcgttgcttcttttaaggaggttcgtccagtgtcagggtgcagcttggtggagtcgtagggggagcgtgggtaccaggccgtggggacgtccctggacgtactcctcgtgtcgctacgtcctcgtggtacttcctaaccgttcgagttcggttattagtggactagtcgactaccgggtcggggttcccgacgtacggcctaccggaagggtaccggaacgggggttcgtaggggtacgggtttcggggtacgtacgtaaggttttactacgtcgtaagttagtaggtaacggttaacgggtaaaaggtaagttaacgttaacgttaaaccgttgtcggaacgtacggtacccgtacggtaacgggaaccgggtaccgttaactaccgtacccgttaacgttaccgtaagaaccgtaacgtaaacctaccgaaacgaaccgtaccgtagttacgttacgtttacgaactaaccgtagaaccgtacgtacgtaaggacggtactacggaggacggtaccggtacgtacgttaacggttacgttacgttcgttaggtacgttaacgttaacttacggaccggtaacgggaccgtaaccggtaaccccggg

SEQ ID NO: 49497 - DNA, 905 bp, Homo sapiens
  misc_feature: GYAE6OF02JZFBK.52.77.G11.1.454.CMB.1.raw
  modified_base (108)..(108): a, c, t, g, unknown or other
  misc_feature (108)..(108): n is a, c, g, or t
  modified_base (485)..(485): a, c, t, g, unknown or other
  misc_feature (485)..(485): n is a, c, g, or t
tcagcgcagtacgacacgaccggtgctcgatttagctagtcactcgaaggggaaagggggggagaggagcccagcactagaagtcggcggttgtttccattcggtaanagcacgaaacacgtaacgacgacacgacgtacgtacgtagtggtagttaggtcgtcgtggttcgttcgtttcgttccgtttagttcgttacgttacggttaccgaggttccgaggtagttcgagggttggcgttgggtgggaaggttcgggtaggggtccgtgggggtaccgtcgggttaccgccgtagggaaacccgtttgaccgttccgtcggtgtcctcgtcgtcgtcggtcctctcgttcgtcgtacgttacgtaccttgtctagttaccgtacggtaccgttcggacgtccgacggttacggcgtccgggacgcttttaacttttttacggctttacccggttaacgggttagtagtcgtagtacgtagtanaccccggttaaccggaagtacgtagtcccgaagtacgtacgacgtacgtcctacgtacgaccgtacgtcgacgactacgtacgcccgggaacgtaaccgtaccgtaacgtaacgtaaccgtacgtaacgaacgtaacgtacgtaacgtaacgtaacgtacgtaccgtacggtaacggtaaccggtaccgttacggtaacggttaacccgtttaacccgaacggttaacggttaaccgttaacccggttaaccggttaccccgggaccccgggtttaaccccgggtaaaccccgggttcgggggttaacccgggttaacccgggttaccccgggtaaccccggggttacccccggttacccggggttacccccgggttacccgggttcccgggttacccggggttacccgggtaacccggg

SEQ ID NO: 49498 - DNA, 725 bp, Homo sapiens
  misc_feature: GYAE6OF02H02FC.52.77.G11.1.454.CMB.1.raw
  modified_base (190)..(190): a, c, t, g, unknown or other
  misc_feature (190)..(190): n is a, c, g, or t
  modified_base (290)..(290): a, c, t, g, unknown or other
  misc_feature (290)..(290): n is a, c, g, or t
  modified_base (320)..(320): a, c, t, g, unknown or other
  misc_feature (320)..(320): n is a, c, g, or t
  modified_base (348)..(348): a, c, t, g, unknown or other
  misc_feature (348)..(348): n is a, c, g, or t
  modified_base (358)..(358): a, c, t, g, unknown or other
  misc_feature (358)..(358): n is a, c, g, or t
  modified_base (363)..(363): a, c, t, g, unknown or other
  misc_feature (363)..(363): n is a, c, g, or t
tcagcgcagtacgacacgaccggtgctcgatttagctagtcactcaaaggggaaaggggggggagaggagcccagcactagaagtcggcggtgtttccattcggtgatcagcactgaacacagagactcaccatggagtttgggctgagtctgggtttttcctcgttgctcttttaagaggtgtccagtntcaggtgcagctggtggagtcgtggggagcgtggtccagcctgggacggtccctgacgacctctcctggtgacacgccttctgggattccgaaccctttnagtgtctaagtgactatgacactgggtccncagcctccaggcaagggctggcgtgggngcagtagtancatangtataggaagtaaagattagaactagtgactagtactacgtaggaagggccgtaacttaccaaccgtatttaccgaaggtaccgtaacaaacgttacccgaaagaaaccacgtaccgttagtaaccgttttaaggaacctaaaagttacgtaaaaccgtaacggtacccgttaacggaacggtaaacggtaacggtaccgtaaacgggaccgtaacccgggggtacgtttaacgggtttaacgttaaccggttttaaaaccgttacggggtttaacccgtaacgggttaaaaccccggttttaaagttaaaccccgggtaaaccggggtaaccggggtaaacccgggttaaaacccccgggg

SEQ ID NO: 49499 - DNA, 1021 bp, Homo sapiens
  misc_feature: GYAE6OF02FJEJI.52.77.G11.1.454.CMB.1.raw
  modified_base (184)..(184): a, c, t, g, unknown or other
  misc_feature (184)..(184): n is a, c, g, or t
tcagcgcagtacgacacgaccggtgctcgatttagctagtcactcaagggaaagggggggagaggagcccagcactagaagtcggcggtgttccattcggtgatcagcactgaacacagaggactcaccatgggtagtttgggctgagtcttgggttttcctcgttgcttcttttaaggaggtntccagtgtcaggtgcagtcgttgggtggtacgtcggtggggggacgtcggtcgggtcccaggtcccgttagggggaccgttccccgtggaaccggaccttccgtcccgtaggtcgcctacggtccttcggtggtactttcctacctttcgaggtttcgtctagtcgaacgtatcggtcctacggttcgggtcccgaccggtacgggtcctaccgggacggggtaccgggtaacgggggtccggttaggggtaacggggttcgggggttacggggtaccgtttaaacgggttttaacgtacgttaccggtaacttttaacgggcgggttaaaacgggttaaacggggttaaaagtttaaacggtaaacgttttaaaccgttaacccggttttaaacggtaccggttaaaccgtaaacccgggtttcccggtttaaccccggggggttaaacgggtaaacccggggtacccccggtttaacccgttaaccccggttaaacccgttttaaccccgttttaaccgggaaaacggttaaacccgggtaaaccccttaaccggttaaaaccccgggaaaacccgtttaacccgtaaaccggtttccgtttacgggttttaaaccgtttccggtaaaaaacggttaacccggtttaacgaaaacccggtaccggttaccggaacgggtaacggtacccgggttagggtaaaccgggttaccggggaccgttacgggtaccggtttaagggtttaccgttaacggtttcggttacgggttaacgttaccggttaaaccttacgggaacccggttaacgggtaacccggttacgggtaaccccggg

SEQ ID NO: 49500 - DNA, 759 bp, Homo sapiens
  misc_feature: GYAE6OF02GHKJ2.52.77.G11.1.454.CMB.1.raw
  modified_base (259)..(259): a, c, t, g, unknown or other
  misc_feature (259)..(259): n is a, c, g, or t
  modified_base (274)..(274): a, c, t, g, unknown or other
  misc_feature (274)..(274): n is a, c, g, or t
  modified_base (304)..(304): a, c, t, g, unknown or other
  misc_feature (304)..(304): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagctctcctgtgcagcctntggacttccaccttnagtgtctagtgacatgcacgtcgggtcccnccgacggcctaccgagggccgaagggggctggggaggttggggtgacgtaggttatacgtcaagttagtggtaagtacgggtaaagttaacgtagttaacgttaacgttagtagaccgtaacgggtaccccgttaccgggttaagggaaaccggggtaccccgttaaacgtttacccgaaacccgtttacgttttaccccgaaagggtaaccgtaaacccgtaaaccgttaacccggaaacgtaaacccgtaccggttacgtttaacgtttaacgttttaccgaaactaaaacgttacgaaacccgtacggtaccgttaaggaacgtacggtaccgtagggaacggtaccggtaccggtacgttaacggttacgtttaacggttacggtttaggtaccggttaacgttaacgtttaaccggaccggtaacgggaaccggtaccggtaacccgggg

SEQ ID NO: 49501 - DNA, 774 bp, Homo sapiens
  misc_feature: GYAE6OF02J3BE8.52.77.G11.1.454.CMB.1.raw
  modified_base (176)..(176): a, c, t, g, unknown or other
  misc_feature (176)..(176): n is a, c, g, or t
  modified_base (303)..(303): a, c, t, g, unknown or other
  misc_feature (303)..(303): n is a, c, g, or t
tcagcgcagtacgacacgaccggtgctcgatttagctagtcactcaagggaaaggggggagaggagcccagcactagaagtcggcggtgtttccattcggtgatcagcactgaacacagaggactcaccatggagtttgggctgagcttgggttttcctcgttgctcgttttaagnggtgtccagtcgtcgaggtgcagcgtggtggagtcgtgggggaggcgtggtccagccgtgggcgtccctgacgtcctcttccgtgtcgcgacgccgtcgtggtacttccaccgtttcagtttccgtntaacgtcggaactaggtcgtccgtaggtccgggtacccgccggtaggcccgtcggaacgggtcggaaacgggggtcttacgggggaggttcgggggtccggtaacgtaggttttaacacgttaccgtaagttaacggttagtaacggggtaaaggttaaaacgtaagtagtaacgtttacgagttcgacacgtacgtcggtaacggtacggtacctacgttacccaccgttacgtttaccgaaaggtaccgtaaacccgtaaaccgtaaccgaaccgtaaaaccgtccgttaccgttaagtttaacgttaccgaaaacgtaaaccgtaacgttaaaccgacgtacccgtaggaacgtaaacgtccgacggaaaccggtcgacggttccgaaagtttccgtaaagttccgtacggtacgtaaaccgttaacgttaagccgggttaaccgaacgggtaaccccggttacccgg

SEQ ID NO: 49502 - DNA, 900 bp, Homo sapiens
  misc_feature: GYAE6OF02IXTSL.52.77.G11.1.454.CMB.1.raw
  modified_base (186)..(186): a, c, t, g, unknown or other
  misc_feature (186)..(186): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagtctgggtttttcctcgtttgcttcgttttaaagacggtntccaagtgtccaggtgcagcgtaggtggaggtacgtgggggaggccggttggtcccagccgtaggggacggtcccctggacgtaccttcctccgtggtcgctaacgtccctcgtaggtaacttccgtacctttaccgagttcgttccaatcggaactagtgtacctacggtcggggtccccacgccggtacctccggaacggacggtaacgggggccttagggacgggttcgggggtaggacgttaacggttaatagtaccgaattaagtaggtaaaggtacggtaaaaggttaaagaacgtttaacctacgttaaacggtcgaaacgtaacgtaacggttacccggtacgggtaaaccggggtacccgtaacgttaacccgaacccgttaacgttaacccgtaaacgtaaccgtaaaccttaaaccgtaaacccgtaaaacggtaaccggtaaaccgttcgggttaaaccgtttaaaggtttaaccgtaaacggtaaaaccgtttaacggaaaacccggtaaacggttcccgtaaaggggtaaacgtaacgggttaaaccccggtagggaaacccgggtaaccggtaaccgggttcggttacgggtttaaactttaaccggtttaacggttagggtaaccgtaaacccggtttaaatttaacccgttaaccggggaaacgggtttaaaccgggaccccgttaaacccccgggg

SEQ ID NO: 49503 - DNA, 603 bp, Homo sapiens
  misc_feature: GYAE6OF02JUX10.52.77.G11.1.454.CMB.1.raw
  modified_base (160)..(160): a, c, t, g, unknown or other
  misc_feature (160)..(160): n is a, c, g, or t
  modified_base (372)..(372): a, c, t, g, unknown or other
  misc_feature (372)..(372): n is a, c, g, or t
  modified_base (436)..(436): a, c, t, g, unknown or other
  misc_feature (436)..(436): n is a, c, g, or t
  modified_base (471)..(471): a, c, t, g, unknown or other
  misc_feature (471)..(471): n is a, c, g, or t
  modified_base (481)..(481): a, c, t, g, unknown or other
  misc_feature (481)..(481): n is a, c, g, or t
  modified_base (488)..(488): a, c, t, g, unknown or other
  misc_feature (488)..(488): n is a, c, g, or t
  modified_base (493)..(493): a, c, t, g, unknown or other
  misc_feature (493)..(493): n is a, c, g, or t
  modified_base (496)..(496): a, c, t, g, unknown or other
  misc_feature (496)..(496): n is a, c, g, or t
  modified_base (501)..(501): a, c, t, g, unknown or other
  misc_feature (501)..(501): n is a, c, g, or t
  modified_base (504)..(505): a, c, t, g, unknown or other
  misc_feature (504)..(505): n is a, c, g, or t
  modified_base (510)..(510): a, c, t, g, unknown or other
  misc_feature (510)..(510): n is a, c, g, or t
  modified_base (512)..(512): a, c, t, g, unknown or other
  misc_feature (512)..(512): n is a, c, g, or t
  modified_base (516)..(516): a, c, t, g, unknown or other
  misc_feature (516)..(516): n is a, c, g, or t
  modified_base (518)..(519): a, c, t, g, unknown or other
  misc_feature (518)..(519): n is a, c, g, or t
  modified_base (524)..(524): a, c, t, g, unknown or other
  misc_feature (524)..(524): n is a, c, g, or t
  modified_base (528)..(528): a, c, t, g, unknown or other
  misc_feature (528)..(528): n is a, c, g, or t
  modified_base (530)..(530): a, c, t, g, unknown or other
  misc_feature (530)..(530): n is a, c, g, or t
  modified_base (534)..(534): a, c, t, g, unknown or other
  misc_feature (534)..(534): n is a, c, g, or t
  modified_base (536)..(536): a, c, t, g, unknown or other
  misc_feature (536)..(536): n is a, c, g, or t
  modified_base (571)..(571): a, c, t, g, unknown or other
  misc_feature (571)..(571): n is a, c, g, or t
tcagcgcagtacgacacgaccggtgctcgatttagctagtcactcaagggaaagggccgattcaccatttccagagacaactccaagaacacgctgtattgcaaatgaacagcctgagagctgaggacacggctgtcgtattacctgtgacgaaacttancacggacggacaaccggtcacccccggtcgctcggtgcggacgtcgtcggggccaacggggaccacgggtcacgccgtactccctcacggcccctcccaaccgtaacgggcccctaagttccgggttacccttccccccgtggcccaccccgtccgtacccaagacggccacctcgtcgggggaccacggacgccgggtccctggggtaccncggtcctcgggcaacggtacctaccgttcctaacgtacgtactcgaccgtggaccgtccggggnttaccggcggtaaacgggcctacgtagtaggtacnaccgtgacanccgagtntacgngcncgtgngtnncgtancnctgncnngcgcncgcncncacncncacgcgacgcagtacgagcgcgtactacgtctacncgtagacgtcgacgacgcacgtacgtcgtgac

SEQ ID NO: 49504 - DNA, 769 bp, Homo sapiens
  misc_feature: GYAE6OF02H338H.52.77.G11.1.454.CMB.1.raw
  modified_base (214)..(214): a, c, t, g, unknown or other
  misc_feature (214)..(214): n is a, c, g, or t
  modified_base (281)..(281): a, c, t, g, unknown or other
  misc_feature (281)..(281): n is a, c, g, or t
  modified_base (690)..(690): a, c, t, g, unknown or other
  misc_feature (690)..(690): n is a, c, g, or t
  modified_base (719)..(719): a, c, t, g, unknown or other
  misc_feature (719)..(719): n is a, c, g, or t
tcagcgcagtacgacacgaccggtgctcgatttagctagtcactcaagggaaagggggggagaggagcccagcaactagaagtcggcgttgtttccattcggtgatcagcactgaacacagaggactcaccatggagtttggggctggagtcgttggggtttttcctcgttgctttctttttaaggagggttcgtcctagtgtccaggtcgacngcgtggtcggagtcgtggggggagcgtggtccagccgtgggacgtcctgagactcctcgtgtgaccngccttcgtagggtactttccctaccttacgtaacgttcgtcttaagtggtaactcgtagtaccgtacccggttcggggtccccgaccgacgggccttccggaaggtccgggaaagggggtctaggggtagggtcggggtggtaccgtaagtttaagaccgttcttaagtagttccggaaaggttagggtaaaagttaaacggtattaaaccgtaagttcgtacgaacgttaaccggtccgtttacggaccgggtaacgggtccctttaaccgttaccgaaaccgtttacgtttaacccgaaaggtaactaaccgtaaaccgtaccgtaaaccgaaccgttaaccgtcgtttaacggtaaacttttcggaaaaccctttaaaagtacccgaaacggtaccgtacgtaagnggtacgaacggtaggacggccgtacggtntgtacgttatgttagcgtactaacgtacgacggagtaccgagtaacccgg

SEQ ID NO: 49505 - DNA, 759 bp, Homo sapiens
  misc_feature: GYAE6OF02HWFG7.52.77.G11.1.454.CMB.1.raw
  modified_base (262)..(262): a, c, t, g, unknown or other
  misc_feature (262)..(262): n is a, c, g, or t
  modified_base (328)..(328): a, c, t, g, unknown or other
  misc_feature (328)..(328): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtggggggagcggtggtccgagccgtgggacgtccctggagtacctctctgtncgacgcctcgtggtacttccaccttcgaagtgttactagtgacattcgacgtacgtcggggtcccncgacggtccgtccgagggaccggaagggggtcttaggggtaggtggggtacgacgtaagtttaatacgtactaagttagtcggaaggttaacgggtaaaagtaaagtaagttaacgttaacgtacgttacgacctaacggtacccgttacccgggtaagggtaaccggggtacccgttaacgttacccgtaacccgttaacgtttacccgaaggtaacccgtaaaccgtaacccgtaaacccgaaacggaaacccgtaaccggtacgttacggtttaactttacggaaacgttaaagtaccgaaccgtacgtaccgtaaggacgtaacgtcgtacggacggtaccgtaacggtccgttaggttacgttacttacgttcgtacgtacgtaaccgtttacgaaccggtaacggtacggtaaccgtaacccggg

SEQ ID NO: 49506 - DNA, 651 bp, Homo sapiens
  misc_feature: GYAE6OF02JAB10.52.77.G11.1.454.CMB.1.raw
  modified_base (318)..(318): a, c, t, g, unknown or other
  misc_feature (318)..(318): n is a, c, g, or t
  modified_base (452)..(452): a, c, t, g, unknown or other
  misc_feature (452)..(452): n is a, c, g, or t
  modified_base (463)..(463): a, c, t, g, unknown or other
  misc_feature (463)..(463): n is a, c, g, or t
  modified_base (466)..(466): a, c, t, g, unknown or other
  misc_feature (466)..(466): n is a, c, g, or t
  modified_base (472)..(472): a, c, t, g, unknown or other
  misc_feature (472)..(472): n is a, c, g, or t
  modified_base (477)..(477): a, c, t, g, unknown or other
  misc_feature (477)..(477): n is a, c, g, or t
tcagcgcagtacgacacgaccggtgctcgatttagctagtcactcaagggaagggccgattcaccatttccagagactaactccaagaacgacgctgtaactttgcaatgaactgcctgagagctgaggacacggtctggtcgtaatccgtgtacgcgaactttagcacggaagtacgaacggtcgacccccgtcgcgtccggtgcggtaccgtcgtggggaccaagggccctacgtcgaacgcgtcctcctacgacgcctaccaccgtaaggccctagtccggtccttcccccgtggccaccctcctaccgaagacnccgtacctcggtacggggccacgacggcgcccgttggtctcggtccgtcggtacgtaaccggtaccttacgttcctacgtacgtacgtcgaccgtggacgtacgggtcacgggacgacgtacggcgacgtagancgtatgaccanacncgtacncgacncgcgactcgtcgcgtacgtcgtacgtagagcgtacgtacacgtcgacgtcacgtcgacgcgtcgacgtcgtagtacgacgtacgtacgtacgaccggacgtaacgtaacggtaccgtaaccgtacgtacgtacgtaacgtacgtacgtaccgtaccgtaccgtactcgtaaccg

SEQ ID NO: 49507 - DNA, 688 bp, Homo sapiens
  misc_feature: GYAE6OF02JPHPG.52.77.G11.1.454.CMB.1.raw
  modified_base (322)..(322): a, c, t, g, unknown or other
  misc_feature (322)..(322): n is a, c, g, or t
  modified_base (447)..(447): a, c, t, g, unknown or other
  misc_feature (447)..(447): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggttttcctacgttgctcttttaagagtgtccagtgtcaggtcgcagcgtggtcggagtcgtgggggagcgtggtcaggccgtgggcgtaccctgagctcgtctgtacgcagccctgtggacttccaaccgttgacgttgtactagtgaaccattcgcacggtttgggccnccaggtcctaccggagggaccgtaagggggtctggggtacgtcggggttacacgtaggtttaacctagttccgaaaagtttgacgtaaggtggtaaaaaggttaatacgttaaagttaaaccgtnttcgggaactaacgggtacccgttaccggttaaggaaccgggtaccgtaacttacccgtactaaccgtttcgaaacgaaccgacccgttaaaccgaacgtaaacgtaccgtactacgttactacggactaaacgtcggaactagaaccgttagacgaacgtgacgacgaacgcgtcgagttattacgttactgtactacggtacgttagtaccggtacggaacgtaccgtacgtaccccgg

SEQ ID NO: 49508 - DNA, 786 bp, Homo sapiens
  misc_feature: GYAE6OF02HFNHL.52.77.G11.1.454.CMB.1.raw
  modified_base (178)..(178): a, c, t, g, unknown or other
  misc_feature (178)..(178): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctctttaagaggtntcagtgtcaggtgcagctggtggagtcgtggggagcgtggtccagccgtgggacgtccctgagacctctcctgtgcagtcctcgtaggtattccgaccttcgagttgttactatgactagtcgacctacggtcggggtccccgaccgaggtccgtccggaaggccggaaagggggtccttgggggagggttgggggtcggacgtaaggttttataacgtctaattagtaggagttaacgggtaaaggttaaggtaatttaagtaacctttagacggtacgtaacgtacccgttaccggttaacggaacggggtaccgttaacttacccgtaaccgttaacgttttacccgaaggtaaaccgtaacgaaacccgttaaccctaaacgaaaccgaccgttaacgttaaccgtttagtttaccgaaccgttaaaacgtaaccgtaaaccggtaacgtacccgttaagggaacggaccgtacgtacgggtaaccgggacccggtaccggttcgttaccggttaaggtttaaacttacggttacggttcgtaaccgtttaaacgttaaccggtaccggtaacggggtaaccggtaacccggttaaccccgggg

SEQ ID NO: 49509 - DNA, 820 bp, Homo sapiens
  misc_feature: GYAE6OF02F3UU4.52.77.G11.1.454.CMB.1.raw
tcagcgcagtacgacacgaccggtgctcgatttagctagtcactcaagggaaaggggggagaggagcccagcactagaagtcggcggtgttccattcggtgatcagcactgaacacagaggactcaccatggagtttgggctgagcgttgggttttcctcgttgcttacgtttttaagaggtcgtaccagttgtcaggtgcagtcgtggtgaggtcgtgggggagcgtggtccaggccgtagggacggtccctaggactacctctccgtagtcgcgtacgcctcgtacggacttacctacccgttagtacggttagttcctaagtcggtaacctgttccggaccgtaaccgggtttccggggtcccgcccggtaacggtcccgtacccggacggggtaaccggacgggggtccggttagggaacggggttcggggtacggtaccgtaacgtttacgacttacgtaagtacgttaggtaacgttagggtaaacggttaaacgtagttaacttaacggttactacgggtacctacggacccgggttccggtaaggggtaacccggtacccgtaacgtttaccgaacccttacctttaacggtaccggaaccgtaaccctaacccggtaaaccctaacgttaacccgaacctttcgtaacggttttactaccgaaacctaaacggtctaaacccggtagtaccgtacgaaggtctacggtacggacgtacgaccgggtgttaaggtcttaacggttaccgttaggaaccgttaacgtaaccggttaccgaagtaacccggggtacgtaaccgtacccccgggg

SEQ ID NO: 49510 - DNA, 748 bp, Homo sapiens
  misc_feature: GYAE6OF02GIO0U.52.77.G11.1.454.CMB.1.raw
  modified_base (159)..(159): a, c, t, g, unknown or other
  misc_feature (159)..(159): n is a, c, g, or t
  modified_base (202)..(202): a, c, t, g, unknown or other
  misc_feature (202)..(202): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttccncgttgctacttttaagaggtgtccagtgtcaggtgcagctggnggagtcgtgggggacgcgtaggtccagccgtggggacgtccctagagacctcgtccgtaggtcgacacgcctcgtaggtacttcctaccggttcaggttcgtacctagtcgaacgtacttcgccgtacggttccggggccccgaccgaacgggtcctacccggagggttaccggaagggggtccgttaggggacggtttcgggggcggtacgttaggtttaatacttacgtaacgttaggtaccggaagtttaaggggaaaacgttaagaacgtttaactacgtttaagcgttaacaaccggttacgttacccgggtaggaaccgggtcgtaacttaccgaccttaccgttacgaacgtaccgaacttaaccgaccgaaacgtaacccgagtaccgttacgtttaacgttcggaaaccttaagaaccgtaacgacgtcccgtagaaccgtcgacgtacgggacggtacgacggttacggtcttaggttacttacgtggtaacctacgtaacgtaccgaccggacggtaacggacccgtaacccggg

SEQ ID NO: 49511 - DNA, 729 bp, Homo sapiens
  misc_feature: GYAE6OF02I6QUC.52.77.G11.1.454.CMB.1.raw
  modified_base (170)..(170): a, c, t, g, unknown or other
  misc_feature (170)..(170): n is a, c, g, or t
  modified_base (196)..(196): a, c, t, g, unknown or other
  misc_feature (196)..(196): n is a, c, g, or t
  modified_base (240)..(240): a, c, t, g, unknown or other
  misc_feature (240)..(240): n is a, c, g, or t
  modified_base (263)..(263): a, c, t, g, unknown or other
  misc_feature (263)..(263): n is a, c, g, or t
  modified_base (279)..(279): a, c, t, g, unknown or other
  misc_feature (279)..(279): n is a, c, g, or t
  modified_base (282)..(282): a, c, t, g, unknown or other
  misc_feature (282)..(282): n is a, c, g, or t
  modified_base (290)..(290): a, c, t, g, unknown or other
  misc_feature (290)..(290): n is a, c, g, or t
  modified_base (353)..(353): a, c, t, g, unknown or other
  misc_feature (353)..(353): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcgtggttctcgtgctctttaagngtgtcagtgtcaggtgcagcttgggngatcggtgggggagtcgtggaccagccgtgggacggtcctggancgttctcttgcgacagccttcgnggtacttccgacttcngtntctagtanacgatgccacggttcgggcccgccgtacggcctaccggacggccgggaaggggtccgtagggngggtggggtaccggagttaggttaatacctactagtaaggtcgtaagtaggtaaaaggtaagtaattaagtaacttaggacgtcgaacggttaccgtacgtaagggaccggtacgtaacgttaccgtacctacttaacggacgtaacgtaaccgtaaccgttaacgaaacgtacgacgttacgttacggttaattacgaacttaaaggttaccaaacgtacggaccgttaagaaacgtcggtaccgtaagggtaccggtaccgggacggttacgggtagtttacggttaaggttaccgttacggtaacgttaaccgggttaacgttaaccggtaaccgggtaacgggggtaacccggtaacccggtaaccccgggg

SEQ ID NO: 49512 - DNA, 707 bp, Homo sapiens
  misc_feature: GYAE6OF02FZH3S.52.77.G11.1.454.CMB.1.raw
  modified_base (191)..(191): a, c, t, g, unknown or other
  misc_feature (191)..(191): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctggttttcctcgttgctcttttaagagtgtccagtgtcaggtncagcgtggtggagtcgtgggggagcgtggtccagccgtggggacgtccctgacgactctcctgtcgcacgtcctcgtggacttctaccttcagttcgtcctatagactagtcgctacgtcggggtcccgccgtaaggtccctcgacgggtacggaacgggggtctagggtaggttggggtacggacgttaaggttactacgtacctagttaagtcggaagtacgggttaaagtaagtattacgtaactagtacgctaacgtccgttaccggtaagggtaaccggtccgtaacttacccgacttacgtttccgaagacgtaaccgttaacctaaccgaacgtaaccgtaccgtacgttaattacggtttagaaaccgttaagttaccgaaacgtacgtaccgttagaacggtacgtacgtaggacccggtagtaccgggtcttacgggtaatttacgtacgttagtaaccgtacgtaacgttacgaccggtaacgggtacgtaccggtaaccccggg

SEQ ID NO: 49513 - DNA, 641 bp, Homo sapiens
  misc_feature: GYAE6OF02G5F7R.52.77.G11.1.454.CMB.1.raw
  modified_base (315)..(315): a, c, t, g, unknown or other
  misc_feature (315)..(315): n is a, c, g, or t
  modified_base (368)..(368): a, c, t, g, unknown or other
  misc_feature (368)..(368): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtgagtcgtggggaggcgtggtccagccgtgggacggtccctgagactctcctgtgcacggtcctcgtaggacttcctaccttcagttgtactatgacatgctacgtcggggtccnccgtaggcctacgaggcgaagggctgggaggtgggtgctagttatatcaatanagatgggtaaacgtaagtataagtactagtacactacgtcgtcggtaggaacggtacgtacttaccacttattaccaagaacgtacctaacctaccgaaagaacctacgccttagttacgtttacgaactaaagtacgaaacgtaccgacgtagacgagtacgtacggaacgtacgacggttaccgttggttacgtttaacgttaccggtagttaaccggtaacgttaacgttttaaccgacggtaacgggtacggtaacccgttaacccggg

SEQ ID NO: 49514 - DNA, 646 bp, Homo sapiens
  misc_feature: GYAE6OF02I9M7T.52.77.G11.1.454.CMB.1.raw
  modified_base (512)..(512): a, c, t, g, unknown or other
  misc_feature (512)..(512): n is a, c, g, or t
  modified_base (526)..(526): a, c, t, g, unknown or other
  misc_feature (526)..(526): n is a, c, g, or t
tcagcgcagtacgacacgaccggtgctcgatttagctagtcactcaagggaaaggggggagaggagcccagcactagaagtcggcgtgtttccattcggtgatcagcactgaacacagaggactcaccatggagtttgggctgagctgggttttcctcgtcgcttcttttaagaggtgtccagtgtcaggtgcagctggtgagtcgtggggagcgtggtccagccgtgggcgtccctgagacctctccgtgtagcagcctctgacttcaccttcagtctctatcgacatcgactacgtcgggtcccgacgaggtcctaccgaggacgtaacggggctggggtaacgtcgggtagacctagttatactacgaagtcgtagagtacggtaagtaagtattacttaacgactaggtcaaccgtcgtaccggtaggtaaccggaccgttacgtaccacgttaacgtttacagggaactaccgtaactaccgaaacgaccacggttctagttagttnaacgaatacgaacngtactagactcgtagtaccggaagtccgagtacgtacggttcgttaacgttccgaggttacgtaacccgtttaaacgtttccgaaccgggtaaccgggtacggtaccgttaaccccgggg

SEQ ID NO: 49515 - DNA, 631 bp, Homo sapiens
  misc_feature: GYAE6OF02J1LOP.52.77.G11.1.454.CMB.1.raw
  modified_base (180)..(180): a, c, t, g, unknown or other
  misc_feature (180)..(180): n is a, c, g, or t
  modified_base (295)..(295): a, c, t, g, unknown or other
  misc_feature (295)..(295): n is a, c, g, or t
  modified_base (311)..(311): a, c, t, g, unknown or other
  misc_feature (311)..(311): n is a, c, g, or t
  modified_base (324)..(324): a, c, t, g, unknown or other
  misc_feature (324)..(324): n is a, c, g, or t
  modified_base (355)..(355): a, c, t, g, unknown or other
  misc_feature (355)..(355): n is a, c, g, or t
  modified_base (380)..(380): a, c, t, g, unknown or other
  misc_feature (380)..(380): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcgttgggttttacctcgttgactcgttttaagnggttgtccagttgtcaggtgcagtcgttggtaggcgttcgtgggggaggcgttggtccaggccgtgggtacgtcctggacgcttctcgtgtagcacgtcgtctgtatcgaccttnattgtctatcgatacngctacgtggtccncgagcctcgagaggaacgggctaggtacggngggtgcgtagttaacgtatcatacngtagtggaaacgtaagtaacttagtaacttagtacgtactaagaccgtacgtacggaaaccggtcgtaacgtacaaccgttacttacgaacgaagtaactaaccgttacgaaacgtaaccgactacgtattacgttactacgaacgttacgacgtacgtacgtaacgtacgagtacgtgaccggtacgcgtacgtagtgtaagttacgtgtacgtacgttactaagtaccggaacgcggaacgttacccgg

SEQ ID NO: 49516 - DNA, 752 bp, Homo sapiens
  misc_feature: GYAE6OF02HI6PR.52.77.G11.1.454.CMB.1.raw
  modified_base (315)..(315): a, c, t, g, unknown or other
  misc_feature (315)..(315): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcgtttaagaggtgtccagtgcaggtgcagcgtggtggagtcgtgggggagcgtggccagccgtgggacggtccctggagtactctccgtgtagcacgtcctacgtggtacttacctaccttcgtacgtcgtactatacgactagtacgngtaccgcgggtccaccgtacggcctaccgaggacggaacggggtcgtgggtaggtggggtcgtacgtagtttaagtatacgtaatacgtaggtaagtaaggtaagtaaagtattaagtactagtacgacgtagtaccgtaccggtacgggtaccgggtacgttaaccgtactaaccttaacgttaccgaacgtaacgaaaccgtaaaccgttaaccgaaacgaaccgttaaccgtacgtacgtttaacgttacgtaaacgtaaacgtacgaaaccggtaccgtaccgtaaaggtaacggtaggtaccgaaggtaaccggaccgtaccggtacgtttagggttaaccgtttaacgtttaaccgtacggttaacgttaaccggttaaacgttaaccgtaccgggtaaacgggtaccgggtaacccgttaaaccccgggg

SEQ ID NO: 49517 - DNA, 747 bp, Homo sapiens
  misc_feature: GYAE6OF02G12XU.52.77.G11.1.454.CMB.1.raw
tcagcgcagtacgacacgaccggtgctcgatttagctagtcactcaaggggaaagggggggagaggagcccagcactagaagtcggcgtgtttccattcggtgatcagcactgaacacagaggactcaccatggagtttgggctgagcttgggttttcctcgttgctcttttaagaggtgtccagtgtcaggtgcaggctgggtggagttcgtggggggagcggtggtccacggtccgtggggacggtcccctggacgaccttccgtccgtgtcggctacggtcctcgtggtacttcctaccgttcagtttcgtactagtcgaactgtcgacctcggttacggggtccccgacgacgggtccctaccgggagggaccggaaggggggtctagggggtagggttcggggtacggacgttaaggtttactacgttactaagttaggtacggtaaggttaagggtaaaacggttaagtacgttaaagttaacgttgtacgtaacgtaacggaccgtttaccgggtaaggaacgggtacctacgttacctaccgttacgttaacgacgtaacgaccaacgtaacaaccgacaccgttagtagttagttacaacgtaaagtcgaaagtcgtacgtacgaagtacgtacgtacggacggacgtacggttacgttggttaagttaccgtaaggttcgttaacggtaacgttaaccttaacggtacgaaccggggacggttaaccggaccccggg

SEQ ID NO: 49518 - DNA, 693 bp, Homo sapiens
  misc_feature: GYAE6OF02JABW1.52.77.G11.1.454.CMB.1.raw
  modified_base (182)..(182): a, c, t, g, unknown or other
  misc_feature (182)..(182): n is a, c, g, or t
  modified_base (197)..(197): a, c, t, g, unknown or other
  misc_feature (197)..(197): n is a, c, g, or t
  modified_base (267)..(267): a, c, t, g, unknown or other
  misc_feature (267)..(267): n is a, c, g, or t
  modified_base (546)..(546): a, c, t, g, unknown or other
  misc_feature (546)..(546): n is a, c, g, or t
  modified_base (554)..(554): a, c, t, g, unknown or other
  misc_feature (554)..(554): n is a, c, g, or t
tcagcgcagtacgacacgaccggtgctcgatttagctagtcactcaaggggaaagggggggagaggagcccagcactagaagtcggcggtgtttccattcggtgatcagcactgaacacagaggactcacatgggagtttgggctgagtcgttgggttttcctcgttgcttacgttttaagnggttgtccagtgttnaggtgcagcttgggtaggtgttcggagggggcgtcggtcggtaccgtaggccggttggggacggttcccnggaacgtcctctccgtggtacgcgtacgtcctacgtggtacttccgtaccttgagttcgttactagtacgaactgtcgtaccgtcggtcgggaccctcgacggttccgacgacggacggtaacgggtcgtaggggtacggttgggcgtaaccttagttagtacctgtaagttagtggtaagtacgggtaaaattaagattaacgttatggactacgaacgtccgtacggacggtacggtcttactaccgtactactcgaactacgaacaccgaagaacnctaccgtntagtttacgagattaacgacacgtacactagagccgtagacgacgtacgtacgtacgttgaagtttagttaacttaaccggttagtaaccgttaacggttccggaaccgggtaacttaaccgggtccgtaacccccggg

SEQ ID NO: 49519 - DNA, 752 bp, Homo sapiens
  misc_feature: GYAE6OF02GLCFK.52.77.G11.1.454.CMB.1.raw
  modified_base (202)..(202): a, c, t, g, unknown or other
  misc_feature (202)..(202): n is a, c, g, or t
  modified_base (254)..(254): a, c, t, g, unknown or other
  misc_feature (254)..(254): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcgttgggtttttccctcggttgcttacttttaaggaggtcgtccagtgtcaggtncaggctgggtggagtcggtgggggagtcgtggtccaggcgtggggacgtccngacgactcgtccgtgtcgcacgtcctcgtggtacttccaccttcgagttgtaccttatcgactagtcgacctacggttccgggcccgaccggtacggtaccctaccgggacggggtaacggaacgggggtcctaggggggtacgggttcggggtcggtctaaggtttactacgtactaagttagtaggtaaggtaacggtaaagtaagtacttaacttacgtagtcgaactaacggtaccgtacgggtagggaaccgggtccctaagttcccgtaacttacgttacgaacggtaaccaaacctaaccgtaaccgaaagtaacccgtacgttacgttagtttaacgtacgtaactaaacggtaaccgaaacgtccgacgttacggacgtaacgtacggtagacggtaaccgtacggtccgtttaaggtacgttacgttacggtgttaacgtaacggttactaaccggtacggaacgggtaacggtacccgtaacccggg

SEQ ID NO: 49520 - DNA, 503 bp, Homo sapiens
  misc_feature: GYAE6OF02GJ4WR.52.77.G11.1.454.CMB.1.raw
  modified_base (451)..(451): a, c, t, g, unknown or other
  misc_feature (451)..(451): n is a, c, g, or t
  modified_base (454)..(457): a, c, t, g, unknown or other
  misc_feature (454)..(457): n is a, c, g, or t
  modified_base (459)..(462): a, c, t, g, unknown or other
  misc_feature (459)..(462): n is a, c, g, or t
  modified_base (464)..(503): a, c, t, g, unknown or other
  misc_feature (464)..(503): n is a, c, g, or t
tcagcgcagtacgacacgaccggtgctcgatttagctagtcactcaagggaaagggccgattcaccatttccagagacaactccaagaacacgctgtatttgcaaatgaacagcctgagagctgaggacacggctgtgtattactgtgcgaacttaatcacggaggacaacggtgacccccgtccgctcggtgcggacgtctggggccaagggaccatggtcagcgtctcctcagcctccaccaagggcccatcggtccttcccccgtggccacccctcctccaagagcacctcgtgggggccacacggccggccccgtgggggccttcggcccgttcgggtccgaaacgggaccttaccgtttcccgttccgttaccgttcgccggtcgttcgggacgggccgggggtccgttcggggaccgaaacgggtcccggacgaagttaacggcncgnnnncnnnncnnnnnnnnnnnnnnnnnnnnnnnnnnnnnnnnnnnnnnnn

SEQ ID NO: 49521 - DNA, 866 bp, Homo sapiens
  misc_feature: GYAE6OF02HJ83Q.52.77.G11.1.454.CMB.1.raw
  modified_base (209)..(209): a, c, t, g, unknown or other
  misc_feature (209)..(209): n is a, c, g, or t
  modified_base (706)..(706): a, c, t, g, unknown or other
  misc_feature (706)..(706): n is a, c, g, or t
tcagcgcagtacgacacgaccggtgctcgatttagctagtcactcaagggaaaggggggagaggagcccagcactagaagtcggcggtgtttccattcggtgatcagcactgaacacagaggactcaccatggagtttggctgagcgtgggttttcctcggttgtctctttttaagtaggtgtccagtgtcgaggtgcagcgtggtggngtcgtgggggaggcgtggtccagccgtgggtcggtccccgtgacgtacctcgtccttgtggaccacgtcctcgttacggtactttacccaccgtttcacggttcggttaccttagttacgaacgtcgtacgtccgtaccggttccgggggtccccgtacctacgggtccctacccggagggaaccggaagggggtaccgtggggtcgggtagggtcggaccggttaagttaacgtactaccgtaataagttacggtaacgttaggaaaagttaagtaagtttaacgttaacttaggtaggtacttaacgtacccgttacgggtaacgggtaacgggtacccgtaacgttacccgtaccgtaaaccgttttaccgaaaggtacgtaaacccccgtaacgttaaccggaaacccgttaaaccgacctttacggttaacgttaactttaccgaaaccgtaaagtaccgtaaaacgaccgttaccgtaacgacgtaacggnggttaacgggtaacgtacccggttacgggttaccgtttcgggtttaaactttacggtttaaacgttccggggtttaaacccgtaacggtttaaaccggtttaaacgggttaaccccggtaaagggggtttaaaccccggaacccggttaaacccccgggg

SEQ ID NO: 49522 - DNA, 761 bp, Homo sapiens
  misc_feature: GYAE6OF02GEJMG.52.77.G11.1.454.CMB.1.raw
  modified_base (175)..(175): a, c, t, g, unknown or other
  misc_feature (175)..(175): n is a, c, g, or t
  modified_base (182)..(182): a, c, t, g, unknown or other
  misc_feature (182)..(182): n is a, c, g, or t
  modified_base (190)..(190): a, c, t, g, unknown or other
  misc_feature (190)..(190): n is a, c, g, or t
  modified_base (206)..(206): a, c, t, g, unknown or other
  misc_feature (206)..(206): n is a, c, g, or t
  modified_base (293)..(293): a, c, t, g, unknown or other
  misc_feature (293)..(293): n is a, c, g, or t
  modified_base (325)..(325): a, c, t, g, unknown or other
  misc_feature (325)..(325): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttggctgagctgggttttctcgttgctctttaagagtntccagtntcaggtgnagctggtggacgtcgngggggagcgtcggtcaggtccgtgggcggtcctgacgtactctccgtgtcgcgacgtcctccgtggtacttactaccttcgacgttntccgttagtcgactagtgctacgtcgggtccncgacggcctacgagggcggaacggggtcggtgggtaaggttcgggggcggtacgtaagggttaacttagtacccgtaaagttacgttaaggtaacggttaaagggtaaacggttaaaagtaaacggtttaaaccttacttaaagtacgtaacgtaacgttacccgtaccggttacgggtaaacggggtacccctaccgttacccgtaacccgttaacgttttaaaccggaacggtaacccgtaaacgtaaaacccgttaaccgaaaacggaaaccgtaccggtacctaccgttttaagtttacgaaacgttaacgtacgtaaacgaaccgtaccgtaagaactcggacggtacgacggtacgtcggtacgtgttacttacggttactaggtcgtaacgttaactaagtccgtaacgggaaccgacgttaacccggg

SEQ ID NO: 49523 - DNA, 905 bp, Homo sapiens
  misc_feature: GYAE6OF02IDC0I.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcacatggagtttgggctgagcttgggttttcctcgttgcttcttttaaggaggtgtcctaggtgtcgagggtgctagtcgttagggtggacggttcggtagggggggaggtcggtcgggtacccaacgggtcccggttagggggtaccgggttcccccgtgggtaaccggtaccttccgttccgtaggttacggctacgtccgttcgttcggtacgtttaccgtacccgtttacgtacggtttggttacccttaggttacgaccaaggtttccggacctaaccggggttaccggggttcccccggtaccggaaccgggtccccgtacccggggtacggggaaccggggtaaccgggggggtaccgttggggggtaccgggttagggggaccggtaacgttaaggtttaccgtaaaggttcctaagttaaggttacgggaatttaacgggggtaaaagtttaacgtaagtttaacgtttaacgtggttaaccgaaccggaccgttaaccggtaccgggtaagggtaacccgggtaccgtaacgtttaccacctttaacgttacccgaaacgggtacgtaaaccctaaccggtaaccaaacccggtaccgtacggttacttaagttaacggtttacgaaaaccgttaaagtccgaaaccgtacgtccgaacgtacggtaacgtgtaccgggaacgtcgaccgggttacgttacggttatttacggttctacggtagacccgttaacgttacgaacggtacggaaccggtactaaccccggg

SEQ ID NO: 49524 - DNA, 766 bp, Homo sapiens
  misc_feature: GYAE6OF02GW5LA.52.77.G11.1.454.CMB.1.raw
  modified_base (257)..(257): a, c, t, g, unknown or other
  misc_feature (257)..(257): n is a, c, g, or t
  modified_base (277)..(277): a, c, t, g, unknown or other
  misc_feature (277)..(277): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgctcttttaaggaggtgtccagtgtcaggtgcagctggtggagtcggtgggggagcgtggtccagccgtgggacgtccctgacgactctctgngcagcctgtgattcaccttnagtgtctatgactatgcctacgttcgggtacccgccgtagggcccttaccggacgggaccgtaaggggggcctaggggtacggttcggggtcggtccttaaagggttttactaacgttacgtaatttaggtagttaaaggttagggtaaaaacggtaagtaactttaacgtttaacctaaggtacgtaaccgtaacgtaacccggtttaccgggtaaagggtaaccggggacccgtaacgttacccgtaaccgttactttaacccgaagtaccgaaaccgtaacttaaacccgaaacaaccgtaacgttcgtttaacgttacgtttacgaacgtaaaacgttacgaaaccgtacggtaccgttaacgaggtaacgcgtaggaaccgggaccgtaacggtcgttaagggttactttaacgtccggttagtaaccggtaaccgttaaacgtttaccgtaaccggaacggggtaccgtaccgtaaccccggg

SEQ ID NO: 49525 - DNA, 824 bp, Homo sapiens
  misc_feature: GYAE6OF02GDLIT.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgcttcttttaaggaggtgtccagtgtcaggtgcgagcgtggtgagtcgtggggagcgtggccagcgtgggacgtccctggacgactctcctgtacgcacgcctctaggacttccacttcgagttgtactatgacatcgcgacgtcgggcccgccgaggtccctacgaggaccggtaaggggcgtacgggtaggttcggggttagaccgttaaggttacgtacttacgtaagttacgtaggtaagtttaacgggaaaaggttaaacgtacttaaagtaaaccgttacgtacggactaacggtaccgtttacccgggtaagggtaaacccggggtacccgtttaacggttcccgtaaaccgtttaacccgttttaaaccggaaacgggtaacccgttaaacccgtaaaccgttaaacccgaaaacgttaaacccggttaaccgtaccgtttaaggtttaacgttttacgaaaccgttaaagtaaccggtaacgtaacccgtaccgtaagggtaaccgaacggttaccgtaacggggaacgtaccggtacgggtacgtttaacgggttacgttaacggtttacggtacgtttaaccgtaacccgtttaaaggttaacccgttacgggtaacccggggtaacggtaaccccggttaaccccgggg

SEQ ID NO: 49526 - DNA, 895 bp, Homo sapiens
  misc_feature: GYAE6OF02GKA19.52.77.G11.1.454.CMB.1.raw
  modified_base (195)..(195): a, c, t, g, unknown or other
  misc_feature (195)..(195): n is a, c, g, or t
  modified_base (287)..(287): a, c, t, g, unknown or other
  misc_feature (287)..(287): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgcttcttttaagaggtgtccagttgtcaggtncagctggtggagtcgtggggggagcgtggtccaggccgtggggacgtccctgacgactctccgtgtgcacgcctcgtggtacttctaccttnagtgttctatcgactatcgacctacggtcggggtaccccgccgtacgggtccttacccggaacggggaccggtaacgggggggtacttggggggtaaggggttcggggggttcgggtacgttaagtttaacgtttaacgtaccggttaaatttaacgggttggttaaagggtttaacggggtaaaaaggttaaaaacggttaaacgtttaaagtttaaaccgtttaaaggtcggtaaccgtaaacggttacccgggttaaccggttaaggggaaacccggggtaccggttaaccgtttacccgtaaaccccgttaaccgttttacccgaaacggtaaaccgtaaccctaaaacccgttaacccgaaaacggtaaacccgtaaccgggttaccgtttaacggtttaacgttttacggaaaccgttaaaacgtaacggtaaaccaaccggtaccgtaagggtaaacggacggtaccggtacgggtaacgggtaccgtaccgggtaccggttcggtttagtttaacggttaccgttaggttaaccggtaacggttaaaccgtttaacggtaacccggtaaccgggtaacgggtacccggtaaaccccgggg

SEQ ID NO: 49527 - DNA, 731 bp, Homo sapiens
  misc_feature: GYAE6OF02H0M10.52.77.G11.1.454.CMB.1.raw
  modified_base (159)..(159): a, c, t, g, unknown or other
  misc_feature (159)..(159): n is a, c, g, or t
  modified_base (182)..(182): a, c, t, g, unknown or other
  misc_feature (182)..(182): n is a, c, g, or t
tcagcgcagtacgacacgaccggtgctcgatttagctagtcactcaaagggaaagggggggagaggagcccagcactagaagtcggcggtgtttccattcggtgatcagcactgaacacagaggactcaccatggagtttgggctgagctggttttccncgttgctacttttaagaggggtntccagtgtcaggtgcagctggtggagtcgtggggagcgtggtccagccgtgggacgtcctgagacctctccgtgtcgcagcctgtagtacttaccaccgtttgagtgttactagtcgactacgttgaccgtacggttcggtacccgaccgtacggcctaaccggaggaccggtaaggggtctaggggacgtttggggacgtacgtaacgttatagcgtaagttagtgacgttaggtaaaacgtaatacttaagtacttaagtaccgtacgaacggttaccgtaccggtaggaacggtaccgtaacttaccgtacttaaccgtttacgaacgtaacgtaacctaaccctaaaccgaaacgtaaccgtaccgtacttacgtacgtttaacgaacgtaaacgtacgtaaccgtacgaacgttacggtagaacggtcgtaagggaaccgtaccggacgttacggttacgttaacgtttacggttacgttaggtacgttaacgttaaccgtttaaccggtaacggtaacgggtaccgtaaccgggttaacccgg

SEQ ID NO: 49528 - DNA, 886 bp, Homo sapiens
  misc_feature: GYAE6OF02GHV8X.52.77.G11.1.454.CMB.1.raw
  modified_base (317)..(317): a, c, t, g, unknown or other
  misc_feature (317)..(317): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccagtggagtttgggctgacgtcgttgggttttccttcgttgtcttacgttttaagaggttcgtccgtaggttgtcgtagggtgacgagtcgtgggtggtacggtcggtggggggacggtcggttcgggtccgaggtcccgtaggggtaccggttcccgtaggacgtacctccgttccgtggtcgtacncgtcccgttcgtggtacttccgtaccgttttacgaggtttccggttactacgtaggtaaccttacggtcgtacccgtacggttccggggtaccccggtcccgtacggggtcccttacccggtaggggaaccgggttaacggggggtcgtcgggttaacggggttcggggttacggggtaacgttaaaggttagtactcgtaacgtttaggtaagtagggtaagggttaaaaggttaacgtaaacttagttaaccgttaacgccggtaagtaacgttacccggtttacccgggaggtaaacccgggtcttaaacccggttacctaaaccgtttacggttaccggaaacgtaaccgtaaccgaaaccgttaaacccgaaacgaaccggtacccttaggtttatttaaccgtaacggtaaactaccggtaagtaaaccgcggtaccggtaggaaccgaggtaccgaaggggtaaccgtagttccgttaacgggtgtttacgtaacggtttcgttaaggaccgttaacgttaacgtacggaccggttaaacggacccggtaggtaaaccccgg

SEQ ID NO: 49529 - DNA, 826 bp, Homo sapiens
  misc_feature: GYAE6OF02H5WVH.52.77.G11.1.454.CMB.1.raw
  modified_base (177)..(177): a, c, t, g, unknown or other
  misc_feature (177)..(177): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagtcttgggttttcctcgttgctcttttaagnggtgtcagtgtcaggtgcagctggtggagtcgtgggggaggcgtggtccagccgtgggacggtccctgagactcctcctgtcgcagcctcgtgtacttccacctttcgagttcgtacttagtagactagttacgacctaccggttcgggtcccgacccgtaggtccctacggacggccggaaacggggggtcgtacggggaggggttgggggtacggacttaaggttaacgtactttacgtaaagtagttacggaaggtttaaagggaaaaggtttaaaagtaacgtttaaacgttaacttaggtacgtaaccgtaacggttaacccgtttacccggggtaagggtaaaacccggggtcccgttaactttacccgtaaacctttaaccgttttaacccgaaaccggtagtaaaaccccgttaaaccgttaaaccccgaaaaaggtaacccgtaaccgttaacgttaacggttttaactttaacggttaaacctaaaacggttaacggtaaaaccgtacggtacccgtttaagggaaccggaacggtacgttaaggaaccggtacggacggttccgtaggttacgttaagttaccgtagttaccgtaacttaacgtaaccgtaccggacgggtaccggacgtaacccggg

SEQ ID NO: 49530 - DNA, 683 bp, Homo sapiens
  misc_feature: GYAE6OF02JGUJ9.52.77.G11.1.454.CMB.1.raw
  modified_base (200)..(200): a, c, t, g, unknown or other
  misc_feature (200)..(200): n is a, c, g, or t
  modified_base (207)..(207): a, c, t, g, unknown or other
  misc_feature (207)..(207): n is a, c, g, or t
  modified_base (290)..(290): a, c, t, g, unknown or other
  misc_feature (290)..(290): n is a, c, g, or t
  modified_base (305)..(305): a, c, t, g, unknown or other
  misc_feature (305)..(305): n is a, c, g, or t
tcagcgcagtacgacacgaccggtgctcgatttagctagtcactcaagggaaagggggagaggagcccagcactagaagtcggcggtgttccattcggtgatcagcactgaacacagaggactcaccgatggatttgggcttgagctgggttttccctcgttgcttcttttaagaggtgtccagtgtcagtgcagctggngagtcgnggggacgcgtcggtcacgacctggggtacgtccctggacgctccgtccgttgcgcgaagtcctacgttggacttctacccttnaaggttcgtcttaanccggtaatgtaccgtacgacgttcgggtcccacgaggtcctaccgaggtaccgaaggggtctagggtcgtacggtggtacctagttaactcgtaccaagtcgttaggagtacggtaaacgtatacgtagttacgtagtcgacgtaagtaccgttaccggtacggtaacggtccgtaacgtacctaaccgtacgtttacgacgaacgtaccgtaaccgtaccgtaaactaccgacgtactcgtttaaccgttacgacgtaaattcggaaactccgtaactacgtacgacgtaccgtagacgaccggtagtacgttcggtacgtacgttacgcggtaacgtaggttactaccgacggtaaccgacgtaacggtaacccgg

SEQ ID NO: 49531 - DNA, 654 bp, Homo sapiens
  misc_feature: GYAE6OF02JQ0OO.52.77.G11.1.454.CMB.1.raw
  modified_base (256)..(256): a, c, t, g, unknown or other
  misc_feature (256)..(256): n is a, c, g, or t
  modified_base (264)..(264): a, c, t, g, unknown or other
  misc_feature (264)..(264): n is a, c, g, or t
  modified_base (276)..(276): a, c, t, g, unknown or other
  misc_feature (276)..(276): n is a, c, g, or t
  modified_base (307)..(307): a, c, t, g, unknown or other
  misc_feature (307)..(307): n is a, c, g, or t
  modified_base (354)..(354): a, c, t, g, unknown or other
  misc_feature (354)..(354): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatgggagtttgggctgagcttgggttttcctcgttgcttcttttaaggaggtgtccagtgtcaggtgcagcgtggtggagtcgtgggggagcgtggtccagcgtgggacgtcctgacgctctctgngcagcctntgtactcacttnagtgtctatgactatcgctacggtcggtccncgagtcctaccgaggccgaggggctagggtggtgggtgcgtagttanagtactagtatgtagtagtaacgtaagtactatactagtcgctaagtcgtacggtacggaacgtccgtaattacccgtacttacgttaccgaacgtaacgaaccttaacctacccgaaagtaaccgtaccgacgttaacgttacgtttaacgaaacctaaagtacgtaaaccgacgtaccgtaggacgacgtacggtacggaaccggacgtacggtacgttggttacgttaacgttacgttaggtaaccgttacgtaaacttacggaacccggtaagggacccggtaacgtaaccccggg

SEQ ID NO: 49532 - DNA, 796 bp, Homo sapiens
  misc_feature: GYAE6OF02FN615.52.77.G11.1.454.CMB.1.raw
  modified_base (267)..(267): a, c, t, g, unknown or other
  misc_feature (267)..(267): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggtttttcctcgttgctcttttaagaggtgtccagtgtcaggtgcagctgggtggagtcgtgggggaggcgtggtccaggtccgtgggacggttccctggagaccttctccgtgtcnctacgccctgtggacttcctaccttcgaagttcgtactagtcgactagtcgctacggttcgggtcccaccgaggcccgtacgagggcgtaaacgggggctagggacggtgggtcggtactaggtttaacagtacgtaagttacggtggtaagtaacgggtaaaagtaacgttaagtaacgttaacttacgagaaccccgttaaagtccccggttcgggttaaacgggtaaccgggtaaccggttaaccgttaaccctaacccgtttaaccgtttaccggtaaaggtaacccggtaaaccctaaaccgttaaacccggaaaaccgtaaaccgtaccgttaaccgttacgtttaacgttaacgtaaccgttaaacgtaaccgaaacgtaccgtacgtaacggaacgtacgtaacgtacggaacgggtaccgtacgggtacgttaacggttcggtttaaccgttacgttaggttaccggttaacgtaaccgtttaacgacggtaaccggtaaccggtaaccggtaaccccgg

SEQ ID NO: 49533 - DNA, 546 bp, Homo sapiens
  misc_feature: GYAE6OF02ION94.52.77.G11.1.454.CMB.1.raw
  modified_base (437)..(437): a, c, t, g, unknown or other
  misc_feature (437)..(437): n is a, c, g, or t
  modified_base (446)..(446): a, c, t, g, unknown or other
  misc_feature (446)..(446): n is a, c, g, or t
  modified_base (451)..(451): a, c, t, g, unknown or other
  misc_feature (451)..(451): n is a, c, g, or t
  modified_base (454)..(454): a, c, t, g, unknown or other
  misc_feature (454)..(454): n is a, c, g, or t
  modified_base (459)..(459): a, c, t, g, unknown or other
  misc_feature (459)..(459): n is a, c, g, or t
  modified_base (461)..(461): a, c, t, g, unknown or other
  misc_feature (461)..(461): n is a, c, g, or t
  modified_base (463)..(463): a, c, t, g, unknown or other
  misc_feature (463)..(463): n is a, c, g, or t
  modified_base (468)..(469): a, c, t, g, unknown or other
  misc_feature (468)..(469): n is a, c, g, or t
  modified_base (472)..(472): a, c, t, g, unknown or other
  misc_feature (472)..(472): n is a, c, g, or t
  modified_base (485)..(485): a, c, t, g, unknown or other
  misc_feature (485)..(485): n is a, c, g, or t
  modified_base (493)..(493): a, c, t, g, unknown or other
  misc_feature (493)..(493): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
  modified_base (502)..(502): a, c, t, g, unknown or other
  misc_feature (502)..(502): n is a, c, g, or t
  modified_base (504)..(504): a, c, t, g, unknown or other
  misc_feature (504)..(504): n is a, c, g, or t
  modified_base (509)..(509): a, c, t, g, unknown or other
  misc_feature (509)..(509): n is a, c, g, or t
  modified_base (519)..(519): a, c, t, g, unknown or other
  misc_feature (519)..(519): n is a, c, g, or t
  modified_base (525)..(526): a, c, t, g, unknown or other
  misc_feature (525)..(526): n is a, c, g, or t
  modified_base (529)..(529): a, c, t, g, unknown or other
  misc_feature (529)..(529): n is a, c, g, or t
  modified_base (531)..(531): a, c, t, g, unknown or other
  misc_feature (531)..(531): n is a, c, g, or t
  modified_base (538)..(538): a, c, t, g, unknown or other
  misc_feature (538)..(538): n is a, c, g, or t
  modified_base (543)..(544): a, c, t, g, unknown or other
  misc_feature (543)..(544): n is a, c, g, or t
tcagcgcagtacgacacgaccggtgctcgattttagctagtcactcaagggaaagggccgattcaccatttccagagacaactccaagaacacgctgtatttgcaaatgaacagcctgagagctgaggacacggctgtgtattactgtgcgaacttaatcacggaggacacggtcgacccccgccgctcggtgcggacgtcgtcgggccaaggggaccacggtcagccgtctcctcgacgccctccaaccgaacggccctacgtccggtccttcccccgtcggaccacccctcctacgaacgcgccaccgtcggtcgggggcaacgacggccggacccgtcgggcctcgccgttacggtacgaacggtccttacttccgaagttacgacgttccgacgtaggcggtcggggctcggacgaaccggcgaccgagtagncgctcacgntacgnacncgacncngngctgnngcncgctgcgactacncgatgacncgcgncngngngcacncacagtgcgnacgtgnncgngnacgcgcngagcnntc

SEQ ID NO: 49534 - DNA, 755 bp, Homo sapiens
  misc_feature: GYAE6OF02ICKCJ.52.77.G11.1.454.CMB.1.raw
  modified_base (146)..(146): a, c, t, g, unknown or other
  misc_feature (146)..(146): n is a, c, g, or t
  modified_base (177)..(177): a, c, t, g, unknown or other
  misc_feature (177)..(177): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgngcttgggttttcctgttgcttcttttaaggnggtgtccagtgtcgagggtgcgagcgtgggtggtaggttcggtgggggacggcggtacggtccgaggtcccggtggggaccggtccctggacgtaccttccgtaccgtggtcgccgacgtcccttgtacggttacttcccgtaacgttaccgtagttcgtacgttaagtcgtaactacgttccggcgtaccggtccgggtcccgaccgcggtcccgtaccggagggacggaacgggggtcgtaggggtacggtaggggtacgacgttaacgtttaagtactacgtaagttaacgtaggtaataagggtaaaagttaagttacgtaagtacgtcgtacgacgtaccgtacggtacgggtacggtaccgtactaaccgtactaaccttcgtaacgaacgtaactaactaaccgaacgtaacgtacgtacgttagttataacgtactaaaggaactactacgaacgttcgaagtacggacgtaggacgaacgtacggtgttagtgttaacgtagtcccggtaatacccggttaactaacgggttacgacccgggtaacggtacccgtacccggtacccggg

SEQ ID NO: 49535 - DNA, 817 bp, Homo sapiens
  misc_feature: GYAE6OF02IFL4H.52.77.G11.1.454.CMB.1.raw
  modified_base (355)..(355): a, c, t, g, unknown or other
  misc_feature (355)..(355): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggacctcaccatggagtttgggctgacgccgttagggttttcctcgttgccttcttttaaaggcggttcgtccagtgtcgaggtgcagtcgtgggtgaggtcggtggggacggtcgttgggtccaggtccgtcggggtacgtccctagacgtacctctcgtgtcgacgtcgtctcggtaggtacttacccacttcgtaggtctacgtatggaactgtcacgtcggtcggtaccncgtacgcctacggtacggacggacggggtcgtagggtacgggttcggggcgtagttaagttaacgtacgtacgtagttggtacgtaaggtaacgggaaagttaagtacttaacgttaaagtcggtacggaactacggttaaccggtaccgggtacgggtaaacccggtcgttaaccgttaacctaccctttaaccggtacctaaacgggtacgtaaaccctaaccgaaccggtaaaaccgtacgtaccccgttagtaaccggtttacgttaactaacgggtaaaactacgaacccgtaccggaacgttaccggaagtaacggccggtaacgggacccgttaacgaccggtttctaaacgggttacggttaacccggttgtaacggtaacccgtttaaccggttaaaccggtaaccggttacccggaaacccgggttaccggtaacccggttaaaccccgggg

SEQ ID NO: 49536 - DNA, 909 bp, Homo sapiens
  misc_feature: GYAE6OF02GUAQA.52.77.G11.1.454.CMB.1.raw
  modified_base (485)..(485): a, c, t, g, unknown or other
  misc_feature (485)..(485): n is a, c, g, or t
tcagcgcagtacgacacgaccggtgctcgatttagctagtcactcaagggaaaggggggggagaggagcccagcactagaagtcggcggtgtttccattcggtgatcagcactgaacacagaggactcaccatcggagtttgggctgagcgttcgggttttcctcggttgccttcgttttaaaggagggtcttccaaggttcgttacgacgggttcgacaggccttaggggtggacgttcggaggggggtacgtcggttggtcccaggcccgttggggaccggtcccttagacgtaccgttacctcccgtggtacacgtacgtcccgttctacgggtaacttccttacccttgaacggtttcggttaccttacgtacggtaactcgtagccctaacgggtccggggtaccccaccggcggtacctccggacggggtacggtaacggtggtacgggttgggacggggtcacgtagttaacgttacncgtaacgtgttacggaagtggaaaaggtaactagtaactacgtacggttacgtacccgaagtacccgttaggaacccggggtagggtaccccttaaaccgtacccgtaaccggttaactttacccgggaaggtaaaccggaccccttaaaaccggttaacccgtaaaacgggtaaccctaccggttacccgttaaacggttttagttaaaccggtaaccgttaaaaaccgggttcggaaaacccgttttacggtaacccgggtttagaaaccgggttcctaaagggtccggaacccggttaccggttacgttacgtttacggttaacgggtttaaccgtttacggttaccgggtaaccgttaacctttaagttaacccgggtaacccggaacgggttaccccggaaacccggtttaccccgggg

SEQ ID NO: 49537 - DNA, 723 bp, Homo sapiens
  misc_feature: GYAE6OF02GC04M.52.77.G11.1.454.CMB.1.raw
  modified_base (424)..(424): a, c, t, g, unknown or other
  misc_feature (424)..(424): n is a, c, g, or t
tcagcgcagtacgacacgaccggtgctcgatttagctagtcactcaagggaaaggggggagaggagcccagcactagaagtcggcggtgtttccattcggtgatcagcactgaacacagaggactcaccatggagtttgggctgagctgggttttcctcgttgctcgttttaagaggtgtccagtgtcaggtgcagctggtggagtcgtggggagcgtggtccagccgtgggacgtccctggacgtacctcttccgtggtgaccacgccctcgtggactttccaccctttgaggttcgtctaagtcgactatcgacctacggtcgggtcccgccgaacggtccctacgacggacgaaggggtctgggaggtggggtcgacttaaggttactatcgaatttagtagaagttagggtaaacgtaanacttagtaactagtcgacagtaccgttcggtaggaacggtcgtacttacccgaacttacttaccgaagtaacgaaccctaaacctaacgaaacacctacggtcttacggtttattacgaaacgtaaacgtaacgaaaccgtaggtaccgttaacgggaagtaccgtaggtacgggaaccgggtacctacggggttaccttaagggttacgtttaacgttaacggttcggtaaccggttaacgttaaccgtttaaacggaccggtaacgggtaaccggggtaacccttaacccccggggg

SEQ ID NO: 49538 - DNA, 722 bp, Homo sapiens
  misc_feature: GYAE6OF02HRIV8.52.77.G11.1.454.CMB.1.raw
  modified_base (158)..(158): a, c, t, g, unknown or other
  misc_feature (158)..(158): n is a, c, g, or t
  modified_base (176)..(176): a, c, t, g, unknown or other
  misc_feature (176)..(176): n is a, c, g, or t
  modified_base (193)..(193): a, c, t, g, unknown or other
  misc_feature (193)..(193): n is a, c, g, or t
  modified_base (207)..(207): a, c, t, g, unknown or other
  misc_feature (207)..(207): n is a, c, g, or t
  modified_base (248)..(248): a, c, t, g, unknown or other
  misc_feature (248)..(248): n is a, c, g, or t
  modified_base (258)..(258): a, c, t, g, unknown or other
  misc_feature (258)..(258): n is a, c, g, or t
  modified_base (268)..(268): a, c, t, g, unknown or other
  misc_feature (268)..(268): n is a, c, g, or t
  modified_base (621)..(621): a, c, t, g, unknown or other
  misc_feature (621)..(621): n is a, c, g, or t
  modified_base (639)..(639): a, c, t, g, unknown or other
  misc_feature (639)..(639): n is a, c, g, or t
tcagcgcagtacgacacgaccggtgctcgatttagctagtcactcaagggaaggggggagaggagcccagcactagaagtcggcggtgtttccgattcggtgatcagcatgaacacagaggactcgaccatggacgtttggctgagcttgggtttccncgttagcttcttttaagngtgtccagtgtcaggtncagcgtgggtaggngtcggtagggggagcgtggtccagccgttgggacgttcccnggactacctntcctgtgacncggccttgtggtactttcccgaccttcgaagttcgtactagtcgaactgtcgactacgttccggggtccaccgtacggccttaccggaggacgggaacggggtctaggggtacgtcgggtcggacctagtttaacgacttcggtataggttaggacgttaagggaaaagttaagtaacttagtttaaaccgtagtacggacgtaaacgtaccgttacggtaacggaacgggtacccgtaacttccgtaaccgttacgttaacccgaggtaacgaaccctaacgtaccgaaaacgtaccgtaccgtcgttagttaacgttcgaaacaacgttagaaccctagcgttagaaccgngtcgtacgaacggaccgnggtaccgtggtaacgttaacttacggttacggcgtaacggtttacttaaccggaggtaaacccggacggtaaccggtacccgg

SEQ ID NO: 49539 - DNA, 923 bp, Homo sapiens
  misc_feature: GYAE6OF02FZKLH.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaaccatggagtttgggctgacgcgttggggtttttcctcggtttgccgttacgttttttaaggacgggttcgtccgtaaggttcggttacgacgggtgccgtaaggtccgttggggttagggaacggttccgggtacgggggggggtaagggtaccggtttcgggttcccgaacgggtcccggttaggggggtaccggttccccttaggaaccggtaccttccgttcccgttggtcgccgtacgggttcctttcggttcgggttaacctttcctaacccttttcggtagttccgtttacgtaacgttcgtaaccgtttaagtcggaccgttaacccggggtcggggttaccccggaccggttaaccgggtcccttaacgggggaaccgggtacccggggttaaggggtcccgggttgggggtaacgggggttccggggttggaaccggtttaaggtttaacgttacgtaagtcgtttaactaaggtaaccgtttaaggggaaaagttaacttaacgttaacttaacgtaaggttacgaacccggttgtacccggtaccggtaacgggtacggcccgttaacgtacccgttaacgttaccgttaccgaaaggtacctaacgtaaccctaaaccggaaccgttaaccgaccggtacgtttaacgtttacgttacgtaacggtaactcgaacccggttaccaggttcgagttacgacgtacgacgtaggcgtaggttcgttattacgttgtacgtcggtaactaaccggtgtaaccggcgggtaacgacggtaacccgg

SEQ ID NO: 49540 - DNA, 708 bp, Homo sapiens
  misc_feature: GYAE6OF02HCE08.52.77.G11.1.454.CMB.1.raw
  modified_base (156)..(156): a, c, t, g, unknown or other
  misc_feature (156)..(156): n is a, c, g, or t
  modified_base (161)..(161): a, c, t, g, unknown or other
  misc_feature (161)..(161): n is a, c, g, or t
  modified_base (258)..(258): a, c, t, g, unknown or other
  misc_feature (258)..(258): n is a, c, g, or t
  modified_base (264)..(264): a, c, t, g, unknown or other
  misc_feature (264)..(264): n is a, c, g, or t
tcagcgcagtacgacacgaccggtgctcgatttagctagtcactcaagggaaagggggggagaggagcccagcactagaagtcggcggtgtttccattcgtgatcagcactgaacacagaggactcaccatggagtttggctgagctgggtttccncgttnctcttttaagaggtgtccagtgtcaggtgcagcgtggtgagtcgtgggggagtccggtggtacagccgtgggacggtccctgagactctcctgtgcncgcctntaggtacttacacctttcgagttcgtctagtgaactgtcgacctacggtcgggtcccctaccgagggccctaccggagggtaccgaaggggtctagggggtacggttcggggtcgacgttaaggttactcgtaccgtaattaggtcgtagtaaggaaacggttaaagtataacgtaacgtagttcgacgtgaaccgttcgtaacgggaccgggtacgtacttacccacctacgtttacccgaagtaaccgaacctaaccgtaaccgaaaccgtaaaccgaccgttacgtacgtttagtttacgaactaaacggtacgtaaactacggaccgttagacggtacctacggttacggaccggacgtaccgggtctagggttacttacgttacgtacggttacgtaacgttaacttaccgacgaacgggttaccgaaccgtacccggg

SEQ ID NO: 49541 - DNA, 808 bp, Homo sapiens
  misc_feature: GYAE6OF02FK91B.52.77.G11.1.454.CMB.1.raw
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgcttcttttaagaggtgtccagtgtcgaggtgcagcgtggtggagtcggtgggggaggcgtggtccaggtccgtggggacggttcccctaggacgtaccgtccttccgtaggtcgaccgacggtccttacggtggtactttcccgaacccgtttcgagttcgttccgtaagtcggaacctagtcgaccgtaccggtcggggtcccgaccgtagggtccctaccggaacgggtacggtaaacggggggtccttagggggacgggtttacggggtcgggtacctaaggtttaacgtcgttaacaaggtttagtacggtaagggttaacggggaaaagttaaggtaaactttaacgttaacttacggttgaaccggtacggtaaccgttaccgggtaacgggtaaccgggtaccgttaacgttaccgtaacccgttacgtttaccggaacgtaacgtaaccgtaaccgttaaccgaaacgtaaccgaccgttacgttacgttagtttacgaacgtaacgtaaccgtaaacgtacgtacgtagacgtaacgcggtaacggacggacgtacgtacgtacgttaacgttaccgtaggttcgtaacgtacgtaacgttaacgaccggaacggtacggtaaccggtacccggg

SEQ ID NO: 49542 - DNA, 841 bp, Homo sapiens
  misc_feature: GYAE6OF02JIV8T.52.77.G11.1.454.CMB.1.raw
  modified_base (503)..(503): a, c, t, g, unknown or other
  misc_feature (503)..(503): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggtagtttgggctggagcttgggttttcctcggttgtccttactttttaagaggtcgttccgagttgtcagggtgcaggtcttgggtggtaggttcggtgggggggagtccggttcgggtccacggtccggttgggggtacggttccccgtaggtaacggtaccttccgttacccgtggtcggccgtaacggtcccttccgttagggtactttacccgtaacccctttgtaacggtttcggtccttaaagtcggtaactacgtcggaccgtacggtttccggggccccgtaccggtacggtccgtaaccggacgggtaccggaaacggggtcgtacgggacggggttggggtaggtaccttaaagggtttntaacgtacgtatacggtagacgggttaaagtaaacgggtaaatagttaacttaagtagtcgaacggtacgtcgtacggtacgggaacggtcccgttaactacctaacgtacttaccgaggtaaccgaacctaacccgtaagaaaccgaaccgtacgtacgttagttaacgttacgaataaactacgtaacaccggttacaaggactacggacgtaacgtaccggaaccgttcggacggttttacgtaacgtttaacggttactaggggtaacttaacccggttaaatttacccgggaacccgggtaaccgggttaacggtaacccggttaaccccggg

SEQ ID NO: 49543 - DNA, 862 bp, Homo sapiens
  misc_feature: GYAE6OF02FGRHQ.52.77.G11.1.454.CMB.1.raw
  modified_base (294)..(294): a, c, t, g, unknown or other
  misc_feature (294)..(294): n is a, c, g, or t
tcagcgcagtacgacacgaccggtgctcgatttagctagtcactcaagggaaaggggggagaggagcccagcactagaagtcggcggtgtttccagttcggtgatcagcactgaacacagaggactcaccatggagtttgggctgagcttgggtttttcctcgttgcttcttttaaggaggtgtccagtgtcgaggtgcagcgtggtggagtcgtgggggagcgtggtccagcgtgggacgtccctggacgactctccgtgtcgcacgtcctcgtggactttcgaacccgtttnaacggtttcgtacctaagtagacctgtcgaccgtacggttccgggtccccaccgacggtccctacccggaaggaccggtaacgggggtctaggggtagggttcggggttacggacttaaggtttaacgacgtttacgaagtttaggtacggttaaggtaaggtaaaacgttaaagaagtttaacccgtttaataacgttacggacctaggttacccgttacggtaacggacgggtaccgtacgttacctaaccgttacgtttaaccgaaggtaaccgtaacgtaaccgtaaaccgtaaaccggtaaaccgtaaccggtacgtttaaacggtttaccgttaacgttaaccgtaaaacgttaccggtaaaaccgtacgggtaacccgttaagggaacccggttaaagggtaacccgtaacgggtaaaccgggtacccgtaaccggggtacgtttaaacgggttacctttaacgggtttaaccggtttacggtaaccggttaaccggtttaaaccgttaaaccggttaacccggggtaaccggtaacccgggtaacggttaacccccgggg

SEQ ID NO: 49544 - DNA, 697 bp, Homo sapiens
  misc_feature: GYAE6OF02JPG2T.52.77.G11.1.454.CMB.1.raw
  modified_base (362)..(362): a, c, t, g, unknown or other
  misc_feature (362)..(362): n is a, c, g, or t
  modified_base (434)..(434): a, c, t, g, unknown or other
  misc_feature (434)..(434): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagctgggtttcctcgtgctctttaggagtgtccagtgtcaggtgcagtctgggtggagtcgtgggggaggcgtgggtcccaggcccgtggggacgttccccgtagacggaccttcctccgtgtggaccacggtcccttctagggtactttcccgaacccgttttcgaagttcggtactacgtcggaacctagtcgaccgtacggttcggggtccccnccgtaagggcccttacgacggtcgaacggggtctaggggtagtggggtcggtacagtttatatccaaggttnaggatacgggaaataaggtataacttactagtacgacgtaagtacccgtacggtaacggtaacgggacctacgtacctaaccgtacgttaccgaaggtaccgaacctaaccgtacgtaaacgaccgaacgttcttagtacgttacgaacgtaaagacgtacgtacgtaccgtagtacgtagtactaggacgtacgtaccggtgtacgtacgttaattcgtagtacgacgttaactacgtacgacggtacgtacgtaacccggg

SEQ ID NO: 49545 - DNA, 677 bp, Homo sapiens
  misc_feature: GYAE6OF02H0E1S.52.77.G11.1.454.CMB.1.raw
  modified_base (182)..(182): a, c, t, g, unknown or other
  misc_feature (182)..(182): n is a, c, g, or t
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (229)..(229): a, c, t, g, unknown or other
  misc_feature (229)..(229): n is a, c, g, or t
  modified_base (279)..(279): a, c, t, g, unknown or other
  misc_feature (279)..(279): n is a, c, g, or t
  modified_base (441)..(441): a, c, t, g, unknown or other
  misc_feature (441)..(441): n is a, c, g, or t
  modified_base (472)..(472): a, c, t, g, unknown or other
  misc_feature (472)..(472): n is a, c, g, or t
  modified_base (563)..(563): a, c, t, g, unknown or other
  misc_feature (563)..(563): n is a, c, g, or t
tcagcgcagtacgacacgaccggtgctcgatttagctagtcactcaagggaaaggggggagaggagcccagcactagaagtcggcgtgtttccattcggtgatcagcactgaacacagaggactcactagtggtagttggctgagtcttgggttttccctcgttgcttactttaaggaggtntccaggttgtcngggtnaccgngtgtgggtcgtaggtcggtgggggnggcgtggtccgagccggtgggtaccgtcctggactcctcctgtgtcgacngtcccgttgtacggctttccacgttgtcgttcgtcttagcgtacctagtcgtacgtcggtcgggtccacgcggtactccggaaggtaccggcggtcggtgggcgtgggttacgacgtattaaccggtatccgatacggtcgtaaggtacggaaaataagttnttaagttactcgaggtctacgtccgtacggnggtacggtaactcgtacctaacgttgttacgaagtaccgtacactaaccgtaagcgacttacgcttaagttcaagtaacctagtaaccgtnaaccgtggaactaccgttagacgaccgtacggtcgtacgtaaggttccgttaagacgttacgaaccggttactaacgttacgaccggtaacggcccggtaagtaaccccccggg

SEQ ID NO: 49546 - DNA, 793 bp, Homo sapiens
  misc_feature: GYAE6OF02JGZA9.52.77.G11.1.454.CMB.1.raw
tcagcgcagtacgacacgaccggtgctcgatttagctagtcactcaaggggaaagggggggagaggagcccagcactagaagtcggcggtgtttccattcggtgatcagcactgaacacagaggactcaccatggagtttgggctgagtcgttgggtttttcctcggttgcttacttttaaggaggtgtcctagtgtcgaggtgccagcgttggtggaggtcggtgggggacgcggttgggtccaggccgtggggtacggtcccgtggagtacctctccgtgtcgcgtaccggcctacgtggtacttacctacccgtttgtacgtcgtacttagtacgactacgtacgtcccgtaggtccgggtcccgtacgacggtcccgtgacggaccgggacggggcggtgggtagggtgggtacggcgtaagttactagtcgtagttacgtaggtaagtaaggaagtagtaacttaacttaagcgtacggacctacggtacccgtacggaccgggtaacggtcccgttacgtaccgtacctttaacgttacccggaacgtaaaccgaaccgtaacccgtaaccgtaaacgtaacccgtaaccgttaccgtttaagttaaccgtttaacggaaccgttaaagtacccgaaacgttaccggacgttaacgggtaacgtacgtaccggtaggaaccgaccgtcgggttaacgttcggtttaacgtagtttaccggttagtacccgttaaggtaaccgttaacggtaccggtaaccggtaccgggtaaccggtaacccccggg

SEQ ID NO: 49547 - DNA, 876 bp, Homo sapiens
  misc_feature: GYAE6OF02GB2I5.52.77.G11.1.454.CMB.1.raw
  modified_base (274)..(274): a, c, t, g, unknown or other
  misc_feature (274)..(274): n is a, c, g, or t
  modified_base (821)..(821): a, c, t, g, unknown or other
  misc_feature (821)..(821): n is a, c, g, or t
tcagcgcagtacgacacgaccggtgctcgatttagctagtcactcaagggaaaggggggagaggagcccagcactagaagtcggcggtgtttccattcggtgatcagtcactgaacacagaggactcaccatggagtttgggctgagcttgggttttcctcgttgcttcgttttaacgtaggtgtcctaggtgtcgaggtgcagtcgtgggtggtagtcggtggggggtacggcggttcggtaccgtacggtccggtgggggacggttccccgnggtacgtacctccgttccgttcggttagccgtacgttcccgtacgttacggggttacttaccgtacccttaccggtacgggtttacgtttaccttagttaccgtaacgtacgttcggtaaccgttccgggtttaccggggtaccccgtaccgtaacgggtacccgtacccggtaaacgggtacccgggtaaacggggtccggttacggggtagggtaggggttccggtacgttaacgttaagttactaccggtattaaggtacgtaaggtacggttaaaagggtaattaacggttaactaacgttacggtacgtaaccggtacgtacccggggttaacggttacgggggaaaccggttaccggtacgtttaacccgggaaccttttaccggtaaccggtaacgtaaccgtaacccgtaaacgttaaaccccgaaacggtaaccccgtacggttaacccgtttacggtttattaacggaaacgttaaccggacgtaaaccgtcggtaccgttaggacgtacggtagccgtaagaccgtagacggtttntaggttacctagtcgtacgttaacgtacgtacgtaggtacgagtacccggtaccg

SEQ ID NO: 49548 - DNA, 846 bp, Homo sapiens
  misc_feature: GYAE6OF02G9HKK.52.77.G11.1.454.CMB.1.raw
  modified_base (197)..(197): a, c, t, g, unknown or other
  misc_feature (197)..(197): n is a, c, g, or t
  modified_base (268)..(268): a, c, t, g, unknown or other
  misc_feature (268)..(268): n is a, c, g, or t
tcagcgcagtacgacacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgcttacttttaagaggtgtccagttgtcaggtncagtcgtggtggagtcgtgggggagcgtggtcagccgtgggacggtccctggacgtactccgtcgtggtcncgacgccgtcgtggtacttaccgacctttcgtagttcgtccttagtcgactagttggaccctacgggttccgggtcccctaccggtacggtcccgttaaccgggaacggggtaaccggaacggggggtccgttacgggggtacgggtttcggggggtacgtaaccgttaaggttttaacgaacttaccgtaaagttacgtaggaacgtttaacgggaaaaggttaagtaatttaacgtaaaccgttagtaccggtaccgtaaacggttacccgtaccgggtacgggtaaacccgggtaccgtacgttaacccgaacccgttacgttacccgtaacgtaacgtaacctaaaccggtaacccgaaacgtaacccgtaacggtacccgtttagtttaaccgttaacgtaaacctaaacgttaacgaacgtaacgtaccggtaagtaacggtaacgtacgtaacggaaccggtacggaaccggtacgttacggttacgtttaacgttaaccgttagttaccggttaacgttaaccgtttaacgtacccggtaacgggtaaccggtaacccggtaacccgggg

SEQ ID NO: 49549 - DNA, 678 bp, Homo sapiens
  misc_feature: GYAE6OF02JZAIX.52.77.G11.1.454.CMB.1.raw
  modified_base (279)..(279): a, c, t, g, unknown or other
  misc_feature (279)..(279): n is a, c, g, or t
  modified_base (418)..(418): a, c, t, g, unknown or other
  misc_feature (418)..(418): n is a, c, g, or t
  modified_base (670)..(670): a, c, t, g, unknown or other
  misc_feature (670)..(670): n is a, c, g, or t
tcagcgcagtacgacacgaccggtgctcgatttagctagtcactcaaggggaaaggggggggagaggagcccagcactagaagtcggcggtgttccattcggtgatcagcactgaacacagaggactcacatggagttgggctgagcttgggtttcctcgttgctctttaagagtgtccagtgtcgaggtgcagtcttgggtggacgttcggtaggggggagtcggtcgggtaccacggccgttaggggaccggtccctggacgtacctcgtccttggngacacgccttcggtacggtacttcgaccttcgagtgtacctatgtaacctaggtactcctacggtccgggaccgacccgtaggccctacggaacgggacggaacggggtcgagggtagggtgggtaggtactagttaanagtcagtagtagaattacgggaaataagtactaaggttactaagtcgacgttacgacgtaccggtaggaccggtactacggtaccacgtaacttacgaaggtaactaaccaacaacgtaaacaacgtccgtattacgtaggttaccgaataagtaacgacgactcgaagcgaaagccgtagaccgagtcgacgttggtaacctatacggtacgtacggaaacttacggtacctaaggtaccggaacggttanaaccccgg

SEQ ID NO: 49550 - DNA, 919 bp, Homo sapiens
  misc_feature: GYAE6OF02H900R.52.77.G11.1.454.CMB.1.raw
  modified_base (212)..(212): a, c, t, g, unknown or other
  misc_feature (212)..(212): n is a, c, g, or t
tcagcgcagtacgacacgaccggtgctcgatttagctagtcactcaaagggaaagggggggagaggagcccagcactagaagtcggcggtgtttccattcggtgatcagcactgaacacagaggactcaccatgggagtttgggctgagtcgttgggttttccctcgttgacttacgtttttaagaggttcgtccgtagttgtcgaagggtnacgagtcgtgggttacggagtcggtgggggaggtcggtggtccgaggcccggtggggaccgtcccgtggaacgtacctcttccgtggtacgccgtacgtccttcgtcggttaacttccctaaccgttgtaacgttcgttaacgtacgttggaaacctgttaccggacctaccgggtttccgggaccccgtaccgaaccgggtcccttacccgggaaagggtacccgggtaacgggggtaccgttaggggggtaggggttaccgggtcggggtaacgtttaaaggttttaccgttacgtaaccgtaagtttaaacggtgtaaaggggttaaggtaaaaaggttaccgtaatttaaaccttaacgggtctttacggaacccgttaaaacggtttcccggacggggtttaaaccgggacggggttaacccggtaacctttacccggaaccttttacgtaaccggtaaaacggtaccgtaacccgaaaccgttacccgaaaaagtccgaacccgtacggttttaacgttaaccgttagaaacgtttaaccgttaacgaaaccgttacgtaccgggtaagtaccggtaacggaagtaccgggacgttaacggccggttagttcggttaaccgttacgtacggtttaaccggtagttaaccgttaaacggttcgaaacggggttacccgtaacggggtacccggtaaccccgg

SEQ ID NO: 49551 - DNA, 571 bp, Homo sapiens
  misc_feature: GYAE6OF02F7P5E.52.77.G11.1.454.CMB.1.raw
  modified_base (279)..(279): a, c, t, g, unknown or other
  misc_feature (279)..(279): n is a, c, g, or t
  modified_base (393)..(393): a, c, t, g, unknown or other
  misc_feature (393)..(393): n is a, c, g, or t
  modified_base (452)..(452): a, c, t, g, unknown or other
  misc_feature (452)..(452): n is a, c, g, or t
  modified_base (461)..(461): a, c, t, g, unknown or other
  misc_feature (461)..(461): n is a, c, g, or t
  modified_base (468)..(468): a, c, t, g, unknown or other
  misc_feature (468)..(468): n is a, c, g, or t
  modified_base (473)..(473): a, c, t, g, unknown or other
  misc_feature (473)..(473): n is a, c, g, or t
  modified_base (480)..(480): a, c, t, g, unknown or other
  misc_feature (480)..(480): n is a, c, g, or t
  modified_base (483)..(483): a, c, t, g, unknown or other
  misc_feature (483)..(483): n is a, c, g, or t
  modified_base (487)..(487): a, c, t, g, unknown or other
  misc_feature (487)..(487): n is a, c, g, or t
  modified_base (489)..(489): a, c, t, g, unknown or other
  misc_feature (489)..(489): n is a, c, g, or t
  modified_base (491)..(491): a, c, t, g, unknown or other
  misc_feature (491)..(491): n is a, c, g, or t
  modified_base (495)..(495): a, c, t, g, unknown or other
  misc_feature (495)..(495): n is a, c, g, or t
  modified_base (500)..(503): a, c, t, g, unknown or other
  misc_feature (500)..(503): n is a, c, g, or t
  modified_base (505)..(505): a, c, t, g, unknown or other
  misc_feature (505)..(505): n is a, c, g, or t
  modified_base (509)..(509): a, c, t, g, unknown or other
  misc_feature (509)..(509): n is a, c, g, or t
  modified_base (511)..(511): a, c, t, g, unknown or other
  misc_feature (511)..(511): n is a, c, g, or t
  modified_base (514)..(515): a, c, t, g, unknown or other
  misc_feature (514)..(515): n is a, c, g, or t
  modified_base (518)..(518): a, c, t, g, unknown or other
  misc_feature (518)..(518): n is a, c, g, or t
  modified_base (524)..(524): a, c, t, g, unknown or other
  misc_feature (524)..(524): n is a, c, g, or t
  modified_base (530)..(530): a, c, t, g, unknown or other
  misc_feature (530)..(530): n is a, c, g, or t
  modified_base (544)..(544): a, c, t, g, unknown or other
  misc_feature (544)..(544): n is a, c, g, or t
tcagcgcagtacgacacgaccggtgctcgatttagctagtcactcaagggaaaggccgattcgaccatttccagagacaactccaagaacacgctgtatttgcaaatgaacagcctgagagctgaggacacggctgtgtattactgtgacgaacttaatcgacggagacaacggtcacccccgtcgctcggtcgcgtacgtcgtgggcctaaagggcccaggtcagcgtcctcctgcgtcctccacgaacggcccagttccggtccttccccgggaccnccctccgaccaagtcgactaacccgttcggacgggggccaaccggtggccggccccggttggcctcggtccggtcggaccgtaaaccggacctttaacgttcccgtaacgttanaaccgttccgtacgtcgggtacgccgggtctaggaccgacggtccgaacgtactgactnaacgtgagngatcccngatcnttaacgngcncgancntncagngcgannnngngtcngnctnncgncgacanctactntcgtcgtcgagtgntctgcgtctcgtcgtacgtacgtcgtc

SEQ ID NO: 49552 - DNA, 813 bp, Homo sapiens
  misc_feature: GYAE6OF02IYSLF.52.77.G11.1.454.CMB.1.raw
  modified_base (161)..(161): a, c, t, g, unknown or other
  misc_feature (161)..(161): n is a, c, g, or t
  modified_base (227)..(227): a, c, t, g, unknown or other
  misc_feature (227)..(227): n is a, c, g, or t
tcagcgcagtacgacacgaccggtgctcgatttagctagtcactcaagggaaaggggggggagaggagcccagcactagaagtcggcggtgtttccattcggtgatcagcactgaacacagaggactcaccatggagtttgggctgagctgggtttttccncgtttgcttactttttaaagaggttcgtccagtgtcaggtgcagctggtggagtcgtgggggacgnggtggtccagccttaggggacggtccctgacgacctctccgtgtgcgacgcctgtaggacttccaccgtttcaagttcgttactaagtcgaaactgtacggtcctaacggttcggggttcccgccgtaacgggccctaacccggagggaaccggaagggggtccgtaggggtaagggttggggaacggtacgttaaggttaacttaagtactaagtttaacgtagtaaggttaacgggtaaaaagttaaacggtaattaactaacgttatacggtacgtaaacggtacccgttaccgggtaacggtaaacggggttacccggtaactttacccgtaaacccgttaaccgttttaaccggaacgtaaaccgtaaacccgtaaacctaaacccgaaaaccgtaaacccggtaaccgtccgttaagtttaacgttacgaacgtaaacgtacgaaaccgaacgtaccgtacgtaaacggtaaggtaccgaggaacgacgtacggtacgttaggttaacttaacgttaacgttacggtacgtaacgttaacgttaaacgtacggaaccgggtacgaaccggttaaccccgg

SEQ ID NO: 49553 - DNA, 153 bp, Homo sapiens
  misc_feature: GYAE6OF01D3TOA.1.70.G04.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtgtagtgtgaagggaaagggaccaaggtggaagtcaagcgaactgtggctgcaccatctgtcttcatcttcccgccctcttcacgcactcgtctgagcgggctggcaaggcgcatagn

SEQ ID NO: 49554 - DNA, 175 bp, Homo sapiens
  misc_feature: GYAE6OF02HDFFL.1.70.G04.1.454.CMB.1.raw
  modified_base (156)..(175): a, c, t, g, unknown or other
  misc_feature (156)..(175): n is a, c, g, or t
tcagacgagtgcgtcacgaccggtgctcgatttagtgtagtgtgaagggaagggtaccgaaggtggaagtcaagcgaactgtggctgcaccatctgtcttcatcgttccccgccatctgaacgcactcgtctgagcgggctggcaaggcgcatagnnnnnnnnnnnnnnnnnnnn

SEQ ID NO: 49555 - DNA, 727 bp, Homo sapiens
  misc_feature: GYAE6OF01DFUJT.38.12.B01.1.454.CMB.1.raw
tcagtcgatcacgtcacgaccggtgctcgatttagtagtgtagatttgggtctggagctgcggtgaagaggcctggggcctcagtgaacgtctcctgcaaggcttctggttacactttttagcagttatggtgtcagctggggtgcgacaggcccctggacaagggcttgagtggatgggatggatcagcacttacaataggaaaacacaaagtatgacaacattaatttccgaggcagagtcatcatgaccacaagacacactccacgagcactcgacctacatggaactaggaacggaacctgagactcgtacgacgactaacggtaccttaattattagtttgtagcgaagtaacgaacttaaaactttcccttacctttaactaattaacgttaacgacgtagttacggtaagttcgttacttttacttttcttttacgtaccgttaccggtacggggacccgtaacgggtaacccttgtaaccttcccgtaccccgttccttcccgtcccgggtaccccttaaccccggaacccgtaacccgggtccctaaccgttcccggttccccgttacccccgtcccgggtacccctacccccttacccgttaccgaaccgtaccgacccgtaacccgtccggtcggggtacccacggaccggcccgggtcccgtcggggtccctacggtcccgttacggtaccaacggtacccgttccgttacccgg

SEQ ID NO: 49556 - DNA, 811 bp, Homo sapiens
  misc_feature: GYAE6OF01D5A45.38.12.B01.1.454.CMB.1.raw
  modified_base (769)..(769): a, c, t, g, unknown or other
  misc_feature (769)..(769): n is a, c, g, or t
tcagtcgatcacgtcacgaccggtgctcgatttagtagtgtagatttgggtctggagctgcggtgaagaggccctggggcctcagtgaacgtctcctgcaaggcttctggttacacttttagcagttatggtgtcagtcgtgggtgcgacacggcccctggaacgaagggtcttggagtggagtgggatggtactcagtctaacgttacaagtaggaaaacacgaaagtatgacactaattaacgtttccgagggtacaggactcatactagtacgaacccagacgacacactccaacggacgcactcgacctaacagtacggtaacgtcggaacggaaccgtggtaacgtacgtaccgtaccggaacggtaaccgtaccggttaacctttaagtttagttacggttcggtacggaaggtaacgaagttaacctaaaaccgtttcctacccgtttaaacgaactttaacggttaaccgaacggttaaggttaacgggtaaacgtttcgtttaacgttttacgttttcggtttaaccggttccccggttaccggggtaaccgggggtacccgttaacccgggttaacccgtaacggtaccttaccccggtacccgtttcccgtaccgtacccggtcctaacccgtaccggtaccggtacccgttacgtccccgttcccgtcccgaccgtaccctaccctccgtaccgtaacgcgtaccccgtcggtccgggtacggccctaccgggacccgccgggtcccgtcgggtccnccggttaccgcgggtaacctaccggtccgttacccgtaccgg

SEQ ID NO: 49557 - DNA, 779 bp, Homo sapiens
  misc_feature: GYAE6OF02J0JB8.38.12.B01.1.454.CMB.1.raw
  modified_base (244)..(244): a, c, t, g, unknown or other
  misc_feature (244)..(244): n is a, c, g, or t
tcagtcgatcacgtcacgaccggtgctcgatttagtagtgtagatttgtgtttggggaccaaaaaccacacccctccttgggagaatcccctagatcacagctcctcaccatggactggacctggagcatcctttctggtggcagcagcaacaggtgcccactcccaggttcaattggtgcagtctggagctgcgtgaagaggctggggcctcgagtgaacgtctctgcaggcttcgtgttacncgtttagctagttatggtgtccagtcgtgggtcacggtacgacggtccccgtaggaccgtaagggtccttaggaggtggtaacgtgggtaacgttgggtactacgaggtaccgtacgtttaacgaagttacgggaaacaacgtaaaagtgtaccggacaactaaacgttaatttaccccggaaggggtctaaacggggtactcgtaaaccggttaccaagttaacccggaacccgtaacgtaacgggaaaccctaacgtaaccgtaccccgtaaacgggacgtaacccgtaacgtacgtacccgtaagttaacgtacgggaaaccttgggaaaccgttaccgaggtaacgtacgtaaccgagggtaaacccgacgtaaccgggttaaccttaagttaaaccgtttatacggttacggaacgtaagggtaaccaaacgttaaacccgtttacccttacggttaacctaacggttttaaacgtaaccccggttaagttaacccgggttaaggtttaaccgtacggtttttaaacccg

SEQ ID NO: 49558 - DNA, 812 bp, Homo sapiens
  misc_feature: GYAE6OF02IDXVB.38.12.B01.1.454.CMB.1.raw
  modified_base (299)..(299): a, c, t, g, unknown or other
  misc_feature (299)..(299): n is a, c, g, or t
  modified_base (458)..(458): a, c, t, g, unknown or other
  misc_feature (458)..(458): n is a, c, g, or t
tcagtcgatcacgtcacgaccggtgctcgatttagtagtgtagatttgggtctggagctgcggtgaagaggcctggggcctcagtgaacgtctcctgcaaggcttctggttactacttttagcagttatggtgtcagcgtgggtgcgacacggcccctggacgaagggcttgagtggagtgggatggatcagctacgttacaagtcggaaaacaacgaaagtatgacctaataacgttaactttccggaagggcaaggacgtacattgaatcgaaccagacgacacactaccgacgaanccgactcgaccttacgattacggaagtcgaacgtaacctgtaacgtataccgtacggaaccgaccgacggttaccttaattacttagttgtcgacgtaacgacgttaaacacttacctaccgttaactagtacgttacgaacgtaggttacgaacggtnttacgtttttaagttttcctttacggtacctttaccgggtaccgggtcccgtaaacgggtacccttacgtaccgtacccggttacccgtccgttaccgttcccgaccctaacccgtaccgtaaccggccccgttacgttcccccggtttaccccgttaccccgtccggttaacccctaccccccgttacgttaaccccgaaaggtaccccgtcgttaccccgtacccgggttcgggaaccccgttaacccggtacccggtaccccggggtacccctcgggggttaccccgttcggtacccccggtttagggttacccccgtaaccggttacccgtttaccccccgttaaccggg

SEQ ID NO: 49559 - DNA, 183 bp, Homo sapiens
  misc_feature: GYAE6OF01BIIIU.23.73.G07.1.454.CMB.1.raw
  modified_base (183)..(183): a, c, t, g, unknown or other
  misc_feature (183)..(183): n is a, c, g, or t
tcagacgcgagtatcacgaccggtgctcgatttagctctacgctcagggtccgggagatcatgagggtgtccttgggttttgggggaagaggaagactgacggtcctgccacagcggccctgggctgcctggtcaaggactacttccatactcgcgtctgagcgggctggcaaggcgcatagn

SEQ ID NO: 49560 - DNA, 183 bp, Homo sapiens; identical to SEQ ID NO: 49559
  misc_feature: GYAE6OF01BKRWL.23.73.G07.1.454.CMB.1.raw
  modified_base (183)..(183): a, c, t, g, unknown or other
  misc_feature (183)..(183): n is a, c, g, or t

SEQ ID NO: 49561 - DNA, 282 bp, Homo sapiens
  misc_feature: GYAE6OF01COV8M.23.73.G07.1.454.CMB.1.raw
  modified_base (276)..(282): a, c, t, g, unknown or other
  misc_feature (276)..(282): n is a, c, g, or t
tcagacgcgagtatcacgaccggtgctcgatttagctctacgctcagggtttccacacctgctcgaaaagggagttgagcttcagcagctgacccaggactctgttcccctttggtgagtaagggtttttgtcagcaagacaatggagagctctcactgtggtggacgttcggccaagggaccaaggtggaaatcaaacgaactgtggctgcaccatctgtcttcatctcccgcatctgaatactcgcgtctgagcgggctggcaaggcgcatagnnnnnnn

SEQ ID NO: 49562 - DNA, 331 bp, Homo sapiens
  misc_feature: GYAE6OF01DJPWD.23.73.G07.1.454.CMB.1.raw
  modified_base (295)..(331): a, c, t, g, unknown or other
  misc_feature (295)..(331): n is a, c, g, or t
tcagacgcgagtatcacgaccggtgctcgatttagctctacgctcaggggtttccacgacctgctcgaaagggagttgagcttcagcagctgacccaggactctgttcccctttggtgagtaacgggttttttgttccagcaagacaagtggagaggcctcgtccactgtggtcggacgttcggccaagggaccaaggtggaaatccgaaacgaactgtggctgcaccatctgtcttcatcttcccgccatctgaatactcgcgtctgagcgggctggccaaggccgacatacgnnnnnnnnnnnnnnnnnnnnnnnnnnnnnnnnnnnnn

SEQ ID NO: 49563 - DNA, 185 bp, Homo sapiens
  misc_feature: GYAE6OF01EU7W7.23.73.G07.1.454.CMB.1.raw
  modified_base (184)..(185): a, c, t, g, unknown or other
  misc_feature (184)..(185): n is a, c, g, or t
tcagacgcgagtatcacgaccggtgctcgatttagctctacgctcaggggtccgggagatcatgagggtgtccttgggttttgggggaagaggaagactgacggtcctgccacagcggccctgggctgcctggtcaaggactacttccatactcgcgtctgagcgggctggcaaggcgcatagnn

SEQ ID NO: 49564 - DNA, 330 bp, Homo sapiens
  misc_feature: GYAE6OF01DKMS0.23.73.G07.1.454.CMB.1.raw
  modified_base (152)..(152): a, c, t, g, unknown or other
  misc_feature (152)..(152): n is a, c, g, or t
  modified_base (161)..(161): a, c, t, g, unknown or other
  misc_feature (161)..(161): n is a, c, g, or t
  modified_base (288)..(288): a, c, t, g, unknown or other
  misc_feature (288)..(288): n is a, c, g, or t
  modified_base (315)..(315): a, c, t, g, unknown or other
  misc_feature (315)..(315): n is a, c, g, or t
  modified_base (317)..(330): a, c, t, g, unknown or other
  misc_feature (317)..(330): n is a, c, g, or t
tcagacgcgagtatcacgaccggtgctcgatttagctctacgctcagggtttccacacctgctacggaaaagggagttgagcttcagcagctcgaccaggactctcgttcccttggtgtagttaggttttgtcagacaagataagtggaagngtctctacngtggtggtacggtacggtacggaccgaaggtaaccgaaggtagaaataccgaaacgtatggcggtctgaccactactcgtgttcctactcttccctccacctagtctacgtaactcgtcgtcgtagngggacgtcggcgacgacgaggccagtngnnnnnnnnnnnnnn

SEQ ID NO: 49565 - DNA, 183 bp, Homo sapiens; identical to SEQ ID NO: 49559
  misc_feature: GYAE6OF02GGSFE.23.73.G07.1.454.CMB.1.raw
  modified_base (183)..(183): a, c, t, g, unknown or other
  misc_feature (183)..(183): n is a, c, g, or t

SEQ ID NO: 49566 - DNA, 185 bp, Homo sapiens; identical to SEQ ID NO: 49563
  misc_feature: GYAE6OF02IHPVZ.23.73.G07.1.454.CMB.1.raw
  modified_base (184)..(185): a, c, t, g, unknown or other
  misc_feature (184)..(185): n is a, c, g, or t

SEQ ID NO: 49567 - DNA, 358 bp, Homo sapiens
  misc_feature: GYAE6OF01D3UAA.33.4.A04.1.454.CMB.1.raw
  modified_base (358)..(358): a, c, t, g, unknown or other
  misc_feature (358)..(358): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagcctccaccaagggcccatcggtcttccccctggcaccctcctccaagagcacctctgggggcacagcggccctgggctgcctggtcaaggactacttccagtgtgtgtactgagcgggctggcaaggcgcatagn

SEQ ID NO: 49568 - DNA, 363 bp, Homo sapiens
  misc_feature: GYAE6OF01A8ZG3.33.4.A04.1.454.CMB.1.raw
  modified_base (357)..(363): a, c, t, g, unknown or other
  misc_feature (357)..(363): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagcctccaccaagggcccatcggtcttcccctggcaccctcctccaagagcacctctgggggcacagcggccctgggctgcctggtcaaggactacttccagtgtgtgtactgagcgggctggcaaggcgcatagnnnnnnn

SEQ ID NO: 49569 - DNA, 360 bp, Homo sapiens
  misc_feature: GYAE6OF01BYHPZ.33.4.A04.1.454.CMB.1.raw
  modified_base (358)..(360): a, c, t, g, unknown or other
  misc_feature (358)..(360): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagcctccaccaagggcccatcggtcttccccctggcaccctcctccaagagcacctctgggggcacagcggccctgggctgcctggtcaaggactacttccagtgtgtgtactgagcgggctggcaaggcgcatagnnn

SEQ ID NO: 49570 - DNA, 363 bp, Homo sapiens
  misc_feature: GYAE6OF01B0OOC.33.4.A04.1.454.CMB.1.raw
  modified_base (359)..(363): a, c, t, g, unknown or other
  misc_feature (359)..(363): n is a, c, g, or t
tcagtacacacactcacgaccggtgctcgatttagagtagtgatcagggagaactggttcattagacacgtctaagaaccagttctccctgaagttgaactctgtgactgccgcggacacggccgtgtattactgtgtggcatactacgatactagtggccgatatcaccatcacgatgcttttgatatctggggccaagggacaagggtcaccgtctcttcagcctccaccaagggcccatcggtcttccccctggcaccctcctccaagagcacctctgggggcacagcggccctgggctgcctggtcaaggactacttccagtgtgtgtactgagcgggctggcaaggcgcatagnnnnn

SEQ ID NO: 49571 - DNA, 361 bp, Homo sapiens
  misc_feature: GYAE6OF01C9T90.33.4.A04.1.454.CMB.1.raw
  modified_base (357)..(361): a, c, t, g, unknown or other
  misc_feature (357)..(361): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagcctccaccaagggcccatcggtcttcccctggcaccctcctccaagagcacctctgggggcacagcggccctgggctgcctggtcaaggactacttccagtgtgtgtactgagcgggctggcaaggcgcatagnnnnn

SEQ ID NO: 49572 - DNA, 365 bp, Homo sapiens
  misc_feature: GYAE6OF01A7YWJ.33.4.A04.1.454.CMB.1.raw
  modified_base (358)..(365): a, c, t, g, unknown or other
  misc_feature (358)..(365): n is a, c, g, or t
tcagtacacacactcacgaccggtgctcgatttagagtagtgatcagggagaactggttcattagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagcctccaccaagggcccatcggtcttccccctggcaccctcctccaagagcacctctggggcacagcggccctgggctgcctggtcaaggactacttccagtgtgtgtactgagcgggctggcaaggcgcatagnnnnnnnn

SEQ ID NO: 49573 - DNA, 363 bp, Homo sapiens
  misc_feature: GYAE6OF01CBSAR.33.4.A04.1.454.CMB.1.raw
  modified_base (357)..(363): a, c, t, g, unknown or other
  misc_feature (357)..(363): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagcctccaccaagggcccatcggtcttccccctggcaccctcctccaagagcacctctgggggcacagcggccctgggctgcctggtcaaggctacttccagtgtgtgtactgagcgggctggcaaggcgcatagnnnnnnn

SEQ ID NO: 49574 - DNA, 367 bp, Homo sapiens
  misc_feature: GYAE6OF01A1V3A.33.4.A04.1.454.CMB.1.raw
  modified_base (358)..(367): a, c, t, g, unknown or other
  misc_feature (358)..(367): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagcctccaccaagggcccatcggtcttccccctggcaccctcctccaagagcacctctgggggcacagcggccctgggctgcctggtcaaggactacttccagtgtgtgtactgagcgggctggcaaggcgcatagnnnnnnnnnn

SEQ ID NO: 49575 - DNA, 361 bp, Homo sapiens
  misc_feature: GYAE6OF01CGQ7Z.33.4.A04.1.454.CMB.1.raw
  modified_base (358)..(361): a, c, t, g, unknown or other
  misc_feature (358)..(361): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagcctccaccaagggcccatcggtcttccccctggcaccctcctccaagagcacctctgggggcacagcggccctgggctgcctggtcaaggactacttccagtgtgtgtactgagcgggctggcaaggcgcatagnnnn

SEQ ID NO: 49576 - DNA, 364 bp, Homo sapiens
  misc_feature: GYAE6OF01AXB6K.33.4.A04.1.454.CMB.1.raw
  modified_base (358)..(364): a, c, t, g, unknown or other
  misc_feature (358)..(364): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagcctccaccaagggcccatcggtcttccccctggcaccctcctccaagagcacctctgggggcacagcggccctgggctgcctggtcaaggactacttccagtgtgtgtactgagcgggctggcaaggcgcatagnnnnnnn

SEQ ID NO: 49577 - DNA, 364 bp, Homo sapiens
  misc_feature: GYAE6OF01BB5XV.33.4.A04.1.454.CMB.1.raw
  modified_base (359)..(364): a, c, t, g, unknown or other
  misc_feature (359)..(364): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagcctccaccaagggcccatcggtcttccccctggccaccctcctccaagagcacctctgggggcacagcggccctgggctgcctggtcaaggactacttccagtgtgtgtactgagcgggctggcaaggcgcatagnnnnnn

SEQ ID NO: 49578 - DNA, 624 bp, Homo sapiens
  misc_feature: GYAE6OF01CR9XS.33.4.A04.1.454.CMB.1.raw
  modified_base (255)..(255): a, c, t, g, unknown or other
  misc_feature (255)..(255): n is a, c, g, or t
  modified_base (311)..(311): a, c, t, g, unknown or other
  misc_feature (311)..(311): n is a, c, g, or t
  modified_base (335)..(335): a, c, t, g, unknown or other
  misc_feature (335)..(335): n is a, c, g, or t
  modified_base (353)..(353): a, c, t, g, unknown or other
  misc_feature (353)..(353): n is a, c, g, or t
tcagtacacacactcacgaccggtgctcgatttagagtagtgatcagggggactttctgagagtcctggacctcctgtgcaagaacatgaaacacctgtggttctccctcctgctggtggcagctcccagatgggtcctgtcccaggtgcagctgcaggagtcgggcccaggactggtgaagccttcacagacccctgtccctcacctgcactgtctcgtggtcgctccatcaccagtggttatcactactgganctggatccgccagccaccgagggaaggcctggagtggattggacatctattaccgnggagcaccttcacaacccgtcctnaatgtcgatcactatctnattagacacgtcaaatacctagttctcctagaacgttgaaacttcgtagtagacgtcgacccgacggaaccgacgggtccgttagtaacgtttaactgggtcgtaccgggacttaacgttaacctaaacgtaacgtaacgttaacggtcgggacccgtaattaccgtacccaacctaacgtaccgaaaccgttacgttcgttacccgttttttagaactttaacgttcggtacggggggtaaccgtaaaagggggaaccgtaaacccgggg

SEQ ID NO: 49579 - DNA, 359 bp, Homo sapiens
  misc_feature: GYAE6OF01CR6PF.33.4.A04.1.454.CMB.1.raw
  modified_base (358)..(359): a, c, t, g, unknown or other
  misc_feature (358)..(359): n is a, c, g, or t
tcagtacacacactcacgaccggtgctcgatttagagtagtgatcagggagaactggttcattagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagcctccaccaagggcccatcggtcttcccctggcaccctcctccaagagcacctctgggggcacagcggccctgggctgcctggtcaaggactacttccagtgtgtgtactgagcgggctggcaaggcgcatagnn

SEQ ID NO: 49580 - DNA, 367 bp, Homo sapiens
  misc_feature: GYAE6OF01CKSHS.33.4.A04.1.454.CMB.1.raw
  modified_base (358)..(367): a, c, t, g, unknown or other
  misc_feature (358)..(367): n is a, c, g, or t
tcagtacacacactcacgaccggtgctcgatttagagtagtgatcagggagaactggttcattagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagcctccaccaagggcccatcggtcttccccctggcaccctcctccaagagcacctctggggcacagcggccctgggctgcctggtcaaggactacttccagtgtgtgtactgagcgggctggcaaggcgcatagnnnnnnnnnn

SEQ ID NO: 49581 - DNA, 380 bp, Homo sapiens
  misc_feature: GYAE6OF01C97XE.33.4.A04.1.454.CMB.1.raw
  modified_base (361)..(364): a, c, t, g, unknown or other
  misc_feature (361)..(364): n is a, c, g, or t
  modified_base (366)..(380): a, c, t, g, unknown or other
  misc_feature (366)..(380): n is a, c, g, or t
tcagtacacacactcacgaccggtgctcgatttagagtagtgatcaggggagaactggttcttagacacgtctaagaaccagttctccctgaagttgaactctgtgactgccgcggacacggccgtgtattactgtgcggcatactacgatactagtggccgatatcaccatcacgatgcttttgatatctggggccaagggacaaggggtcaccgtctcttcagcctccaccaagggcccatcggtccttcccctggcacccctcctccaagagcacctctgggggcacagcggccctgggctgccgtggtcaaggactactccagtgtgtgtctggacgcgggctggcaggcgcatagnnnngnnnnnnnnnnnnnnn

SEQ ID NO: 49582 - DNA, 362 bp, Homo sapiens
  misc_feature: GYAE6OF01B9SIU.33.4.A04.1.454.CMB.1.raw
  modified_base (357)..(362): a, c, t, g, unknown or other
  misc_feature (357)..(362): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgcttttgatatctggggccaagggcaagggtcaccgtctcttcagcctccaccaagggcccatcggtcttccccctggcaccctcctccaagagcacctctgggggcacagcggccctgggctgcctggtcaaggactacttccagtgtgtgtactgagcgggctggcaaggcgcatagnnnnnn

SEQ ID NO: 49583 - DNA, 357 bp, Homo sapiens
  misc_feature: GYAE6OF01AK7GQ.33.4.A04.1.454.CMB.1.raw
  modified_base (350)..(357): a, c, t, g, unknown or other
  misc_feature (350)..(357): n is a, c, g, or t
tcagtacacacactcacgaccggtgctcgatttagagtagtgatcagggagaactggttcattagacacgtctaagaaccagttctccctgaagttgaactctgtgactgccgcggacacggccgtgtattactgtgcggcatactacgatactagtggcctatatcaccatcacgatgcttttgatatctggggccaagggacaagggtcaccgtctcttcagcctccaccaaggcccatcgtctcccctgcacctctccaagagcacctctggggcacagcggccctggctgcctggtcaaggctacttccagtgtgtgtactgaggcgggctggcaaggcgcatagnnnnnnnn

SEQ ID NO: 49584 - DNA, 593 bp, Homo sapiens
  misc_feature: GYAE6OF01A964A.33.4.A04.1.454.CMB.1.raw
  modified_base (309)..(309): a, c, t, g, unknown or other
  misc_feature (309)..(309): n is a, c, g, or t
tcagtacacacactcacgaccggtgctcgatttagagtagtgatcagggggactttctgagagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtgctccatcaccagtggttatcactactggagctggatccgcagcacccagggaacggcctggagtggattgggacatctattaccggnggagcaccttcacaacccgtcctcaatgtcgagtcaccatctcattagacacgtctaagaccagttctcctagacgttacgtaactcgtgtacgtactcgacccgcggacgtaccggtccgttagtaacgtttacgtcggtcggtccggtacctacgtaaccgttaacgtacgttacgttaacggtcggtacccgtaagttactaccgtaccaacgtccaacgtatcgttaccgttttagaactttacgtcgtagggggacctaaaggggtacgtaaaccgggg

SEQ ID NO: 49585 - DNA, 390 bp, Homo sapiens
  misc_feature: GYAE6OF01CJLJJ.33.4.A04.1.454.CMB.1.raw
  modified_base (251)..(251): a, c, t, g, unknown or other
  misc_feature (251)..(251): n is a, c, g, or t
  modified_base (325)..(325): a, c, t, g, unknown or other
  misc_feature (325)..(325): n is a, c, g, or t
  modified_base (359)..(361): a, c, t, g, unknown or other
  misc_feature (359)..(361): n is a, c, g, or t
  modified_base (363)..(390): a, c, t, g, unknown or other
  misc_feature (363)..(390): n is a, c, g, or t
tcagtacacacactcacgaccggtgctcgatttagagtagtgatcaggggagaactggttcttagacacgtctaagaaccagttcctccctgaagttgaacgtctgtgactgccgcggacacggccgttgtattactgtgcgcatactacgatactagtggccgatatcacatcacgatgcttttgatatctggggccaagggacaagggtcaccgtctcttcagcctcacaaggccatcggtcttccccnggcacctctccaagagtcacctcgtggggcacaggtcgccctgggcttgcctggtcaaggactacttccagtgngtgtactgagcgggctgggccaaggcgacatagnnncnnnnnnnnnnnnnnnnnnnnnnnnnnnn

SEQ ID NO: 49586 - DNA, 365 bp, Homo sapiens
  misc_feature: GYAE6OF01E2KCW.33.4.A04.1.454.CMB.1.raw
  modified_base (358)..(365): a, c, t, g, unknown or other
  misc_feature (358)..(365): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagcctccaccaagggcccatcggtcttccccctggcaccctcctccaagagcacctctgggggcacagcggccctgggctgcctggtcaaggactacttccagtgtgtgtactgagcgggctggcaaggcgcatagnnnnnnnn

SEQ ID NO: 49587 - DNA, 632 bp, Homo sapiens
  misc_feature: GYAE6OF01C14MX.33.4.A04.1.454.CMB.1.raw
  modified_base (310)..(310): a, c, t, g, unknown or other
  misc_feature (310)..(310): n is a, c, g, or t
  modified_base (316)..(316): a, c, t, g, unknown or other
  misc_feature (316)..(316): n is a, c, g, or t
tcagtacacacactcacgaccggtgctcgatttagagtagtgatcagggggactttctgagagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtgctccatcaccagtggttatcactactggagctggactccgccagcaccgagggacggcctggagtgagttgggtacatctagtaccgngggacncaccttcacacccgtcacaatagtcgatcacatctacattacgactacgtactaaacgacctagttcctacccgtagtaacgttcgaaccttctggtacgtaccgttggcccggacggaaccgtaccgggtccgttagttacgttacgtcggtacggaccggtactaacgttaaccgtaacgtaacgttacgttaggtacggtaccgtaattacgtacctaaccgtacgtaccgaaccgtatttcggttacgtttttagaactttacggttaccggttacgggggaacccgtaaaggggtaccggttaaaccgggg

SEQ ID NO: 49588 - DNA, 369 bp, Homo sapiens
  misc_feature: GYAE6OF01CJOO9.33.4.A04.1.454.CMB.1.raw
  modified_base (360)..(369): a, c, t, g, unknown or other
  misc_feature (360)..(369): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgcttttgatatctggggccaaagggacaagggtcaccgtctcttcagcctccaccaagggcccatcggtcttccccctggcaccctcctccaagagcacctctgggggcacagcggcccctgggctgcctggtcaaggactacttccagtgtgtgtactgagcgggctggcaaggcgcatagnnnnnnnnnn

SEQ ID NO: 49589 - DNA, 386 bp, Homo sapiens
  misc_feature: GYAE6OF01CVYQK.33.4.A04.1.454.CMB.1.raw
  modified_base (163)..(163): a, c, t, g, unknown or other
  misc_feature (163)..(163): n is a, c, g, or t
  modified_base (372)..(372): a, c, t, g, unknown or other
  misc_feature (372)..(372): n is a, c, g, or t
  modified_base (377)..(386): a, c, t, g, unknown or other
  misc_feature (377)..(386): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccganatcaccatcacgatgtcttttgatatcgtggggccaagggacaagggtcaccgtctcttcacgcctccaccaagggcccatccggtccttccccctggccaccctcctccaagacgcacctcgtgggggccacgagcggcccctggggctcgcctggtacaacggactacttccagtgtgtgtactggagcgggctggcgaaggccganatagnnnnnnnnnn

SEQ ID NO: 49590 - DNA, 438 bp, Homo sapiens
  misc_feature: GYAE6OF01AEEHC.33.4.A04.1.454.CMB.1.raw
  modified_base (276)..(276): a, c, t, g, unknown or other
  misc_feature (276)..(276): n is a, c, g, or t
  modified_base (300)..(300): a, c, t, g, unknown or other
  misc_feature (300)..(300): n is a, c, g, or t
  modified_base (394)..(394): a, c, t, g, unknown or other
  misc_feature (394)..(394): n is a, c, g, or t
  modified_base (426)..(426): a, c, t, g, unknown or other
  misc_feature (426)..(426): n is a, c, g, or t
  modified_base (428)..(438): a, c, t, g, unknown or other
  misc_feature (428)..(438): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatccaccatcacgtatgtcttttgatatcggtggggaccaagggacaaggtccaccgttctctacgacgtccctaccgaccgaacgggccctacgttccggtcccttccccgnggccgccctgcctaccgaggaccncccaccgtacggagaccgccacgcggtcccggccgtgggtcctcggtccgtaggtaccgaacggtccttaccgttcgtagtttcgtcgttacgnggacgggcggcgtacggacgaaggccagtagngnnnnnnnnnnn

SEQ ID NO: 49591 - DNA, 363 bp, Homo sapiens
  misc_feature: GYAE6OF01DTSU3.33.4.A04.1.454.CMB.1.raw
  modified_base (340)..(340): a, c, t, g, unknown or other
  misc_feature (340)..(340): n is a, c, g, or t
  modified_base (357)..(363): a, c, t, g, unknown or other
  misc_feature (357)..(363): n is a, c, g, or t
tcagtacacacactcacgaccggtgctcgatttagagtagtgatcagggagaactggttcattagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagcctccaccaaggcccatcggtcttcccctggcacctcctccaagacgcacctctggggcacagcggcctggctgcctggtcaaggactacgttccagtcgtgtgtactgagcgggntggcaaggcgtcatagnnnnnnn

SEQ ID NO: 49592 - DNA, 658 bp, Homo sapiens
  misc_feature: GYAE6OF01COLRF.33.4.A04.1.454.CMB.1.raw
  modified_base (239)..(239): a, c, t, g, unknown or other
  misc_feature (239)..(239): n is a, c, g, or t
  modified_base (250)..(250): a, c, t, g, unknown or other
  misc_feature (250)..(250): n is a, c, g, or t
  modified_base (306)..(306): a, c, t, g, unknown or other
  misc_feature (306)..(306): n is a, c, g, or t
  modified_base (311)..(311): a, c, t, g, unknown or other
  misc_feature (311)..(311): n is a, c, g, or t
  modified_base (343)..(343): a, c, t, g, unknown or other
  misc_feature (343)..(343): n is a, c, g, or t
  modified_base (461)..(461): a, c, t, g, unknown or other
  misc_feature (461)..(461): n is a, c, g, or t
tcagtacacacactcacgaccggtgctcgatttagagtagtgatcagggggactttctgagagtcctggacctcctgtgcaagaacatgaaacacctgtggttctccctcctgctggtggcagctcccagatgggtcctgtcccaggtgcagctgcaggagtcgggccaggactggtgaagccttcacacgaccctgtccctcacctgcactgtctctggtgctcatcaccagtgttancatacgtgganctggactccgcagccaccgagggacggcgtggagtggagttggacatctagtacgnggacnctactcacaccgtctacaatcgcatcacatcntattacgactacgtactaaacgaacctagttcctacccgtagtaacgttcgaaaccttcgtagtacgaacctcggacccgtacgggaacctacgggtccgttagttaactttaaccgnggttcggaccgtaactaacgttaacccgtaacgtaacttaccggttaggtacggtacccgtaaattaccgaccgtaacccctaagttacccgtaaacggttaatttccggttaacgttttttacggaacttttaaaccggttacccgggttaacggggggaaacccctaaaaaggggggtacccgttaaaccggggg

SEQ ID NO: 49593 - DNA, 676 bp, Homo sapiens
  misc_feature: GYAE6OF01DJYTG.33.4.A04.1.454.CMB.1.raw
tcagtacacacactcacgaccggtgctcgatttagagtagtgatcagggggactttctgagagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtgctccatcaccagtgtatcactactggagctggatccgccagccaacccgagggaacgggccgtagggagtggtagttcggggtactagtctagtttaccggtgggacgtaccgaacctttcctaaccaaaccccgttccctactaaacgttacgtccgtaacgtaccaaccctaattcccttacgaactttacgaacctaaccggttacttaaaacggaaacccttacggtttacctacccgtagtaaacgtttcgaaacttcttagtcgtaacttcggacccggcggaaccgaccggccgttagtacgttactcggtgaccgggtctaattaccgtaacggtacttaacgttaggtcgggacctaattacgtcccaaaccacttcgaaccgtattcggttacttttagaacttcgtaccgtacgggggaacccaaaggggaccgtaaacgggg

SEQ ID NO: 49594 - DNA, 370 bp, Homo sapiens
  misc_feature: GYAE6OF01CTZKR.33.4.A04.1.454.CMB.1.raw
  modified_base (271)..(271): a, c, t, g, unknown or other
  misc_feature (271)..(271): n is a, c, g, or t
  modified_base (358)..(370): a, c, t, g, unknown or other
  misc_feature (358)..(370): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagcctccaccaagggcccatcggtattccccctggcaccctctccaagancacctctgggggcacacgcggcctgggctgcctggtcaaggactactccagtgtgtgtactgagcgggctggcaaggcgacagtagnnnnnnnnnnnnn

SEQ ID NO: 49595 - DNA, 688 bp, Homo sapiens
  misc_feature: GYAE6OF01ERGKK.33.4.A04.1.454.CMB.1.raw
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
  modified_base (251)..(251): a, c, t, g, unknown or other
  misc_feature (251)..(251): n is a, c, g, or t
  modified_base (316)..(316): a, c, t, g, unknown or other
  misc_feature (316)..(316): n is a, c, g, or t
  modified_base (342)..(342): a, c, t, g, unknown or other
  misc_feature (342)..(342): n is a, c, g, or t
tcagtacacacactcacgaccggtgctcgatttagagtagtgatcagggggactttctgagagtcctggacctcctgtgcaagaacatgaaaacacctgtggttctccctcctgctggtggcagctcccagatgggtcctgtcccaggtgcagctgcaggagtcgggcccaggactggtgaagccttcacagaccctgtccctcacctgcactgtctctggtgctccatcaccagtgtancactacngganctggatccgcagccacccgagggacggcctggagtggagttgggacatctagttaccggtgggancctaccttcacctaacccgtccctanaaatcgtcgagtccaccatctcattaacgactacgtactaaacgaccctagttccctacccgtagtaacgttcgaaccttctacggtagaccgtacggccccgggacggaacccgacccgggtcccgttaagtttaacgtttacccggtggttacggcccgggtaacctaacgtttaaccgtaaccgggtaattaacccgttaggtaccgggtacccgtaattaccgtacccgaaaccctagttacccgtaaggtaacttcggtttaccgtttttaagaacgttaacggttcccgggtaaaccggggggtaccccggtaaaaggggtaacccggttaaaccggggg

SEQ ID NO: 49596 - DNA, 641 bp, Homo sapiens
  misc_feature: GYAE6OF01BI0YP.33.4.A04.1.454.CMB.1.raw
  modified_base (521)..(521): a, c, t, g, unknown or other
  misc_feature (521)..(521): n is a, c, g, or t
  modified_base (586)..(586): a, c, t, g, unknown or other
  misc_feature (586)..(586): n is a, c, g, or t
tcagtacacacactcacgaccggtgctcgatttagagtagtgatcagggggacgtttctgagagtcctggacctcctgtgcaagaacatgaaacacctgtggttctcctctgctggtgcagctccagatgggtcctgtcccgaggtgcagctgcaggagtcgggccaggactggtgaacgccttcacagaccctgtccctcacctgcactgtctctggtgctccatcactagtgttactcactactggagcgtggactccgccagccaccgaggggacggccgtgggaggtggtagttcggggtacacgttcgtacgttaccgggtcgggactctaacccgtttacgtaacctacccgtccctacaacgtacgtcgaacgtccaactactcctactattacgactacgtactaaacggtacctacgttcctaccgttagtaactttacggaaccttcgttagtacgtaccgtcggtacccggtacgggtaaccgacggtcccggttagttaacgtttacgnggtacgcggactacgtactacggtactacgtagtcggacctaatctccaacgtactcgaacgttntcgttcttttagaacgttataccgggtaggggacccgaaaggggtcccgtaaggg

SEQ ID NO: 49597 - DNA, 570 bp, Homo sapiens
  misc_feature: GYAE6OF01AKS5O.33.4.A04.1.454.CMB.1.raw
  modified_base (530)..(530): a, c, t, g, unknown or other
  misc_feature (530)..(530): n is a, c, g, or t
tcagtacacacactcacgaccggtgctcgatttagagtagtgatcagggggactttctgagagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtcccctcacctgcactgtctctggtgctccatcaccagtggttatcactactggagctggatccgccagccaccccgaggggaacgggcctgggagtggattggggtacagtctagttaccggtgggacgctaccttctaccaacccgtccctacaatagtcgagtccaccatctacattacgacacgtctaaacgacctagttcctcctagtaacgttgaacttcgtgtcgactcgccgcggacaccgggtccgtgtacttacgtggtcgccggtactacttacctacgtattacgtaggtcgggaccgtatactccaacctagtccacgtntgtcttttgattacgtcgtaggggaccaagggctaacggg

SEQ ID NO: 49598 - DNA, 349 bp, Homo sapiens
  misc_feature: GYAE6OF01BW0MK.33.4.A04.1.454.CMB.1.raw
  modified_base (341)..(349): a, c, t, g, unknown or other
  misc_feature (341)..(349): n is a, c, g, or t
tcagtacacacactcacgaccggtgctcgatttagagtagtgatcagggagaactggttcttagacacgtctaagaaccagttctccctgaatctgacctctgtgaccgctgcggacacggccgtctattactgtgcgagagccgtcagcagtgggtggttctactttgactactggggccagggatccctggtcaccgtctcctctgcctccaccaagggcccatcggtcttccccctggcaccctcctccaagagcacctctggggcacagcggccctgggctgcctggtcaaggctacttccagtgtgtgtactgagcgggctggcaaggcgcatagnnnnnnnnn

SEQ ID NO: 49599 - DNA, 686 bp, Homo sapiens
  misc_feature: GYAE6OF01C00LF.33.4.A04.1.454.CMB.1.raw
  modified_base (240)..(240): a, c, t, g, unknown or other
  misc_feature (240)..(240): n is a, c, g, or t
  modified_base (312)..(312): a, c, t, g, unknown or other
  misc_feature (312)..(312): n is a, c, g, or t
tcagtacacacactcacgaccggtgctcgatttagagtagtgatcagggggactttctgagagtcctggacctcctgtgcaagaacatgaaacacctgtggttctccctcctgctggtggcagctccagatgggtcctgtcccaggtgcagctgcaggagtcgggcccaggactggtgaagccttcacacgaccctgtccctcacctgcactgtctctggtgctccatcaccagtgttancactactggagctggactccgcagcaccgagggacggcctggagtggattgggtacatctattacggtgganctaccttctaccaacccgtcctacaatagtacgacgtcacctatctcaattacgactaacgtactaaacgaacctgttacctacccgtagtaaacgtttcgaaaccttcgttacggtacgtaaccgttcgggaccccggtacgggtaacccgtaacccggggtcccgtttaggtttaacgtttaacccggtgggtttaccggccgggtaccttaaacgttaacccgttaacgaacgtttaccgttaaggtccggaacccgtaattacctaccaacctacgtaccaaccggttattcggtttactttttaggaaatttaccgttaccgggttagggggtaaaccccgtaaagggggtcccgttaaaaaccggggg

SEQ ID NO: 49600 - DNA, 836 bp, Homo sapiens
  misc_feature: GYAE6OF01ACC9Z.33.4.A04.1.454.CMB.1.raw
  modified_base (245)..(245): a, c, t, g, unknown or other
  misc_feature (245)..(245): n is a, c, g, or t
tcagtacacacactcacgaccggtgctcgatttagagtagtgatcagggggactttctgagagtcctggacctcctgtgcaagaacatgaaacacctgtggttcctccctcctgctggtggcagctcccagatgggtcctgtcccaggtgcagctgcaggagtccgggcccaggactggtgaacgtccttcacacgaccctcgtccctcacctgcactgtctcgtggtcgctcatcactgtgtancactactggacgtctcggactcccgacacgaccgacccggtaaggggaacgggtcctagggtacggtggtaagttcgggtaactacgttcgttaacggttaccgggtaggggactacccttaacccgtttacctaaaccccggtaaccccgttcctaacgtaaacggttaaccgtccggtaacgtaccccaaacctactttacctaacgtaaacgtttaaccgaaccgttaaaccgttaaccgtaaaaccgtaacccctttacggtttacccgttacccgtaaggttaacggtttaacgtaaccgtttcgttacgggtaccggtaccgttaccgggacccgggaccgggtaacccgtacccggggttaccgtttaacggtttaaccttacgggttcgggtaccggtaccgggtacctaaacggttaacccttaaccggtaacttaaccgggttaacgggtaccggtaaccgttaactaaccttacccgaaaccctaacgttccgtaaggttattccggtttaccttttaaggaccgtttaagttacccggggtacggggaaccgtaaaggggttaacccggtaaacccggg

SEQ ID NO: 49601 - DNA, 880 bp, Homo sapiens
  misc_feature: GYAE6OF01DNZQY.33.4.A04.1.454.CMB.1.raw
tcagtacacacactcacgaccggtgctcgatttagagtagtgatcagggggactttctgagagtcctggacctcctgtgcaagaacatgaaacacctgtggttcctccctcctgctggtggcagcctccagagtcgggtcctcgtccaggtgcagctgcgagggacgtccgggcccaggtactgggtagaacgtcccttacaacgaccgtacccctcgtcccctaccacctcgacctacgttcgttccgttcggtgggtcgtcctccactaccaccgttaggttaggtttactaccgtaacgttacggtagggtaacgtcggttacggtaccgtcccggaccgaacgacccgaacccgggaacgggggtaaccgggtccggtaggggtacggttaggtaacgggtttacgggtaactacgttaccgtttaacggttaccgggtaggggtacctacccgttaccctttaacccgtaacccgtaacccccgttacctaacgtaaacgtacggtaccgtaacgtaccctaactacttcctaacgtacgttaaccgtaaccgtaaccgttaaccgtaaaccgtaacccgttaccgtttacccctacccgttaaggttaaccgttacgtaaccttcgttagtacgtaccgtccggacccggtacgggtaaccgtaccggtttcgttaagttaacgtttcggtagggtaccggacgtaacttaacggttaaccgtaacggtacgttaacggtacgggtaccggtaacttaacgttaccaacccgtaacttaacgtaccgttaacgttagttcggttttacctttaaggaccgtttaccggtacggggtaaccgggggaccgtaaaagggggtaacccgttaccggg

SEQ ID NO: 49602 - DNA, 366 bp, Homo sapiens
  misc_feature: GYAE6OF01BMDH9.33.4.A04.1.454.CMB.1.raw
  modified_base (359)..(366): a, c, t, g, unknown or other
  misc_feature (359)..(366): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagcctccaccaagggcccatcggtcttccccctggccaccctcctccaagagcacctctgggggcacagcggccctgggctgcctggtcaaggactacttccagtgtgtgtactgagcgggctggcaaggcgcatagnnnnnnnn

SEQ ID NO: 49603 - DNA, 379 bp, Homo sapiens
  misc_feature: GYAE6OF01D5LKV.33.4.A04.1.454.CMB.1.raw
  modified_base (368)..(379): a, c, t, g, unknown or other
  misc_feature (368)..(379): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagccctccaccaagggcccatccggtccttccccctggccacccctcctccaagagccacctcgtgggggcacgagccggccctgggcctgcctggtcaaggactacttccagtgtgtgtactgagcgggctggcaaggcgcatagnnnnnnnnnnnn

SEQ ID NO: 49604 - DNA, 357 bp, Homo sapiens
  misc_feature: GYAE6OF01BKW2V.33.4.A04.1.454.CMB.1.raw
  modified_base (353)..(357): a, c, t, g, unknown or other
  misc_feature (353)..(357): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgcttttgatatcgtggggccaaagggacaagggtcaccgtctcttcagcctccaccaaggcccatcgtcttcccctgcaccctcctccaagagcacctctggggcacagcggccctgggctgcctggtcaaggctactccagtgtgtgtactgagcgggctggcaaggcgcatagnnnnn

SEQ ID NO: 49605 - DNA, 373 bp, Homo sapiens
  misc_feature: GYAE6OF01B203V.33.4.A04.1.454.CMB.1.raw
  modified_base (364)..(373): a, c, t, g, unknown or other
  misc_feature (364)..(373): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgtcttttgatatcgtggggccaagggacaagggtcaccgtctcttcagcctccaccacggcccatcggtccttcccctggcaccctctcaagacgcacctcgtcggggcacgcgcggccctgggctgcctggtcaaggactacttcagtgtgtagtactggagcgggctggacgaaggcgacatagnnnnnnnnnn

SEQ ID NO: 49606 - DNA, 415 bp, Homo sapiens
  misc_feature: GYAE6OF01DN799.33.4.A04.1.454.CMB.1.raw
  modified_base (394)..(415): a, c, t, g, unknown or other
  misc_feature (394)..(415): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgtcttttgatatcgtggggaccaagggacaagggtcaccgtctctcagcctccacgaacgggcccagtccggtccttcccccgtggccacccctcctaccgaagcgcctaccgtcggtcgggccacgcggccggccgtggctcgcgtggtacaacgtacttactccgagttcgtgtcgtacgtcggacggcggcgtacggacgaacggcacgagtgnnnnnnnnnnnnnnnnnnnnnn

SEQ ID NO: 49607 - DNA, 854 bp, Homo sapiens
  misc_feature: GYAE6OF01CQ404.33.4.A04.1.454.CMB.1.raw
tcagtacacacactcacgaccggtgctcgatttagagtagtgatcagggggactttctgagagtcctggacctcctgtgcaagaacatgaaacacctgtggttcctccctcctgctggtggcagctcccagagtgggtcctcgtcccgaggtgcagctgcgaggacggtccgggcccagggacgtgggtacgaacgtccttacaaccacggtaccccttcgtcccctcaccgtcgacctacgttcgtcttcgtggttcgcctaccgataccgtaccgtaggttacggttaactacctaacgttcggtaggacgtcgttaggacctccgaccacggacccgaaccgggaagggggtaaccggccggtagggacggttaggtaacgtttcgggtactacttacggttaacgttaccgggtgggtaacgtcccttaacccgttaccgtaaacccgtaacccccgttacctaaccgtaaacgttacggaccgtaacgtccctaaacctacttcccgtaaacgttaacgtttaaaccgaacccgttaaaccggtttaaaccgtaaaaccgtaacccgttaccgtttaccgttaacccgttaacggttaaccgttaacgttaaaccgttacgttaccgttacggtaccgtaccggtaccggtaccgggtaccggtacccggtaccgttacgttacgtttacgttacgtacggtaccggtaaccgtaacgttaacgtaaccgtaacgttacgacggtttttacggacgtaacttacacctactacgtacgtacgtacttcgttacgttacgttacgttacgttacggtacggtaaccggtaaacgggtaacggtaaccggg

SEQ ID NO: 49608 - DNA, 787 bp, Homo sapiens
  misc_feature: GYAE6OF01BD7NA.33.4.A04.1.454.CMB.1.raw
tcagtacacacactcacgaccggtgctcgatttagagtagtgatcagggggactttctgagagtcctggacctcctgtgcaagaacatgaaacacctgtggttctccctcctgctggtggcagctcccagatgggtcctgtcccaggtgcagctgcaggacgtcgggcccaggacgtgggtgaacgccttcacacgacccctgtcccctcacctcgaccacttcgtcctcgtcgggtcggcctcccactccgacctacggttaggttactcgtacctacgtggacgtcgtacggctcccgccacgccgaaccggacgggacggcgtggaggtggtagttacgggtactagttacgttacgttaccgggtacgggtacgtacctaccgttacctaacccgtaaccccgtccctactaacgtacggtacgtacgtaccgtaacctacgttacctacgtaacttaccgaacgttaccgtaaaccgtaaacgtaaacccgttacgtttaccctacccgtttacggtaaacgttaccgtaaacgtttccgttagtaccggtaaccgtccgggacccgggtaaccgggtaaccggtcccggtacgtttaaggttaaccgttccggttagtaccgggtaccgtaccgtaacttaccggtaaccttaagttaccgttaagggtccggtaccgtaagttaccctacgaccctacgtaccgaagttacttcggttactttggtaaccttaggttcccgggtaaggggaacccggtaagggtaaccggtaacccgggg

SEQ ID NO: 49609 - DNA, 429 bp, Homo sapiens
  misc_feature: GYAE6OF01CL7MY.33.4.A04.1.454.CMB.1.raw
  modified_base (288)..(288): a, c, t, g, unknown or other
  misc_feature (288)..(288): n is a, c, g, or t
  modified_base (296)..(296): a, c, t, g, unknown or other
  misc_feature (296)..(296): n is a, c, g, or t
  modified_base (359)..(359): a, c, t, g, unknown or other
  misc_feature (359)..(359): n is a, c, g, or t
  modified_base (395)..(398): a, c, t, g, unknown or other
  misc_feature (395)..(398): n is a, c, g, or t
  modified_base (400)..(429): a, c, t, g, unknown or other
  misc_feature (400)..(429): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgtcttttgatatcgtggggccaagggacaagggtcaccgtctctcagcctccaccaagggcccatccggtccttcccccgtggccacccctcctaccaagcgccactcggnggggcacnggccggcccgtgggcctcgccgtggtacaaggaccttacttcccaggttgtcggtcgttacgnggaggcgggcgtcgggcgaaggccgacgacgtagcnnnncnnnnnnnnnnnnnnnnnnnnnnnnnnnnnn

SEQ ID NO: 49610 - DNA, 730 bp, Homo sapiens
  misc_feature: GYAE6OF01COZPV.33.4.A04.1.454.CMB.1.raw
  modified_base (352)..(352): a, c, t, g, unknown or other
  misc_feature (352)..(352): n is a, c, g, or t
tcagtacacacactcacgaccggtgctcgatttagagtagtgatcagggggactttctgagagtcctggacctcctgtgcaagaacatgaaacacctgtggttctccctcctgctggtggcagctcccagatgggtcctgtcccaggtgcagctgcgaggacgtcgggcccaggactggtgaacgtccttcacacgaccctcgtccctcacctgctactgtctcgtggtcgctccatccacgtagtcggttactcgtactacgtggacgcgtcggactccgaccacgccgaacccggaaggggacggccgtgggaggtggtagttcgggtactagtacgtacgtttaccggngggtacgtaccttaccttaccgtaaccctaaccccgttaccctacgtaacgttacggtaccgtacgtacctacctacttctactaacgttacgaccgtaacgttaacgtaaaaccgaaccttacgtttacccgttaccgtaggttaacgtttacgtaaccgttcgttcggtagaccgtcggacccggtacggtaaccgtaccgggtcccggttagttaacgttacggtcggtacgtaccggtactaacgttaaccgtacgtaagttacgtaggtaccggtactaattaccgtccgaactacgtaccgattacgttcgtttactttaggacttacggttccgggtagggaaacccggtaaaggggtcccggtaaccggg

SEQ ID NO: 49611 - DNA, 726 bp, Homo sapiens
  misc_feature: GYAE6OF01D9IN5.33.4.A04.1.454.CMB.1.raw
  modified_base (641)..(641): a, c, t, g, unknown or other
  misc_feature (641)..(641): n is a, c, g, or t
tcagtacacacactcacgaccggtgctcgatttagagtagtgatcagggggactttctgagagtcctggacctcctgtgcaagaacatgaaacacctgtggttctccctcctgctggtgcagctccagatgggtcctgtcccaggtgcagctgcgaggagtccgggcccaggactggtagaacgtccttcacacgaccctcgtcccctcacctgcactgtctcgtggtgctccatcactagtgttatcacgtacgtggagcgtggactccgccgacgaccgaccgaggggacggtccggtagggacggtgggtaggttacggggtactagttacgttaacggtttaccgggtagggtacgtccctacccgtttacctaacccgtaaccccgttaccctactaaacgttacggtaccggtacgtacctaacctacttacctacgtaacgttaacgacctaacgtaacgtaaacgtaaccgttacgtttacccttacccgttaggtaacgtttcgaacctttcgtaggtacgtaccgtccggacccggcgggtaccgaccgggttacgttacgttaacgtttacgtgggtacgaccggtactacggttaacctacgtacgttaacgtacggtacgccgttaanaccgtaccaaccgtataccgtacgttgttacgttacgtttagacgttcggtacgggtaggggtaacccgaagggaccggtaacgg

SEQ ID NO: 49612 - DNA, 845 bp, Homo sapiens
  misc_feature: GYAE6OF01ESUR0.33.4.A04.1.454.CMB.1.raw
tcagtacacacactcacgaccggtgctcgatttagagtagtgatcagggggactttctgagagtcctggacctcctgtgcaagaacatgaaacacctgtggttcctccctcctgctggtggcagctcccagatgggtcctgtccaggtgcagctgcaggagtcgggccaggactggtagaacgccttcacacgaccctcgtcccctcaccgtgcctactcgtctcgtgggtgcctccatccacctaggttcgttactcactactggacgcgtggacttcccgaccagacccgaacccgaggggaacggccgtgggaggtacgggtagtttcggggtactacgttaccgttaacgtttaccggtagggtacgtacccttacccttaccttaaccgaacccccgttccctacgtaaagtaacggtccgtaacgttacccaaccttacttaccgttacctaagtttaaccgtaacctaaccggttaaccgtaaaaccgtaacccttacggtttaccccttacccggttaagttaacgtttacggtaaactttaccggttacggttaaccggaccgttaccgggacccggtaccgggtaaaccggtacccgggttacccgtttaggtttaacgttttaacggtcggttacggtaacgggtacctaaacgtttaaccggttaaccgtaacttttaaccggtaaggttaccggtaccgtaaactttacctaccgtaacccttaagttccccgtaaaggttaccgttcgtttaccgtttttaacggaacgttaaccggttaccgggttaaaccgggggaacccgttaaaacgggggtaaccgttaaccgggg

SEQ ID NO: 49613 - DNA, 542 bp, Homo sapiens
  misc_feature: GYAE6OF01EJSHW.33.4.A04.1.454.CMB.1.raw
  modified_base (486)..(486): a, c, t, g, unknown or other
  misc_feature (486)..(486): n is a, c, g, or t
  modified_base (489)..(489): a, c, t, g, unknown or other
  misc_feature (489)..(489): n is a, c, g, or t
  modified_base (492)..(542): a, c, t, g, unknown or other
  misc_feature (492)..(542): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgtctttttgatatcgtggggaccaaaggggacaaaggggtccaccgtcttcttacacgtcccctacccaaccgaacgggccccacgttccggttcccttccccccgtggcccctaccccttccctacccgaaacgacgccctaacccgtccggtacggggggccaacgacggcccgggtccccgtggggtcctcggtcccgtacgggtaccgaaaacggtacccttaaccgttcccgtaaggttgttggttagtaaccgttggacgggccggggcgtacgggaccgaaacgggtccgacgtaacgtagngtncgnnnnnnnnnnnnnnnnnnnnnnnnnnnnnnnnnnnnnnnnnnnnnnnnnnn

SEQ ID NO: 49614 - DNA, 830 bp, Homo sapiens
  misc_feature: GYAE6OF01A5WV3.33.4.A04.1.454.CMB.1.raw
tcagtacacacactcacgaccggtgctcgatttagagtagtgatcagggggactttctgagagtcctggacctcctgtgcaagaacatgaaacacctgtggttcctccctcctgctggtggcagctccagatgggtcctgtccaggtgcagctgacgaggacggtccgggacccaggactgggtagaacgtccgttacaacacgtaccccgtcgtacccctcacctcgacctacgttcgttcctcgttgggtcgtacctacctacgtccgaaccgtggtttacggttactacctaaccgttacggtcgggtaacgtcgtacgggtaacctcccgaccgacgacccggaaccggtaacgggggaacggtccggtagggtacggttaggtacggttacgggtacttacgttaccgttaacggttaccgggtggaaccgttaccgttaccctttaaacccgtaacccgttaaccccggtcccttaaccgtaaacgttaccggtaccgtaacgttaccaaccttacgtaccttaacgtaacgtaaccgtaacgtaaaccgtaaacttaaaccgaacgtttaccttcccgttaaccgttaagtaacgtttacgtactttacgtacgttaccgagttcccggaccgtaccggtaccgtaccggttacgttacgttacgttcgtcggtacggctacgtaacgttaaccgtatacgttaacgtacggacgtaccttaataccgtaccgaacgttcgtaaccgttaagtcgtttaagtcgttttaacgacgttacggttaccgggtacggaaccggttaaaacggtcgttaaccccggg

SEQ ID NO: 49615 - DNA, 726 bp, Homo sapiens
  misc_feature: GYAE6OF01BHSY3.33.4.A04.1.454.CMB.1.raw
tcagtacacacactcacgaccggtgctcgatttagagtagtgatcagggggactttctgagagtcctggacctcctgtgcaagaacatgaaacacctgtggttctccctcctgctggtggcagctcccagagtcgggtcctgtcccaggtgcagctgcaggagtcgggcccaggactggtgaagccttcacacgaccctgtccctcacctgcactgtctctggtgctcatccaccaggttgttactcaactacgtcggagtctggactcccgaccgacgaccgaacccggaggggtaacgggcctagggagggtcgggtacgtttacggggtactaagtttcgttaacggttaccgggtagggtaaccgaccttacccttacccgtaaccctaaccccgtcccctaacgtaaagttaccgtacgacgttcccaacctacgtccttacgaacgttaacgaactaccgttactaaacgtaacctacgttttacctacccgttaagaaaccgtttagaaaccgtcgttcgttaacggaccttacgggtccggaccggtaaccgtaccgggttacgttggttaactttacgtcggtcggtacgtaaccgtaagtaaccgtacgtacgttactaacggtcgaaccgtatagtacccacgtactaccgtaagtacgttgttacgtttagtattcggttacggtacgggaccgtaaaggggtccgtaaccggg

SEQ ID NO: 49616 - DNA, 970 bp, Homo sapiens
  misc_feature: GYAE6OF01DCU5X.33.4.A04.1.454.CMB.1.raw
  modified_base (193)..(193): a, c, t, g, unknown or other
  misc_feature (193)..(193): n is a, c, g, or t
  modified_base (260)..(260): a, c, t, g, unknown or other
  misc_feature (260)..(260): n is a, c, g, or t
tcagtacacacactcacgaccggtgctcgatttagagtagtgatcagggggactttctgagagtcctggacctcctgtgcaagaacatagaaacacctgtgttctccctcctgctggtggcagctccagatgggtcctgtcccaggtgcagctgcgaggtacggtcgggcccaggactggtagagccttcacncgacccttcgtccctcaccgtgactactcgtctcgtggtcgtctaccgactcaccgagtttcgtacnccgtaacgtacgttggacgtcgtacggtaccgtccgaccgtacgacccaacccgggaagggggtaacgggtccgtgggaagggttcggtacggttacggggttaacctacgttaccgttacggtttaccgggaacggggtccgtaacccgttaaccctttaccccgaacccgttaaccccccggtacttaaccgtaaacgttaaccggtacgggtaacccttacccgaacctttaagtcccttaacgtaacgtttaacgaacccggttaaaccgttaaccgttaaaacccgtaccgtttaacccgtttacccgttaccccgttaagggtttaaaccgtttaccggtaaaccggtttcgtttaccggttaaccggttaaccgtcccggggtaccccggtaacccggggacccgttaacccggggtacccgtttaggttttttaacccgttacgggtttccgggtaacccgggttaccggtaacggttaaacccgtttaccgggtaaaccgtttaacggtttaaccggtttaaccggggttccgggaaaccggtttaaaccctaggtaaaccccccggttaaccaaccgggtttaaaccgaacggggtttacgttttccgggttttaacctttaggttaccggtttaacgggtttacccggggaccggggtttaaaacggggaaccggttaacgggggttaaaacccccggg

SEQ ID NO: 49617 - DNA, 501 bp, Homo sapiens
  misc_feature: GYAE6OF02FR06W.33.4.A04.1.454.CMB.1.raw
  modified_base (273)..(273): a, c, t, g, unknown or other
  misc_feature (273)..(273): n is a, c, g, or t
  modified_base (398)..(398): a, c, t, g, unknown or other
  misc_feature (398)..(398): n is a, c, g, or t
  modified_base (400)..(400): a, c, t, g, unknown or other
  misc_feature (400)..(400): n is a, c, g, or t
  modified_base (402)..(402): a, c, t, g, unknown or other
  misc_feature (402)..(402): n is a, c, g, or t
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
  modified_base (412)..(412): a, c, t, g, unknown or other
  misc_feature (412)..(412): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
  modified_base (419)..(419): a, c, t, g, unknown or other
  misc_feature (419)..(419): n is a, c, g, or t
  modified_base (421)..(423): a, c, t, g, unknown or other
  misc_feature (421)..(423): n is a, c, g, or t
  modified_base (425)..(425): a, c, t, g, unknown or other
  misc_feature (425)..(425): n is a, c, g, or t
  modified_base (427)..(427): a, c, t, g, unknown or other
  misc_feature (427)..(427): n is a, c, g, or t
  modified_base (429)..(429): a, c, t, g, unknown or other
  misc_feature (429)..(429): n is a, c, g, or t
  modified_base (431)..(431): a, c, t, g, unknown or other
  misc_feature (431)..(431): n is a, c, g, or t
  modified_base (433)..(433): a, c, t, g, unknown or other
  misc_feature (433)..(433): n is a, c, g, or t
  modified_base (435)..(438): a, c, t, g, unknown or other
  misc_feature (435)..(438): n is a, c, g, or t
  modified_base (440)..(443): a, c, t, g, unknown or other
  misc_feature (440)..(443): n is a, c, g, or t
  modified_base (445)..(445): a, c, t, g, unknown or other
  misc_feature (445)..(445): n is a, c, g, or t
  modified_base (447)..(447): a, c, t, g, unknown or other
  misc_feature (447)..(447): n is a, c, g, or t
  modified_base (454)..(454): a, c, t, g, unknown or other
  misc_feature (454)..(454): n is a, c, g, or t
  modified_base (456)..(456): a, c, t, g, unknown or other
  misc_feature (456)..(456): n is a, c, g, or t
  modified_base (458)..(458): a, c, t, g, unknown or other
  misc_feature (458)..(458): n is a, c, g, or t
  modified_base (460)..(460): a, c, t, g, unknown or other
  misc_feature (460)..(460): n is a, c, g, or t
  modified_base (468)..(468): a, c, t, g, unknown or other
  misc_feature (468)..(468): n is a, c, g, or t
  modified_base (470)..(470): a, c, t, g, unknown or other
  misc_feature (470)..(470): n is a, c, g, or t
  modified_base (476)..(476): a, c, t, g, unknown or other
  misc_feature (476)..(476): n is a, c, g, or t
  modified_base (478)..(478): a, c, t, g, unknown or other
  misc_feature (478)..(478): n is a, c, g, or t
  modified_base (481)..(481): a, c, t, g, unknown or other
  misc_feature (481)..(481): n is a, c, g, or t
  modified_base (492)..(492): a, c, t, g, unknown or other
  misc_feature (492)..(492): n is a, c, g, or t
  modified_base (500)..(500): a, c, t, g, unknown or other
  misc_feature (500)..(500): n is a, c, g, or t
tcagtacacacactcacgaccggtgctcgatttagagtagtgatcagggtagggaactggttacttagacacgtctaagaaccaggttctccctgaacgttgaacgtcctggtgactgccgcggacaccggccgtgtattacctgtgcggcgatactacggatacgtacgtggccgatactcaaccatcaccgatgcctttttgatagtctggggccaagggacaagggtcaccgtctcttcagcctccaccaaggcccatcggtcttccccnggcaccctcctcctaagacgtcacctctggggcacagcggcctagggctgacctggtcaaggtactacttcccagtagtcggtcgtacgtggtagcggggtctggtcaaggtcggcactaaggtngnangcncanatcncgngncngnnngngngntntntnnnntnnnngnanatagtgngngngngcgacatncntagtcncncgngcgcgcgcgcnctctctcnc

SEQ ID NO: 49618 - DNA, 386 bp, Homo sapiens
  misc_feature: GYAE6OF02I3A3J.33.4.A04.1.454.CMB.1.raw
  modified_base (364)..(386): a, c, t, g, unknown or other
  misc_feature (364)..(386): n is a, c, g, or t
tcagtacacacactcacgaccggtgctcgatttagagtagtgatcggagggagaactgggttcttagacacgtctaaggaaccagttctccctgaagttgaactctgtgactgccgcggacacggccgtgtattactgtgcggcatactacgatactagtggcccatatcaccatcacgatgcttttgatatctggggccaagggacaagggtcaccgtctcttcagcctcaccaagggcccatcggtcttcccctggcacctcctccaagtagcacctctggggcacagcggcctgggctcgcctggtcaaggtctacttccagtgtgtagtacctggagcgggctggctaaggcgcatacgnnnnnnnnnnnnnnnnnnnnnnn

SEQ ID NO: 49619 - DNA, 359 bp, Homo sapiens
  misc_feature: GYAE6OF02ITPAS.33.4.A04.1.454.CMB.1.raw
  modified_base (358)..(359): a, c, t, g, unknown or other
  misc_feature (358)..(359): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagcctccaccaagggcccatcggtcttccccctggcaccctcctccaagagcacctctgggggcacagcggccctgggctgcctggtcaaggactacttccagtgtgtgtactgagcgggctggcaaggcgcatagnn

SEQ ID NO: 49620 - DNA, 516 bp, Homo sapiens
  misc_feature: GYAE6OF02G7DD6.33.4.A04.1.454.CMB.1.raw
  modified_base (297)..(297): a, c, t, g, unknown or other
  misc_feature (297)..(297): n is a, c, g, or t
  modified_base (307)..(307): a, c, t, g, unknown or other
  misc_feature (307)..(307): n is a, c, g, or t
  modified_base (312)..(312): a, c, t, g, unknown or other
  misc_feature (312)..(312): n is a, c, g, or t
  modified_base (468)..(468): a, c, t, g, unknown or other
  misc_feature (468)..(468): n is a, c, g, or t
tcagtacacacactcacgaccggtgctcgatttagagtagtgatcagggggactttctgagagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtgctccatcaccagtggttatcactactggagctggatccgccagcacccagggaggcctggagtggattgggtacntctattacgngggancaccttctacaacccgtcctcaatagtcgagtcaccatctcattagacacgtctaagaacctagttcctaccctagtaacgttgaactctagtcgactgccgcggacacggccgtgtattacgtgtgcgcagtactacgatactagtcgccgatancactatcacgtatgtctttgactagtcgtgggacaagggactaacggg

SEQ ID NO: 49621 - DNA, 365 bp, Homo sapiens
  misc_feature: GYAE6OF02JCTDA.33.4.A04.1.454.CMB.1.raw
  modified_base (358)..(365): a, c, t, g, unknown or other
  misc_feature (358)..(365): n is a, c, g, or t
tcagtacacacactcacgaccggtgctcgatttagagtagtgatcagggagaactggttcattagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagcctccaccaagggcccatcggtcttccccctggcaccctcctccaagagcacctctgggggcacagcggccctgggctgcctggtcaaggctacttccagtgtgtgtactgagcgggctggcaaggcgcatagnnnnnnnn

SEQ ID NO: 49622 - DNA, 366 bp, Homo sapiens
  misc_feature: GYAE6OF02JC56C.33.4.A04.1.454.CMB.1.raw
  modified_base (340)..(340): a, c, t, g, unknown or other
  misc_feature (340)..(340): n is a, c, g, or t
  modified_base (356)..(366): a, c, t, g, unknown or other
  misc_feature (356)..(366): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagcctccaccaagggcccatcggtcttccccctggcaccctcctccaagagcacctctggggcacagcggccctgggctgcctggtcaaggactactccagtgtgtgtactgagcgggntggcaaggcgcatagnnnnnnnnnnn

SEQ ID NO: 49623 - DNA, 364 bp, Homo sapiens
  misc_feature: GYAE6OF02HCJN6.33.4.A04.1.454.CMB.1.raw
  modified_base (358)..(364): a, c, t, g, unknown or other
  misc_feature (358)..(364): n is a, c, g, or t
tcagtacacacactcacgaccggtgctcgatttagagtagtgatcagggagaactggttcattagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagcctccaccaagggcccatcggtcttcccctggcaccctcctccaagagcacctctgggggcacagcggccctgggctgcctggtcaaggactacttccagtgtgtgtactgagcgggctggcaaggcgcatagnnnnnnn

SEQ ID NO: 49624 - DNA, 546 bp, Homo sapiens
  misc_feature: GYAE6OF02IVIGR.33.4.A04.1.454.CMB.1.raw
tcagtacacacactcacgaccggtgctcgatttagagtagtgatcagggggactttctgagagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtggctccatcaccagtggttatcactactggagctggatccgccagcacccgagggaacgggcctggagtggattgggtacatctattaccggtgggagcaccttctaccaacccgtcctacaatagtcgagtcaccatctcattagacacgtctaaagaccagttcctccctagaagttcgaacttctgtgactgccgcggacacggccttagtattcgtgtgcggacatactacgattactaggtcggacctatacgtccaacctatccacgtatcgttacttttagattacgtccgtagggggacctaaggggacctaacggg

SEQ ID NO: 49625 - DNA, 365 bp, Homo sapiens
  misc_feature: GYAE6OF02G066W.33.4.A04.1.454.CMB.1.raw
  modified_base (358)..(365): a, c, t, g, unknown or other
  misc_feature (358)..(365): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagcctccaccaagggcccatcggtcttcccctggcaccctctccaagagcacctctgggggcacagcggccctgggctgccctggtcaaggactacttccagtgtgtgtactgagcggggctggcaaggcgcatagnnnnnnnn

SEQ ID NO: 49626 - DNA, 401 bp, Homo sapiens
  misc_feature: GYAE6OF02FWFGW.33.4.A04.1.454.CMB.1.raw
  modified_base (365)..(366): a, c, t, g, unknown or other
  misc_feature (365)..(366): n is a, c, g, or t
  modified_base (368)..(401): a, c, t, g, unknown or other
  misc_feature (368)..(401): n is a, c, g, or t
tcagtacacacactcacgaccggtgctcgatttagagtagtgatcaggggagaactgggttcattagacacgtctaagaaccagttctccctgaagttgaactctgtgacctgccgcggacaccggccgtgtatttactgtgcggcatactacgatactagtggccgatatcaccatcacgatgcttttgatatctggggccaagggacaagggtcaccgcctcttcagcctccaccaagggcccatccggtcttccccctggcacccttcctccaagagcacctctgggggcacagcggccctgggctgcctggtcaaggctacttccagtgtgtgtactgagcgggctggcaaggcgcatagnngnnnnnnnnnnnnnnnnnnnnnnnnnnnnnnnnnn

SEQ ID NO: 49627 - DNA, 363 bp, Homo sapiens
  misc_feature: GYAE6OF02HMLXO.33.4.A04.1.454.CMB.1.raw
  modified_base (358)..(363): a, c, t, g, unknown or other
  misc_feature (358)..(363): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagcctccaccaagggcccatcggtcttccccctggcaccctcctccaagagcacctctggggcacagcggccctgggctgccctggtcaaggactacttccagtgtgtgtactgagcgggctggcaaggcgcatagnnnnnn

SEQ ID NO: 49628 - DNA, 425 bp, Homo sapiens
  misc_feature: GYAE6OF02F1KPY.33.4.A04.1.454.CMB.1.raw
  modified_base (378)..(378): a, c, t, g, unknown or other
  misc_feature (378)..(378): n is a, c, g, or t
  modified_base (381)..(425): a, c, t, g, unknown or other
  misc_feature (381)..(425): n is a, c, g, or t
tcagtacacacactcacgaccggtgctcgatttagagtagtgatcaggggagaactggttcttagacacgtctaagaaccagttctccctgaagttgaactctgtgactgccgcggacacggccgtgtattactcgtgcggcatacgtacgatactagtggtccgattatcaccatcacgatgcttttgatatctggggccaagggacaagggtcaccgtctcttcagcctccaccaaagggccccatcggtccttccccctggccacccctcctcccaagcgcacctctcgggggctacagcggccctgggctgcctggtcaaggactacttccagtgtgtgtactgacgcgggactggacaaggcgcgaagtaganagnnnnnnnnnnnnnnnnnnnnnnnnnnnnnnnnnnnnnnnnnnnnn

SEQ ID NO: 49629 - DNA, 366 bp, Homo sapiens
  misc_feature: GYAE6OF02I2ZIT.33.4.A04.1.454.CMB.1.raw
  modified_base (358)..(366): a, c, t, g, unknown or other
  misc_feature (358)..(366): n is a, c, g, or t
tcagtacacacactcacgaccggtgctcgatttagagtagtgatcagggagaactggttcattagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagcctccaccaagggcccatcggtcttccccctggcaccctcctccaagagcacctctgggggcacagcggccctgggctgcctggtcaaggctacttccagtgtgtgtactgagcgggctggcaaggcgcatagnnnnnnnnn

SEQ ID NO: 49630 - DNA, 364 bp, Homo sapiens
  misc_feature: GYAE6OF02GMKAO.33.4.A04.1.454.CMB.1.raw
  modified_base (359)..(364): a, c, t, g, unknown or other
  misc_feature (359)..(364): n is a, c, g, or t
tcagtacacacactcacgaccggtgctcgatttagagtagtgatcagggagaactggttcattagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagcctccaccaagggcccatcggtcttccccctggcaccctcctccaagagcacctctgggggcacagcggccctgggctgcctggtcaaggactacttccagtgtgtgtactgagcgggctggcaaggcgcatagnnnnnn

SEQ ID NO: 49631 - DNA, 520 bp, Homo sapiens
  misc_feature: GYAE6OF02FIQ0K.33.4.A04.1.454.CMB.1.raw
tcagtacacacactcacgaccggtgctcgatttagagtagtgatcagggggactttctgagagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtggctccatcaccagtggttatcactactggagctggatccgccagccaccccgaggggaagggcctgggagtggattgggtacatctattaccggtgggagcaccttctaccaacccgtccctcaatagtcgagtcaccatctcattagacacgtctaagaccagttctccctgtaagttgaactctgtcgactgccgcggacacggcgtgtattactgtgcggcatactagattacagtcggcgatatacaccatcacgatgtctttgacttatcgtggggaccaagggactaacggg

SEQ ID NO: 49632 - DNA, 564 bp, Homo sapiens
  misc_feature: GYAE6OF02I8S5M.33.4.A04.1.454.CMB.1.raw
  modified_base (251)..(251): a, c, t, g, unknown or other
  misc_feature (251)..(251): n is a, c, g, or t
tcagtacacacactcacgaccggtgctcgatttagagtagtgatcagggggactttctgagagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtgctccatcaccagtggtatcactactgganctggatccgccagcacccagggaaggcctggagtggattgggtacatctattaccgtgggagcacttcacaacccgtcctacaatagtcgagtccacatctacattagacacgtactaacgaacctagttcctccctagaacgctgaccctgtcgtcgacccgcccgcagaccgacggcttaggtactaattacgtgttcgacgaagacaagtaaccgggggtagtcggagtcgttaagtcggggaccgacgggtaaccctggtaccaccgtccgttccgtaccacggccctcccgaccgtacggccctacgg

SEQ ID NO: 49633 - DNA, 534 bp, Homo sapiens
  misc_feature: GYAE6OF02FGF6R.33.4.A04.1.454.CMB.1.raw
  modified_base (321)..(321): a, c, t, g, unknown or other
  misc_feature (321)..(321): n is a, c, g, or t
  modified_base (424)..(424): a, c, t, g, unknown or other
  misc_feature (424)..(424): n is a, c, g, or t
  modified_base (432)..(432): a, c, t, g, unknown or other
  misc_feature (432)..(432): n is a, c, g, or t
tcagtacacacactcacgaccggtgctcgatttagagtagtgatcagggggactttctgagagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtggctccatcaccagtggttatcactactggagctggatccgccagccacccgaggggacgggcctgggagtggattgggtacatctattaccggtgggancaccttctaccaaccgtccctcaatagtcgagtcaccatctcattagacacgtctaagaaccagttcctccctgaagttgaacttctgtgactgccgcggacncggccgtntattactgtgcggcagttaccaacgattacgtagtcggacctatactcaccatccacgatcgttacttttgattcgtcgtgggaccaagggtacctaacggg

SEQ ID NO: 49634 - DNA, 527 bp, Homo sapiens
  misc_feature: GYAE6OF02INKAH.33.4.A04.1.454.CMB.1.raw
  modified_base (317)..(317): a, c, t, g, unknown or other
  misc_feature (317)..(317): n is a, c, g, or t
  modified_base (402)..(402): a, c, t, g, unknown or other
  misc_feature (402)..(402): n is a, c, g, or t
tcagtacacacactcacgaccggtgctcgatttagagtagtgatcagggggactttctgagagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtcccctcacctgcactgtctctggtgctccatcaccagtggttatcactactggagctggatccgccagcaccgagggaaggcctggagtgggattgggtacatctagttaccgtgggancaccttctacaacccgtcctcaatagtcgagtccaccatctcattagacacgtctaagaaccagttctccctagaagttgaactntgtgactcgccgcggacacggccgtgtacttactgtgcggcatactacgatactagtcggaccgatactcaccatcacgattgtcttttagattactcggtcggggaccgaagggacgtaacggg

SEQ ID NO: 49635 - DNA, 365 bp, Homo sapiens
  misc_feature: GYAE6OF02HCGQW.33.4.A04.1.454.CMB.1.raw
  modified_base (357)..(365): a, c, t, g, unknown or other
  misc_feature (357)..(365): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagcctccaccaagggcccatcggtcttccccctggcaccctcctccaagagcacctctgggggcacagcggccctgggctgcctggtcaaggactactccagtgtgtgtactgagcgggctggcaaggcgcatagnnnnnnnnn

SEQ ID NO: 49636 - DNA, 365 bp, Homo sapiens
  misc_feature: GYAE6OF02JD8NW.33.4.A04.1.454.CMB.1.raw
  modified_base (357)..(365): a, c, t, g, unknown or other
  misc_feature (357)..(365): n is a, c, g, or t
tcagtacacacactcacgaccggtgctcgatttagagtagtgatcagggagaactggttcttagacacgtctaagaaccagttctccctgaagttgaactctgtgactgccgcggacacggccgtttattactgtgcggcatactacgatactagtggccgatatcaccatcacgatgcttttgatatctggggccaagggacaagggtcaccgtctcttcagcctccaccaagggcccatcggtcttccccctggccaccctcctccaagagcacctctgggggcacagcgccctgggctgcctggtcaggactacttccagtgtgtgtactgagcgggctggcaaggcgcatagnnnnnnnnn

SEQ ID NO: 49637 - DNA, 534 bp, Homo sapiens
  misc_feature: GYAE6OF02F0PPV.33.4.A04.1.454.CMB.1.raw
  modified_base (420)..(420): a, c, t, g, unknown or other
  misc_feature (420)..(420): n is a, c, g, or t
tcagtacacacactcacgaccggtgctcgatttagagtagtgatcagggggactttctgagagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtggctccatcaccagtggttatcactactggagctggatccgccagcacccagggaggcctggagtggattgggtacatctattaccgtgggagcaccttctacaacccgtcctcaatagtcgagtcaccatctcattacgacacgtactaagaaccagttcctccctagaacgttgaactctgtcgactgccgcggacncggcgtgtacttactgttagcggactagtactacgattacgtagtcggaccatactaccactatcacggatcgtcttttagattactcgtggggacctaaggggactaacgggg

SEQ ID NO: 49638 - DNA, 366 bp, Homo sapiens
  misc_feature: GYAE6OF02G5LRI.33.4.A04.1.454.CMB.1.raw
  modified_base (357)..(366): a, c, t, g, unknown or other
  misc_feature (357)..(366): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagcctccaccaagggcccatcggtcttccccctggcaccctcctccaagagcacctctgggggcacagcggccctggctgcctggtcaaggactacttccagtgtgtgtactgagcgggctggcaaggcgcatagnnnnnnnnnn

SEQ ID NO: 49639 - DNA, 380 bp, Homo sapiens
  misc_feature: GYAE6OF02GD2AW.33.4.A04.1.454.CMB.1.raw
  modified_base (369)..(380): a, c, t, g, unknown or other
  misc_feature (369)..(380): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagcctccaccacgggcccatcggtccttccccctggccacccctcctcccaagacgcaccctcgtgggggcacgagccggcccgtgggctcgcctggtcaaggactacttccagtgtgtgtactgagcgggctggcaaggcgcatagnnnnnnnnnnnn

SEQ ID NO: 49640 - DNA, 508 bp, Homo sapiens
  misc_feature: GYAE6OF02JFP8R.33.4.A04.1.454.CMB.1.raw
  modified_base (314)..(314): a, c, t, g, unknown or other
  misc_feature (314)..(314): n is a, c, g, or t
  modified_base (333)..(333): a, c, t, g, unknown or other
  misc_feature (333)..(333): n is a, c, g, or t
  modified_base (435)..(435): a, c, t, g, unknown or other
  misc_feature (435)..(435): n is a, c, g, or t
tcagtacacacactcacgaccggtgctcgatttagagtagtgatcagggggactttctgagagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtgctccatcaccagtgttatcactactggagctggatccgccagcacccagggaaggcctggagtggattgggtacatctagttaccgtgggancacttctacacccgtcctnaatagtcgagtcaccatctcattagacacgtctaaagaaccagtttcctccctagaagttcgaactctgtgactggccgtcggacacggccgtagtattacngtgcgcatacagatacgtagtcgcgatatcacatcactatgtctttgattgtcgtgggacagggactaacggg

SEQ ID NO: 49641 - DNA, 368 bp, Homo sapiens
  misc_feature: GYAE6OF02GSZW5.33.4.A04.1.454.CMB.1.raw
  modified_base (361)..(368): a, c, t, g, unknown or other
  misc_feature (361)..(368): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagcctccaccaagggcccatcggtcttccccctggccaccctcctccaagagcacctcgtggggcacagccggcccgtgggctgcctggtcaaggactacttccagtgtgtgtactgagcgggctggcaaggcgcatagnnnnnnnn

SEQ ID NO: 49642 - DNA, 568 bp, Homo sapiens
  misc_feature: GYAE6OF02HEQJO.33.4.A04.1.454.CMB.1.raw
tcagtacacacactcacgaccggtgctcgatttagagtagtgatcagggggactttctgagagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtggctccatcaccagtgttatcactactggagctggatccggcacgcccccagggacggggactgggagtggattggttatgttcttcacaagtggacaattaccgactaccaaccctcctacaagagtcgagtcaccacatacagtagacacgtaccaagaaccacttcctccctagaaactctgacccttctacgtcgaccgctggccgacgaccggtcctactattactgtcgacggagagcccgtacgagctaggtgggtacgttccttacgtttcggacttacggtcgggacctacgggtactcccggttggtacctacccggtctcccttcgtcgtaccccg

SEQ ID NO: 49643 - DNA, 371 bp, Homo sapiens
  misc_feature: GYAE6OF02FJ6PB.33.4.A04.1.454.CMB.1.raw
  modified_base (358)..(371): a, c, t, g, unknown or other
  misc_feature (358)..(371): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagcctccaccaagggcccatcggtcttcccctggcaccctcctcccaagagcacctctgggggcacagcggccctgggctgcctggtcaaggactacttccagtgtgtgtactgagcgggctggcaaggcgcatagnnnnnnnnnnnnnn

SEQ ID NO: 49644 - DNA, 697 bp, Homo sapiens
  misc_feature: GYAE6OF02FKWAO.33.4.A04.1.454.CMB.1.raw
  modified_base (202)..(202): a, c, t, g, unknown or other
  misc_feature (202)..(202): n is a, c, g, or t
  modified_base (241)..(241): a, c, t, g, unknown or other
  misc_feature (241)..(241): n is a, c, g, or t
tcagtacacacactcacgaccggtgctcgatttagagtagtgatcagggggactttctgagagtcctggacctcctgtgcaagaacatgaaacacctgtggttctccctcctgctggtggcagctcccagatgggtcctgtcccaggtgcagctgcaggagtcggcccaggactggtgaagccttcacagaccctgtccctnacctgcactgtctctggtcgctcatcacctagttgttancactacgtggagctggactccgcagccacccgtagggaacggtcctgggagtggtagttcggggaccattaccgttaacgtttaccgggtggggaactccgtaaccctttccgtaacccgtaaccccggtccctacgtaaacgttacggtaccgtaagttacccaacctaattccgtactaagttaccgaaccgtaccgttaacctaaacggaacccttacgtttcctacccgtaggtaaacgttcgtaaaccttcgtacgtcgtaccgtcggtacccgtacggaccgtacggtccgttagttaacgttcgtcggttacgccgtactactacgtaacgtacttacgtacggttacgaaccgttacttactaccaccgtagttaccgaacgttacgtcgtttacctttaggaacttacgtccggtacgggtacccgtaaggggtaccgttaaccggg

SEQ ID NO: 49645 - DNA, 681 bp, Homo sapiens
  misc_feature: GYAE6OF02HF3I0.33.4.A04.1.454.CMB.1.raw
tcagtacacacactcacgaccggtgctcgatttagagtagtgatcagggggactttctgagagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtgctccatcacagtgttatcactactggagctggactccgccagccacccgaggggaacggcctggacggtggagttgggtacagttcttaagttaccggtgggacgtcctaacccgtttacctaacccgtaaccccgttcccctactaaacgtacggtaccgtaacgtccaaccctattccttactaatttaacgaacctacgtacctaaaacgaaccctaggtttcccttacccgtaggtaaacgtttcgaaaccttcgttaggtacgtaccgttcggaccccggtacgggaacccgtacccgggtccgttagttaactttaccgtggtcgccggtactaagttaccgtaacgtacgttaccgtagggtacggaccgtattactaccacctatccgaacgtagttcgttacttttagacgtttacgtccggtacggggacctaaggggtactaaccggg

SEQ ID NO: 49646 - DNA, 364 bp, Homo sapiens
  misc_feature: GYAE6OF02FXW17.33.4.A04.1.454.CMB.1.raw
  modified_base (356)..(364): a, c, t, g, unknown or other
  misc_feature (356)..(364): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgcttttgatatctgggccaagggacaagggtcaccgtctcttcagcctccaccaagggcccatcggtcttccccctggccaccctcctccaagagcacctctgggggcacagcggccctgggctgcctggtcaggactacttccagtgtgtgtactgagcgggctggcaggcgcatagnnnnnnnnn

SEQ ID NO: 49647 - DNA, 377 bp, Homo sapiens
  misc_feature: GYAE6OF02HZ10N.33.4.A04.1.454.CMB.1.raw
  modified_base (351)..(351): a, c, t, g, unknown or other
  misc_feature (351)..(351): n is a, c, g, or t
  modified_base (359)..(359): a, c, t, g, unknown or other
  misc_feature (359)..(359): n is a, c, g, or t
  modified_base (364)..(377): a, c, t, g, unknown or other
  misc_feature (364)..(377): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagcctccaccaagggcccatcggtcttccccctggccaccctcctccagagccacctcgtggggcacgagcggccctgggctgccgtggtcaacggtactacttccagtgtgtgtactgagcgggctggngaaggcgnatagnnnnnnnnnnnnnn

SEQ ID NO: 49648 - DNA, 689 bp, Homo sapiens
  misc_feature: GYAE6OF02GDE6E.33.4.A04.1.454.CMB.1.raw
tcagtacacacactcacgaccggtgctcgatttagagtagtgatcagggggactttctgagagtcctggacctcctgtgcaagaacatgaaacacctgtggttctccctcctgctggtggcagctcccagatgggtcctgtcccaggtgcagctgcaggagtcgggcccaggactggtgaagccttacacacgaccctcgtccctcacctgccactcgtctcgtggtgcctccatccacctagttcggttatccactacgtggacgcgtcggtactcccgacacgccaccgaggggacggcctggaggtggtagtgggtactagttacgtacgttaccggtgggacgtaccgtaccttcgtaacccaaccccgtcctactaacgtacgtcgtacgccaacctactactactattaacgactaacgtactaaacgaacctcgttaccctacccgttagaacgttgtaaccttcgtagtactaccgtcggacccggtacgaccgtaccggttacccgttagttaacgttcgtgggtcgaccgtacctaacgttaccgtaacgtactttaacggtaccggtcgtaaccgtattaacccggttcaacccgttagttaacccgaagtcttaccgtttacgtttacgacgtttaccggtcggtaacgggaacccggtagggtaccgttaacccgg

SEQ ID NO: 49649 - DNA, 713 bp, Homo sapiens
  misc_feature: GYAE6OF02I6JEM.33.4.A04.1.454.CMB.1.raw
  modified_base (175)..(175): a, c, t, g, unknown or other
  misc_feature (175)..(175): n is a, c, g, or t
  modified_base (551)..(551): a, c, t, g, unknown or other
  misc_feature (551)..(551): n is a, c, g, or t
  modified_base (573)..(573): a, c, t, g, unknown or other
  misc_feature (573)..(573): n is a, c, g, or t
  modified_base (582)..(582): a, c, t, g, unknown or other
  misc_feature (582)..(582): n is a, c, g, or t
tcagtacacacactcacgaccggtgctcgatttagagtagtgatcagggggactttctgagagtcctggacctcctgtgcaagaacatgaaacacctgtgttctccctcctgctggtgcagctcccagatgggtcctgtcccaggtgcagctgcaggagtcgggccaggactggngaacgccttcactagaccctgtccctcacctgcactgtctcgtggtcgacctcagtccaccgtagtggttaatccacgtacgtggacgcgtggtactccgactacgacccgaaccggaggggtaacggccctagggagtggtagttcgggactagtccgttagtaccgggtgggaacctctacccttttacgaacccgtaaccccgttcctaacgtaagttacggaccggtaactccgaacccttaactccgttactaacgttaacgaacccgtaccgttaccgtaaaacgaccgttacgttccctacgtaggtaacgtttcgaacttcgttcgagtacgcgtacccgcggtaacgtcgtcgttagtacgttacgngtcgcgtataccgtaagtccgngttaaacgnggttaccgagttaacgtacctaccgtaccgtaacgtccgtaacgtttaacgtccggtttacttttaaggaaccgttccggttaccggggttaccgggaaacggttaacggggtacccggtttaaacccggg

SEQ ID NO: 49650 - DNA, 471 bp, Homo sapiens
  misc_feature: GYAE6OF02HVN7Q.33.4.A04.1.454.CMB.1.raw
  modified_base (297)..(297): a, c, t, g, unknown or other
  misc_feature (297)..(297): n is a, c, g, or t
  modified_base (415)..(415): a, c, t, g, unknown or other
  misc_feature (415)..(415): n is a, c, g, or t
  modified_base (418)..(419): a, c, t, g, unknown or other
  misc_feature (418)..(419): n is a, c, g, or t
  modified_base (421)..(421): a, c, t, g, unknown or other
  misc_feature (421)..(421): n is a, c, g, or t
  modified_base (423)..(423): a, c, t, g, unknown or other
  misc_feature (423)..(423): n is a, c, g, or t
  modified_base (425)..(471): a, c, t, g, unknown or other
  misc_feature (425)..(471): n is a, c, g, or t
tcagtacacacactcacgaccggtgctcgatttagagtagtgatcagggagaactggttcttagacacgtctaagaaccagttctccctgaagttgaactctgtgactgccgcgacacggccgtttattactgtgcggcatactacgatactagtggccgatatcaccatcacgatgcttttgatatgtgggccaaagggacaagggtcaccgtctctcagcctaccaccgaaggccagtccggtaccttccccctggcacccctctaccaagacgctacccgtgtacggggccaanacggccgaccccgtggggcttcggcctcggtacaaaggtacctaccttaccgagtacgtggttactaacgtgaaggtccggggtctcgggacgtaaaggccgaccgtaaagtacgganagnngngngnnnnnnnnnnnnnnnnnnnnnnnnnnnnnnnnnnnnnnnnnnnnnnn

SEQ ID NO: 49651 - DNA, 362 bp, Homo sapiens
  misc_feature: GYAE6OF02GSORV.33.4.A04.1.454.CMB.1.raw
  modified_base (357)..(362): a, c, t, g, unknown or other
  misc_feature (357)..(362): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagcctccaccaagggcccatcggtcttccccctggcaccctcctccaagagcacctctgggggcacagcggccctgggctgcctggtcaaggctacttccagtgtgtgtactgagcgggctggcaaggcgcatagnnnnnn

SEQ ID NO: 49652 - DNA, 640 bp, Homo sapiens
  misc_feature: GYAE6OF02IF0UQ.33.4.A04.1.454.CMB.1.raw
tcagtacacacactcacgaccggtgctcgatttagagtagtgatcagggggactttctgagagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtgctccatcaccagtggttatcactactggagctggactccgccagccaccgagggacggcctggaggtggattgggtacattccgtaagttacccggtgggacgcctactttcctacaaccccgtcctacaatacgcgaagtccacctatctctattacgacctacgttactaaacgtaccctacgtttcctacccgttagtaaacgtttacgaacttctcgtacgtaccgtcggaccccggtccggtaaccggacccgggtcccgttaggttaacgtttacgttcgggttgccgggactacgtaccttaacggtactaacgttaggtcggaccgtagtactactaacctacgtacgtaccgtatccggttcttttaggattacgtcggtacggggaccgtaagggacccgtaacgggg

SEQ ID NO: 49653 - DNA, 688 bp, Homo sapiens
  misc_feature: GYAE6OF02GTMIS.33.4.A04.1.454.CMB.1.raw
  modified_base (241)..(241): a, c, t, g, unknown or other
  misc_feature (241)..(241): n is a, c, g, or t
  modified_base (250)..(250): a, c, t, g, unknown or other
  misc_feature (250)..(250): n is a, c, g, or t
  modified_base (258)..(258): a, c, t, g, unknown or other
  misc_feature (258)..(258): n is a, c, g, or t
  modified_base (326)..(326): a, c, t, g, unknown or other
  misc_feature (326)..(326): n is a, c, g, or t
  modified_base (332)..(332): a, c, t, g, unknown or other
  misc_feature (332)..(332): n is a, c, g, or t
tcagtacacacactcacgaccggtgctcgatttagagtagtgatcagggggactttctgagagtcctggacctcctgtgcaagaacatgaaacacctgtggttctccctcctgctggtggcagctcccagatgggtcctgtcccaggtgcagctgcaggagtccgggcccaggactggtgaacgccttcacacgacccctgtcccctcacctgcactgtcctcgtggtcgctccatcaccngttcgttancactacgnggagctggactccgaccagccaccgagggacggcgtggacgtggagttggtacatcgtagttaccggngggacnctaccgttcaacccgtacccgtccactaacgtcgtacgactaccactatctctaagttacgacgtacgttacaaacgtaacctcgttccctaccgtaaggtaacgtttacgaaccgttacgtacgtacggaccgtccggaccccggtacggaccgtaacccggggtccgtttacgggttaacgtttaccggttacgggtccggtacccgggaacttaaccggttaaccgttaacgtaacgtttaccgtacggtccgtaaccgtactacttacccaaccgtatccggaacttacgtcgttaacgttttgaacgtttaccggtcggtaaccggggtacgaacgggtacgtaaccgggg

SEQ ID NO: 49654 - DNA, 656 bp, Homo sapiens
  misc_feature: GYAE6OF02HOVHK.33.4.A04.1.454.CMB.1.raw
tcagtacacacactcacgaccggtgctcgatttagagtagtgatcagggggactttctgagagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtgctccatcaccagtggttactcactacgtggagctggactcccgccgagccgaacccgtaaggggaacggcctagggagtggtagttcgggtaaccagttaccgttaagttaccggtgggactctacccgttctaaccgtaacccgttcctacaaacgtacgtcgagtccactatctactattaacgactaacgttactaaacgtaaccctagtttacctacccgttaggtaaacgttcgaacttctaggtacgtaccgtcggaccggcggtaaccgaccgggtaccgttagtaacttcgtcgtacggtaccgtactaacgttaacgtaacgtactttaacgtacggtcgaccgtaattcgacctaactacgtacgacgtgttacgttcctttagtacttacgtaccggttggggacctaaggggtactaacggg

SEQ ID NO: 49655 - DNA, 415 bp, Homo sapiens
  misc_feature: GYAE6OF02JW4E3.33.4.A04.1.454.CMB.1.raw
  modified_base (398)..(398): a, c, t, g, unknown or other
  misc_feature (398)..(398): n is a, c, g, or t
  modified_base (403)..(415): a, c, t, g, unknown or other
  misc_feature (403)..(415): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgtcttttgatatcgtggggccaaagggacaaggggtcacccgttctcttacacgccctccaaccgaacgggccccatccggtcccttccccctggcccacccctcctccctaagacgcaccctcgtgggggccacagcggccccgtcgggcgtcgccctggtcaacggacttacctctaggtcgtgtgttactgaggcggggtcgtggccgtaaggcgacntacgnnnnnnnnnnnnn

SEQ ID NO: 49656 - DNA, 556 bp, Homo sapiens
  misc_feature: GYAE6OF02IKKS0.33.4.A04.1.454.CMB.1.raw
  modified_base (498)..(498): a, c, t, g, unknown or other
  misc_feature (498)..(498): n is a, c, g, or t
  modified_base (500)..(501): a, c, t, g, unknown or other
  misc_feature (500)..(501): n is a, c, g, or t
  modified_base (503)..(503): a, c, t, g, unknown or other
  misc_feature (503)..(503): n is a, c, g, or t
  modified_base (505)..(505): a, c, t, g, unknown or other
  misc_feature (505)..(505): n is a, c, g, or t
  modified_base (508)..(510): a, c, t, g, unknown or other
  misc_feature (508)..(510): n is a, c, g, or t
  modified_base (512)..(513): a, c, t, g, unknown or other
  misc_feature (512)..(513): n is a, c, g, or t
  modified_base (515)..(532): a, c, t, g, unknown or other
  misc_feature (515)..(532): n is a, c, g, or t
  modified_base (534)..(556): a, c, t, g, unknown or other
  misc_feature (534)..(556): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgtcttttgatatcgtggggccaagggacaagggtccaccgtctcttcacgccctccaccgaacggcccattccggtcccttccccctggccacccctccctcccaagacgccacccttcggtacggggggccaaccgacggccggcccccgtacggggccttcggaccccgttgggggtacccgtaaaaacggggtaccccttaacccgttttaccccgacggttttcggttagggtttacggtacccgtcgggaaggccgggggggtacccttggggacccctaaaacgggggtccccgacgtaaaacgttacggctagncnncncnagnnnanntnnnnnnnnnnnnnnnnnncnnnnnnnnnnnnnnnnnnnnnnn

SEQ ID NO: 49657 - DNA, 452 bp, Homo sapiens
  misc_feature: GYAE6OF02I04QF.33.4.A04.1.454.CMB.1.raw
  modified_base (420)..(452): a, c, t, g, unknown or other
  misc_feature (420)..(452): n is a, c, g, or t
tcagtacacacactcacgaccggtgctcgatttagagtagtgatcagggagaactgggttcttagacacgtctaagaaccagttctccctgaagttgaactctgtgactgccgcggacacggccgtgtattactgtgcggcatactacgatactagtggccgatatcaccatcacgatgcttttgatatcgtggggccaaggggacaaggggtcaaccgtctcttcacgccctccaccaacgggacccagttccggtccttccccccgtaggcccacccctcctaccgaacgacgcctaccgtcggtcggggccaacgcggccggtcccgtcgggctccggccgtcggtacgaacggtaccttaccgtccgaggttggtcgttcgtacgtggacggcggcgtcggacgacggcgacatgnnnnnnnnnnnnnnnnnnnnnnnnnnnnnnnnn

SEQ ID NO: 49658 - DNA, 689 bp, Homo sapiens
  misc_feature: GYAE6OF02GUBRF.33.4.A04.1.454.CMB.1.raw
tcagtacacacactcacgaccggtgctcgatttagagtagtgatcagggggacgtttctgagagtcctggacctcctgtgcaagaacatgaaacacctgtggttctccctcctgctggtggcagctcccagatgggtcctgtcccaggtgcagctgcaggacgtcgggccaggactggtgaacgccttacacacgaccctcgtccctcacctgcactgtctctgggtgctcatcgacctagtgttatacactacgtggagtctggactccgaccagccaacccggaggggaacggcccgtagggagtaggtagttagggtacagttacgtaacgttaccggtaggacggtaccttaccttaccgtaacccgtaacccttcctactaacgttacgtacgaacgtaccactattcctaactaactaacgactaccgtactaaacgtacctacgtttcctaccgtagtaacgttagtaaccgtcgttagtacggtcctccggaccggtacggtaacgaccgggttccttaaggttaccttacgttcggacggccgttaactacgttaacggtaactacgtttaacgtggtacggtacctaagtaccttcgaaaccgtactaccggtaatacgttcgttaaccgttttgaaccgttgtaccgggtacgggaccgtacgggttacgtaacccgg

SEQ ID NO: 49659 - DNA, 480 bp, Homo sapiens
  misc_feature: GYAE6OF02GUGYG.33.4.A04.1.454.CMB.1.raw
  modified_base (421)..(421): a, c, t, g, unknown or other
  misc_feature (421)..(421): n is a, c, g, or t
  modified_base (424)..(428): a, c, t, g, unknown or other
  misc_feature (424)..(428): n is a, c, g, or t
  modified_base (433)..(433): a, c, t, g, unknown or other
  misc_feature (433)..(433): n is a, c, g, or t
  modified_base (435)..(480): a, c, t, g, unknown or other
  misc_feature (435)..(480): n is a, c, g, or t
tcagtacacacactcacgaccggtgctcgatttagagtagtgatcagggagaactggttcattagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcacgtctcttcagcctccacgaacgggcccagtccggtccttccccctggccacccctccctccaacgacgccacctcgtcggggggcaccgacggccggccccgtggggcctcggccgttcggtacgaacggacttaccgttcccgaggttcgttggtcgttacgtcgggacgggccgggtcgtcgggacgtaagggccgacgaataggntcnnnnngcagncnnnnnnnnnnnnnnnnnnnnnnnnnnnnnnnnnnnnnnnnnnnnnn

SEQ ID NO: 49660 - DNA, 710 bp, Homo sapiens
  misc_feature: GYAE6OF02I0HDW.33.4.A04.1.454.CMB.1.raw
  modified_base (383)..(383): a, c, t, g, unknown or other
  misc_feature (383)..(383): n is a, c, g, or t
  modified_base (445)..(445): a, c, t, g, unknown or other
  misc_feature (445)..(445): n is a, c, g, or t
  modified_base (586)..(586): a, c, t, g, unknown or other
  misc_feature (586)..(586): n is a, c, g, or t
tcagtacacacactcacgaccggtgctcgatttagagtagtgatcagggggactttctgagagtcctggacctcctgtgcaagaacatgaaacacctgtggttctccctctgctggtggcagctccagatgggtcctgtcccaggtgcagctgcagggacgtcgggcccaggactggtacgaacgtccttacaacgacgtcccttcgtcccctacacccgtgacctacgttcgtccttcgtacgggtcgcctaccactccgaaccgtaggttcggttaactcctaaccgtacgtggacgtcgtaggacctcccgcaggacccaccggaaggggacggtctgggtacgtaggtacgttacgggactgttcgtaacgttccgggngggacctacctaccttcgtaacccgtaccccgttcactaagttcgcggtactaccacgttancgttaaccaagttaccacgttaacgtacctaaaacggtaccttacgtttaccctaccgtagttaacgttacgtaacttcgtacggtcgtaccgtcgaccggaccggaacgtccgggtacgttacgttaacgttcggtaggngtaccgtactaacgtactaacgtattacgtacggtcacgtactaccgtacaacgtcctacggacttactcggtttaactttagactcggttacgtaccgggaacggttacggaaccggttacgg

SEQ ID NO: 49661 - DNA, 674 bp, Homo sapiens
  misc_feature: GYAE6OF02GSGEB.33.4.A04.1.454.CMB.1.raw
  modified_base (60)..(60): a, c, t, g, unknown or other
  misc_feature (60)..(60): n is a, c, g, or t
  modified_base (618)..(618): a, c, t, g, unknown or other
  misc_feature (618)..(618): n is a, c, g, or t
tcagtacacacactcacgaccggtgctcgatttagagtagtgatcgagggggactttctnagagtcctggacctcctgtgcaagaacatgaaacacctgtggttctccctcctgctggtggcagctcccagatgggtcctgtcccaggtgcagctgcgaggacgtcgggcccaggactggtagaagccttcgacagacccctggtccctcacctgcactgtctcgtggtgctcatcacagtgtactcactatgagtctggactccgcagccaccgagggaacggtccgtggagtggattcgggtacagtacgtacgttaccggtgggacgtcctaccgttacctaacccgtaaaccccggttccctaacgtaaacgttacggtaccgtaacggttacccaacctagttaccgtactaactttaacgaacctaaccgtttaccgtaaaacgtaaacccgtaggtttccctaccccgtaggtaaaccgtttcgtaaaccgttcgttagtacgtaccgttccggacccggaacggtaccgaccggtccgttaagtacgtttacgtggtacggcgtaactacgtaaccgtacgacttacgtagtcggacctatactcactancaatattgtacctttagacttcgtacggtcgggaaccgtaagggtaccgtaacggg

SEQ ID NO: 49662 - DNA, 396 bp, Homo sapiens
  misc_feature: GYAE6OF02G5JND.33.4.A04.1.454.CMB.1.raw
  modified_base (263)..(263): a, c, t, g, unknown or other
  misc_feature (263)..(263): n is a, c, g, or t
  modified_base (286)..(286): a, c, t, g, unknown or other
  misc_feature (286)..(286): n is a, c, g, or t
  modified_base (294)..(294): a, c, t, g, unknown or other
  misc_feature (294)..(294): n is a, c, g, or t
  modified_base (363)..(363): a, c, t, g, unknown or other
  misc_feature (363)..(363): n is a, c, g, or t
  modified_base (371)..(396): a, c, t, g, unknown or other
  misc_feature (371)..(396): n is a, c, g, or t
tcagtacacacactcacgaccggtgctcgatttagagtagtgatcagggagaactggttcattagacacgtctaagaaccagttctccctgaagttgaactctgtgactgccgcggacacggccgtgtattactgtgcggcatactacgatactagtggccgatatcaccatcacgatgcttttgatatctgggccaagggacaagggtcaccgtctcttcacgcctccaccaacgggcccatccggtccttccccctggccnccctcctccaagagccacctcgnggggcacngcgccctggctgcctggcaaggacctactccgagtgtgtgtactggacggcggcgtggcgtaagggcgngatagacnnnnnnnnnnnnnnnnnnnnnnnnnn

SEQ ID NO: 49663 - DNA, 448 bp, Homo sapiens
  misc_feature: GYAE6OF02GLS2D.33.4.A04.1.454.CMB.1.raw
  modified_base (223)..(223): a, c, t, g, unknown or other
  misc_feature (223)..(223): n is a, c, g, or t
  modified_base (263)..(263): a, c, t, g, unknown or other
  misc_feature (263)..(263): n is a, c, g, or t
  modified_base (406)..(448): a, c, t, g, unknown or other
  misc_feature (406)..(448): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgcttttgatatcgtcggggccaagggacaagggtcaccgtctcttnacgcctccaccaacgggccccagtccggtccttcccccgnggccacccctcctccaagacgccacctcgtgggggcacgacgccggcccgtgggctcgccttggtacaaggtcctaccttcacggttcgtgtcgtactgggacggcggggtacgtgggaccgaaacggccgtactaatagcgnnnnnnnnnnnnnnnnnnnnnnnnnnnnnnnnnnnnnnnnnnn

SEQ ID NO: 49664 - DNA, 471 bp, Homo sapiens
  misc_feature: GYAE6OF02GN6DC.33.4.A04.1.454.CMB.1.raw
  modified_base (387)..(387): a, c, t, g, unknown or other
  misc_feature (387)..(387): n is a, c, g, or t
  modified_base (431)..(432): a, c, t, g, unknown or other
  misc_feature (431)..(432): n is a, c, g, or t
  modified_base (434)..(471): a, c, t, g, unknown or other
  misc_feature (434)..(471): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgtcttttgatatcgtggggccaagggacaagggtccaccgtctcttcacgccctccaccgaacgggccccagtcccggtcccttcccccgtggccctacccctcctaccaaggacgccacccgtcggtgggggccacgacggcccggtcccgtggggctcggcccgtcgggacaacggaccttaccttccgaggttcgttgtcgttacgnggacgggcggggtcgtacgggacgaacgggccgacgtagtacgnngnnnnnnnnnnnnnnnnnnnnnnnnnnnnnnnnnnnnnn

SEQ ID NO: 49665 - DNA, 466 bp, Homo sapiens
  misc_feature: GYAE6OF02GV51J.33.4.A04.1.454.CMB.1.raw
  modified_base (269)..(269): a, c, t, g, unknown or other
  misc_feature (269)..(269): n is a, c, g, or t
  modified_base (407)..(407): a, c, t, g, unknown or other
  misc_feature (407)..(407): n is a, c, g, or t
  modified_base (413)..(417): a, c, t, g, unknown or other
  misc_feature (413)..(417): n is a, c, g, or t
  modified_base (419)..(466): a, c, t, g, unknown or other
  misc_feature (419)..(466): n is a, c, g, or t
tcagtacacacactcacgaccggtgctcgatttagagtagtgatcagggagaactggttcttagacacgtctaagaaccagttctccctgaagttgaactctgtgactgccgcggacacggccgtgtattactgtgcggcatactacgatactagtggccgatatcaccatcacgatgcttttgatatctggggccaagggacaagggtcaccgtctcttcagcctccaccaagggcccatcggtcttcccctgccaccctcctcaagngcacctcgtggggcacgacggccggcccgtgggcctcggcccgttgggtaccaaagggtaccttaccttcccgaggttcggttgttacgtacgtggacggccggggtctacgggaccgaaaggtccgacgtaagtagnactgannnnngnnnnnnnnnnnnnnnnnnnnnnnnnnnnnnnnnnnnnnnnnnnnnnnn

SEQ ID NO: 49666 - DNA, 156 bp, Homo sapiens
  misc_feature: GYAE6OF01BIOMR.49.5.A05.1.454.CMB.1.raw
  modified_base (150)..(156): a, c, t, g, unknown or other
  misc_feature (150)..(156): n is a, c, g, or t
tcagagtcgagagacacgaccggtgctcgatttagatagatagacagggtcaagctcacctgcactctgaacggtcagccaaggctgccctcggtcactctgttccgcctcctctctctcgactctgagcgggctggcaaggcgcatagnnnnnnn

SEQ ID NO: 49667 - DNA, 155 bp, Homo sapiens
  misc_feature: GYAE6OF01A5XVW.49.5.A05.1.454.CMB.1.raw
  modified_base (154)..(155): a, c, t, g, unknown or other
  misc_feature (154)..(155): n is a, c, g, or t
tcagagtcgagagacacgaccggtgctcgatttagatagatagacagggtcaagctcacctgcactctgaacggtcagcccaaggctgcccctcggtcactctgttcccaccctcctctctctcgactctgagcgggctggcaaggcgcatagnn

SEQ ID NO: 49668 - DNA, 157 bp, Homo sapiens
  misc_feature: GYAE6OF01DSRW3.49.5.A05.1.454.CMB.1.raw
  modified_base (156)..(157): a, c, t, g, unknown or other
  misc_feature (156)..(157): n is a, c, g, or t
tcagagtcgagagacacgaccggtgctcgatttagatagatagacaggggtcaagctcacctgcactctgaacggtcagcccaaggctgccccctcggtcactctgttcccgccctcctctctctcgactctgagcgggctggcaaggcgcatagnn

SEQ ID NO: 49669 - DNA, 155 bp, Homo sapiens
  misc_feature: GYAE6OF01AGEB6.49.5.A05.1.454.CMB.1.raw
  modified_base (155)..(155): a, c, t, g, unknown or other
  misc_feature (155)..(155): n is a, c, g, or t
tcagagtcgagagacacgaccggtgctcgatttagatagatagacaggggtcaagctcacctgcactctgaacggtcagcccaaggctgcccctcggtcactctgttcccaccctcctctctctcgactctgagcgggctggcaaggcgcatagn

SEQ ID NO: 49670 - DNA, 158 bp, Homo sapiens
  misc_feature: GYAE6OF01CAWJF.49.5.A05.1.454.CMB.1.raw
  modified_base (154)..(158): a, c, t, g, unknown or other
  misc_feature (154)..(158): n is a, c, g, or t
tcagagtcgagagacacgaccggtgctcgatttagatagatagacaggggtcaagctcacctgcactctgaacggtcagcccaaggctgcccctcggtcactctgttcccaccctcctctctctcgaatctgagcggctggcaaggcgcatagnnnnn

SEQ ID NO: 49671 - DNA, 518 bp, Homo sapiens
  misc_feature: GYAE6OF01BDUT8.49.5.A05.1.454.CMB.1.raw
  modified_base (475)..(475): a, c, t, g, unknown or other
  misc_feature (475)..(475): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggaggcgtggtccagcctgggacgtccctgagactctcctgtgcagcctctggatttacattcagtagttatgctatgcactggtttcgccagggtccaggcaaggggctggagtgggtggcagttatatcgtatgatggaaacgaaaatactacgcagactccgtgaagggccgattcaccatctcccgacacaattccaagaacacattgtttctactgctgaacagcctgagaagtgacgacacggctgtatatcactgtgcggnaggcaacgattacgtacccgaaggactacgtggggccaacggg

SEQ ID NO: 49672 - DNA, 159 bp, Homo sapiens
  misc_feature: GYAE6OF01AC8L6.49.5.A05.1.454.CMB.1.raw
  modified_base (155)..(159): a, c, t, g, unknown or other
  misc_feature (155)..(159): n is a, c, g, or t
tcagagtcgagagacacgaccggtgctcgatttagatagatagacagggggtcaagctcacctgcactctgaacggtcagcccaaggctgcccctcggtcactctgttcccgccctcctctctctcgactctgagcggctggcaaggcgcatagnnnnn

SEQ ID NO: 49673 - DNA, 160 bp, Homo sapiens
  misc_feature: GYAE6OF01ELZHG.49.5.A05.1.454.CMB.1.raw
  modified_base (157)..(160): a, c, t, g, unknown or other
  misc_feature (157)..(160): n is a, c, g, or t
tcagagtcgagagacacgaccggtgctcgatttagatagatagacagggggtcaagctcacctgcactctgaacggtcagcccaaggctgccccctcggtcactctgttcccgccctcctctctctcgactctgagcgggctggcaaggcgcatagnnnn

SEQ ID NO: 49674 - DNA, 156 bp, Homo sapiens
  misc_feature: GYAE6OF01DX98E.49.5.A05.1.454.CMB.1.raw
  modified_base (156)..(156): a, c, t, g, unknown or other
  misc_feature (156)..(156): n is a, c, g, or t
tcagagtcgagagacacgaccggtgctcgatttagatagatagacaggggtcaagctcacctgcactctgaacggtcagcccaaggctgccccctcggtcactctgttcccaccctcctctctctcgactctgagcgggctggcaaggcgcatagn

SEQ ID NO: 49675 - DNA, 157 bp, Homo sapiens
  misc_feature: GYAE6OF01BV3W1.49.5.A05.1.454.CMB.1.raw
  modified_base (157)..(157): a, c, t, g, unknown or other
  misc_feature (157)..(157): n is a, c, g, or t
tcagagtcgagagacacgaccggtgctcgatttagatagatagacagggggtcaagctcacctgcactctgaacggtcagcccaaggctgccccctcggtcactctgttcccaccctcctctctctcgactctgagcgggctggcaaggcgcatagn

SEQ ID NO: 49676 - DNA, 160 bp, Homo sapiens
  misc_feature: GYAE6OF01AL1FV.49.5.A05.1.454.CMB.1.raw
  modified_base (156)..(160): a, c, t, g, unknown or other
  misc_feature (156)..(160): n is a, c, g, or t
tcagagtcgagagacacgaccggtgctcgatttagatagatagacaggggtcaagctcacctgcactctgaacggtcagcccaaggctgccccctcggtcactctgttcccgccctcctctctctcgactctgagcgggctggcaaggcgcatagnnnnn

SEQ ID NO: 49677 - DNA, 157 bp, Homo sapiens
  misc_feature: GYAE6OF01EIC2Y.49.5.A05.1.454.CMB.1.raw
  modified_base (156)..(157): a, c, t, g, unknown or other
  misc_feature (156)..(157): n is a, c, g, or t
tcagagtcgagagacacgaccggtgctcgatttagatagatagacagggggtcaagctcacctgcactctgaacggtcagcccaaggctgccccctcggtcactctgttcccaccctcctctctctcgacctgagcgggctggcaaggcgcatagnn

SEQ ID NO: 49678 - DNA, 157 bp, Homo sapiens; identical to SEQ ID NO: 49675
  misc_feature: GYAE6OF01EDS5X.49.5.A05.1.454.CMB.1.raw
  modified_base (157)..(157): a, c, t, g, unknown or other
  misc_feature (157)..(157): n is a, c, g, or t

SEQ ID NO: 49679 - DNA, 184 bp, Homo sapiens
  misc_feature: GYAE6OF01BOET2.49.5.A05.1.454.CMB.1.raw
  modified_base (157)..(184): a, c, t, g, unknown or other
  misc_feature (157)..(184): n is a, c, g, or t
tcagagtcgagagacacgaccggtgctcgatttagatagatagacaggggtcaagctcacctgcactctgaaccggtcagcccaaggctgccccctggtcactctgttcccaccctcctctcttctcgactctgagcgggctggcaaggcgcatagnnnnnnnnnnnnnnnnnnnnnnnnnnnn

SEQ ID NO: 49680 - DNA, 543 bp, Homo sapiens
  misc_feature: GYAE6OF01C4EM2.49.5.A05.1.454.CMB.1.raw
  modified_base (339)..(339): a, c, t, g, unknown or other
  misc_feature (339)..(339): n is a, c, g, or t
  modified_base (398)..(398): a, c, t, g, unknown or other
  misc_feature (398)..(398): n is a, c, g, or t
  modified_base (446)..(446): a, c, t, g, unknown or other
  misc_feature (446)..(446): n is a, c, g, or t
  modified_base (490)..(490): a, c, t, g, unknown or other
  misc_feature (490)..(490): n is a, c, g, or t
  modified_base (494)..(494): a, c, t, g, unknown or other
  misc_feature (494)..(494): n is a, c, g, or t
  modified_base (530)..(530): a, c, t, g, unknown or other
  misc_feature (530)..(530): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagcctgggactcctgagactctcctgtgcagcctctggatttacattcagttagttatgctatgctacttggtttccgccgagggtccaggcgaaggggctgggagtggggtgcagttanatcgtatgataggaaaacaaaatctacgcagactcggtagaagggccattcaccatccnccgacacaacttccaaagaacactatttcgttactactgactagaacncgtcctaggaagaagtcgacgacacgtctagtactatcacgtgngcgnacggcaacgacttaccgaaccggaagtacctacggnggggcctaacggg

SEQ ID NO: 49681 - DNA, 156 bp, Homo sapiens
  misc_feature: GYAE6OF01EK7U5.49.5.A05.1.454.CMB.1.raw
  modified_base (156)..(156): a, c, t, g, unknown or other
  misc_feature (156)..(156): n is a, c, g, or t
tcagagtcgagagacacgaccggtgctcgatttagatagatagacaggggtcaagctcacctgcactctgaacggtcagcccaaggctgccccctcggtcactctgttcccgccctcctctctctcgactctgagcgggctggcaaggcgcatagn

SEQ ID NO: 49682 - DNA, 605 bp, Homo sapiens
  misc_feature: GYAE6OF01BHRPV.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggaggcgtggtccagcctgggacgtccctgagactctcctgtgcagcctctggatttacattcagtagttatgctatgctactggtttccgccgagggtccaggcgaaggggctgggagtgggtgcagttatatcgtatgaagtaggaaaacaaaatactacgcaagtactccggtaggaacgggcctattccacccgtatccctaccccgaacaactaaacttaccaaagtaacacctatttacgttctactgctagaacagctgaagtaaggtacgaccgacacggcttagtaactataccgacgttggtcggccggacacgggaccctaaacggtaactttaacccgtaacccggaaacggtaccgtaaccgggtcgggggccctaaaccgggg

SEQ ID NO: 49683 - DNA, 554 bp, Homo sapiens
  misc_feature: GYAE6OF01DMR1R.49.5.A05.1.454.CMB.1.raw
  modified_base (502)..(502): a, c, t, g, unknown or other
  misc_feature (502)..(502): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagcctgggacgtccctgagactctcctgtgcagcctctggatttacattcagttagttatgctatgctactggtttcgccgagggtccaggcaagggggctgggagtgggtggcagttatatcgtatgataggaaaacaaaatactacgcagactccgtaggaacgggccattcacctactcctacccgacacaacttaccaaagaacactatttcgttactactgctagaacagctagacgtaagtcgacacgacggtctagtatatcacgtgtcggcgganacggcaacgtacttaaccgaacccggaaggactacggtggggcctaacgggg

SEQ ID NO: 49684 - DNA, 539 bp, Homo sapiens
  misc_feature: GYAE6OF01CD16D.49.5.A05.1.454.CMB.1.raw
  modified_base (419)..(419): a, c, t, g, unknown or other
  misc_feature (419)..(419): n is a, c, g, or t
  modified_base (448)..(448): a, c, t, g, unknown or other
  misc_feature (448)..(448): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagcctgggacgtccctgagactctcctgtgcagcctctggatttacattcagtagttatgctatgcactggtttcgccaggtccaggcaaggggctggagtgggtggcagttatatcgtatgataggaaaacgaaaaatactaacgcaagactccgtagaagggccgattcaccatctcccgacacaattccaagaacanattgtttctactgctagaacagcctgaanagtagacgacacgctgtaatatcacttgcgcggcaggccaaacgactttaaccgaacccgaaggaccctacgtgggggccctaaaccgggg

SEQ ID NO: 49685 - DNA, 156 bp, Homo sapiens; identical to SEQ ID NO: 49681
  misc_feature: GYAE6OF01EOGV0.49.5.A05.1.454.CMB.1.raw
  modified_base (156)..(156): a, c, t, g, unknown or other
  misc_feature (156)..(156): n is a, c, g, or t

SEQ ID NO: 49686 - DNA, 557 bp, Homo sapiens
  misc_feature: GYAE6OF01BQXN9.49.5.A05.1.454.CMB.1.raw
  modified_base (450)..(450): a, c, t, g, unknown or other
  misc_feature (450)..(450): n is a, c, g, or t
  modified_base (499)..(499): a, c, t, g, unknown or other
  misc_feature (499)..(499): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagcctgggacgtccctgagactctcctgtgcagcctctggatttacattcagttagttatgctatgcactggtttcgccagggtccagggcaaggggctgggagtgggtggctagttatagtcgtatgaatagggaaaacgaaaatactacgcagacctcggtagaacgggccattcaccatcctccgacacaattaccaagaacactattagtttctaactgactgaacngctaggagaagtgaacgacgacgctagtaatactcacgtgtcggcgganagggcaaacgtattaacccgaacccggaaggaacctacggtcggggcctaaaccgggg

SEQ ID NO: 49687 - DNA, 512 bp, Homo sapiens
  misc_feature: GYAE6OF01DL82H.49.5.A05.1.454.CMB.1.raw
  modified_base (393)..(393): a, c, t, g, unknown or other
  misc_feature (393)..(393): n is a, c, g, or t
  modified_base (468)..(468): a, c, t, g, unknown or other
  misc_feature (468)..(468): n is a, c, g, or t
  modified_base (473)..(473): a, c, t, g, unknown or other
  misc_feature (473)..(473): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagcctgggactcctgagactctcctgtgcagctctggatttacattcagtagtatgctatgcactggtttcgccagggtccaggcaaggggctggagtgggtggcagttatatcgtatgataggaaacgaaaatactacgcagactccgtgaagggccattcaccatctccganacaattccaagaacacattgttctactgactgaacagtcctagagaagtcgacgacacggtctgtatatcactgngcggnaggcaacgattactaccgaagactacgtgggcctaacgg

SEQ ID NO: 49688 - DNA, 526 bp, Homo sapiens
  misc_feature: GYAE6OF01BYUKV.49.5.A05.1.454.CMB.1.raw
  modified_base (434)..(434): a, c, t, g, unknown or other
  misc_feature (434)..(434): n is a, c, g, or t
  modified_base (477)..(477): a, c, t, g, unknown or other
  misc_feature (477)..(477): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagcctgggacgtccctgagactctcctgtgcagcctctggatttacattcagtagttatgctatgcactggtttcgccagggtccaggcaaggggctggagtgggtggcagttatatcgtatgatggaaacgaaaatctaacgcagactccgtagaaggccgattcaccatctcccgacacaattccaagaacacattgttctactcgctgaacngcctgagtaagtgacgacacggctagtatatcactggtgcggnaggcaacgacttaactacccgaaggacctacgtcggggcctaaccgggg

SEQ ID NO: 49689 - DNA, 647 bp, Homo sapiens
  misc_feature: GYAE6OF01BHUS6.49.5.A05.1.454.CMB.1.raw
  modified_base (249)..(249): a, c, t, g, unknown or other
  misc_feature (249)..(249): n is a, c, g, or t
  modified_base (290)..(290): a, c, t, g, unknown or other
  misc_feature (290)..(290): n is a, c, g, or t
  modified_base (318)..(318): a, c, t, g, unknown or other
  misc_feature (318)..(318): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcgtggtttctcgttagctctttaagaggtgtcagtgtcaggtgcagctggtggagtgggggagcgtggccagcctgggacgtccctgagctctcctgtgcagcctntggatttacattcagtattatgctagtgcacgtggtttacnccgtagggtccaaggcaaggggctgggngtggtgactagttatacgtcgtatgaacgtaaggaaaacaaaatactacgacaagacgtcgtaggaacggacctaattaccaactacctaccgtaccgaactaacctaaactaacccgaaacgtaaacctaacttaacgtttcgtttaccttaacgtacgtacgtaacgtaacgtacgtacctaggaacgtaacggtacggaaccggtaacgacggtacgttagtaacttaacgtacgtacgtggtacggccggtacgaacggtaccaaaccgtaacgttaacccgtaaccggaacggtaaccgtaacggtacggggacccgtaacggg

SEQ ID NO: 49690 - DNA, 690 bp, Homo sapiens
  misc_feature: GYAE6OF01C2MZJ.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttggctgagcttgggttttcctcgttgcttcttttaagaggtgtccagtgtcaggtgcagctgggtgggaggtcgggggggagcgtggtccaggcctggggaccgtccctgagctctcctgtgcagcctctggtatttacattcaagttagttatgtctatgcacgttggtttcgccgtagggtccaaggcgaaggggctgggaggtgggtggctaggttatagtcgtaatggaagtaaggaaaacgaaaaataccgtaacgacaaggacctcggtaaggaaacgggccctaagtttaccacccgtatccgtaacccccgaacaactaaacttaccaaaaggtaacctaactagttttcggtttacctaacgtcggaccttaggaaactacgtaccgtaggaacgtaggtacgaaccgtaccgacgtcttaggtacttaactccgaacgtgggtacggcccggtagaacgggtaccaaaccggttaactttaaaccccgtaaccccgggaaaggtaacccgttacggggtcgggggaaccccgttaaaacccggggg

SEQ ID NO: 49691 - DNA, 528 bp, Homo sapiens
  misc_feature: GYAE6OF01CNNSK.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtggagtcggggggagcgtggtccagcctgggactccctgagactctcctgtgcagcctctggatttacattcagtagttatgctatgcactggtttcgccagggtccaggcaaggggctggagtgggtgcaggttatatcgtatgataggaaaacgaaaaatactacgcaagactcgtgaagggccattcaccatctcccgacacaacttccaagaacacattgtttctactgctgaacagctagagaagtgacgacacggctgtaatatcactgtgcgacaggcaaacgacttacgtaacccgaaggactacgtggggcctaaaccgggg

SEQ ID NO: 49692 - DNA, 552 bp, Homo sapiens
  misc_feature: GYAE6OF01BUAAM.49.5.A05.1.454.CMB.1.raw
  modified_base (473)..(473): a, c, t, g, unknown or other
  misc_feature (473)..(473): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggaggcgtggtccagcctgggacgtccctgagactctcctgtgcagcctctggatttacattcagttagttatgctatgcacttggtttccgcctagggtccaggcaaggggctgggagtgggtgcagttatatcgtatgataggaaacgaaaatactacgcagactccggtgaacgggccgtattccaccatcctacccgacacaacttccaagaacacatttgttactactgctagaactagcctagagaagtgacgacacggntagtaatatcacgtgtcggcggcgaggcaaacgtacttaacccgtacccggaaggacctacggtggggaccctaacggg

SEQ ID NO: 49693 - DNA, 573 bp, Homo sapiens
  misc_feature: GYAE6OF01CA4U5.49.5.A05.1.454.CMB.1.raw
  modified_base (281)..(281): a, c, t, g, unknown or other
  misc_feature (281)..(281): n is a, c, g, or t
  modified_base (419)..(419): a, c, t, g, unknown or other
  misc_feature (419)..(419): n is a, c, g, or t
  modified_base (499)..(499): a, c, t, g, unknown or other
  misc_feature (499)..(499): n is a, c, g, or t
  modified_base (560)..(560): a, c, t, g, unknown or other
  misc_feature (560)..(560): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcgtggtttcgcgttaggctctttaagaggtgtccagtgtcaggtgcagctggtggaggtcggggggagcgtggtccaggcctgggacgtccctgagactctcctgtgcagcctctggtatttacattcagttagttangctatgcacgttggtttcgccgtagggtccagggcgaaggggctgggagtgggtgctagttatatcgtatgactagggaaaacaaaatctacgactagactccggtagaacgggcctattcgaccatccgtacccganaactaacttaccgaaagaactactatttcgttacctactgtactacgaacacgcctagaacgaagtcgaacgacgacgtntagatgtccagtgtacggcgagacggcaaacggtacttaccgaaccggaagtacctacggnggggacctacggg

SEQ ID NO: 49694 - DNA, 538 bp, Homo sapiens
  misc_feature: GYAE6OF01DT2BX.49.5.A05.1.454.CMB.1.raw
  modified_base (451)..(451): a, c, t, g, unknown or other
  misc_feature (451)..(451): n is a, c, g, or t
  modified_base (496)..(496): a, c, t, g, unknown or other
  misc_feature (496)..(496): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagcctgggacgtccctgagactctcctgtgcagcctctggatttacattcagtagttatgctatgctactggtttcgccagggtccaggcaaggggctggagtgggtggcgagttagtatcgtatgagtaggaaacgaaaatactacgcaagactccgtaggaagggccgtattcaccatcctacccgacacaattaccaaagaacactatttgtttactactgctagaacngcctagagaagtgacgacacggctgtaatactcactgtagcgganaggcaacgataaccgtaccgaagactacgtgggcctaacggg

SEQ ID NO: 49695 - DNA, 562 bp, Homo sapiens
  misc_feature: GYAE6OF01ARIML.49.5.A05.1.454.CMB.1.raw
  modified_base (503)..(503): a, c, t, g, unknown or other
  misc_feature (503)..(503): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctctttaagagtgtccagtgtcaggtgcagctggtggagtcggggggagcgtggtccagcctgggacgtccctgagactctcctgtgcagcctctggatttacattcagtagttatgctatgcacgtggtttcgccagggtccaggcgaaggggctgggaggtgggtgcagttatatcgtatgagtaggaaaacgaaaatacgacgcagacctcgtagaacggccattcaccatcctacccgacactaactacaagaacactattcgtttactactgctagaacagtcctagaagtaagtcgaacgacgacggactagtaactactcacgtgtcggccggtanacgggacaacggtattaacccgtacccgaaggtacctacggtcggggccgtaaaccggg

SEQ ID NO: 49696 - DNA, 162 bp, Homo sapiens
  misc_feature: GYAE6OF01C1MRF.49.5.A05.1.454.CMB.1.raw
  modified_base (157)..(162): a, c, t, g, unknown or other
  misc_feature (157)..(162): n is a, c, g, or t
tcagagtcgagagacacgaccggtgctcgatttagatagatagacagggggtcaagctcacctgcactctgaacggtcagcccaaggctgccccctcggtcactctgttcccaccctcctctctctcgactctgagcgggctggcaaggcgcatagnnnnnn

SEQ ID NO: 49697 - DNA, 606 bp, Homo sapiens
  misc_feature: GYAE6OF01AP3ZG.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggtttcctcgttgctctttaagaggtgtccagtgtcaggtgcagctggtggaggtcggggggaggacgtggtccagcctgggacgtcctgagactctcctgtgcacgcctcgtggatttacgattcagtagttatgctatgctacgttggtttccgccgagggtcccaggcgaagggggtctgggagtggggtggctagttatagtcgtatgataggaaaactaaaatcacgcagacctcgtagaaggccattcaccatcaccgacacaattccaaagacactattcgttcactcgactagaaccacgtccgagtaagacgtacgaaccgaccgtacggctaggtaactataccgtacgtggtacggtccggacgaacgggtacctaaaccggtaacttaaaccccgtaacccgggtaaacgtacccgttaacggtccgggggtacccgtaaacccgggg

SEQ ID NO: 49698 - DNA, 672 bp, Homo sapiens
  misc_feature: GYAE6OF01BU1XT.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggaggcgtggtccagcctgggacgtccctgagactctcctgtgcagcctctggatttacattcagttagttatgctatgcacgttggtttcgccgtagggtccagggcgaaggggctgggagtgggtggctagttatagtcgtatgaataggaaaacgtaaaatactaacgcaagacctccggtaggaacgggcctaattccaacctatccctaccccggaactaacctaaacttaccgaaagtaacctaactatttacgtttacctaacgtcgacttacgaacctacgtccctaggaacggtaacggtacggaaccggaaccgtacgggtacttacggttaattacgtacctaacgttacggtcgggaccggtacgtaacgggaccgtaaaaccgttacgttaaaccccgtaacccgggaaaggttaacccgtacgggtacgggggaccccgtaaaccggggg

SEQ ID NO: 49699 - DNA, 572 bp, Homo sapiens
  misc_feature: GYAE6OF01AGZ8J.49.5.A05.1.454.CMB.1.raw
  modified_base (395)..(395): a, c, t, g, unknown or other
  misc_feature (395)..(395): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcgggggaggcgtggtccagcctgggacgtccctgagactctcctgtgcagcctcgtggattttacatttcagttagttatgctatcgctacgtggtttcgccgagggtccaggcgaagggctgggagtgggtgcagttatagtcgtatgataggaaaacaaatcagcagactcgaggaacggctattccacntcctaccgacaacataccaagaacatatttcgttctactcgactacgaacacgcctgaacgtaagtacgaacgacgacgtctagtaatcgtctacgtggtcggcggacgacggaccgtaaacgtaccttaaccgtaacccggaaggtacctaccgggtcggggccctaaacccgggg

SEQ ID NO: 49700 - DNA, 539 bp, Homo sapiens
  misc_feature: GYAE6OF01E4EEF.49.5.A05.1.454.CMB.1.raw
  modified_base (442)..(442): a, c, t, g, unknown or other
  misc_feature (442)..(442): n is a, c, g, or t
  modified_base (453)..(453): a, c, t, g, unknown or other
  misc_feature (453)..(453): n is a, c, g, or t
  modified_base (460)..(460): a, c, t, g, unknown or other
  misc_feature (460)..(460): n is a, c, g, or t
  modified_base (485)..(485): a, c, t, g, unknown or other
  misc_feature (485)..(485): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggaggcgtggtccagcctgggacgtccctgagactctcctgtgcagcctctggatttacattcagtagttatgctatgcactggtttcgccagggtccaggcaagggggctgggagtgggtgctagttatatcgtatgataggaaaacaaaatactacgcagactccgtaggaacggccattcaccatctcccgacacaattccaagaactacattgtttactactgctagaacngcctagagagngacgacncggctgtatacgtcactgtgccggnaggcaaacgtcttaaccgtacccggaaaggacctacggtggggccctaacgggg

SEQ ID NO: 49701 - DNA, 797 bp, Homo sapiens
  misc_feature: GYAE6OF01BM9Y7.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggaggcgtggtccagccgtgggacgtccctgagactctcctgtgcagcctcgtggatttacattcagtagttatgctatgcacttggtttcgccgtagggtccaggcgaaggggctgggaggtggggtgctaggttatagtcgtaagtgaagtaggaaaaacgaaaatacgtacgacgaagtaccgtccggtaggaacggggcccgtaactttacccgaacccgtacttaccccgtacccccggtaaacctaaacctaaaacgtttaccccgaaaaggtaaaccctaaccgttaagttttaccggttttaaccttaaccgtttacgaccgtttacggaaacctaccgtacccgttaaggaaacggtaaacggtaccggtaaacccggaaccgtaacccgggtaccttagggttaacttaaccgttacgtaaaccccggttgggtaccgggtacccggggtacgttaaaccggggacccgtaaaacccggttaaccgttttaaacccccggtaaaaccccggggtaaacgggtaaaccccggtttaacccgggtacccggggggggtaaccccgttaaaaccccgggggg

SEQ ID NO: 49702 - DNA, 571 bp, Homo sapiens
  misc_feature: GYAE6OF01D1V40.49.5.A05.1.454.CMB.1.raw
  modified_base (281)..(281): a, c, t, g, unknown or other
  misc_feature (281)..(281): n is a, c, g, or t
  modified_base (351)..(351): a, c, t, g, unknown or other
  misc_feature (351)..(351): n is a, c, g, or t
  modified_base (437)..(437): a, c, t, g, unknown or other
  misc_feature (437)..(437): n is a, c, g, or t
  modified_base (447)..(447): a, c, t, g, unknown or other
  misc_feature (447)..(447): n is a, c, g, or t
  modified_base (456)..(456): a, c, t, g, unknown or other
  misc_feature (456)..(456): n is a, c, g, or t
  modified_base (487)..(487): a, c, t, g, unknown or other
  misc_feature (487)..(487): n is a, c, g, or t
  modified_base (510)..(510): a, c, t, g, unknown or other
  misc_feature (510)..(510): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggaggtcggggggagcgtggtccaggcctgggactccctgagactctcctgtgcagcctctggatttacattcagttattangctatgctacgttggtttccgccgaggggtcccagggccgaagggggtctgggagtgggtgctaagttanatcgtatgataggaaaacgaaaatactaacgcaagactccgaggaacgggcctaattccaccatcctacccgacacaattccaaanaacactattntttctactnactagaacagctgaagagtcgacgacacgtntagtatatcactagcggacgganacggactaaacgtaattaacccgtacccggaaaggacctaacggtcgggaccgtaaccggg

SEQ ID NO: 49703 - DNA, 555 bp, Homo sapiens
  misc_feature: GYAE6OF01CXPBZ.49.5.A05.1.454.CMB.1.raw
  modified_base (351)..(351): a, c, t, g, unknown or other
  misc_feature (351)..(351): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggagcgtggtccagccgtgggacgtccctgagctctcctgtgcagcctctggatttacattcagttagttatgctatgctacgttgggtttccgccgaggggtccagggcgaagggggtctgggaagtggggtgctacgttanctcattctgagtggaaggtctaggaattctagtcggacccgtactccgggtagaacgggccgtattccgaacctatcctaccgaagacgaactaactaccaaagaacacactatatctaacaaatcgaacactcgtagagtacgtagacgacacggtctagtcttagtactgtcgcgactagagtactagttattactgagtcg

SEQ ID NO: 49704 - DNA, 546 bp, Homo sapiens
  misc_feature: GYAE6OF01E03E5.49.5.A05.1.454.CMB.1.raw
  modified_base (448)..(448): a, c, t, g, unknown or other
  misc_feature (448)..(448): n is a, c, g, or t
  modified_base (474)..(474): a, c, t, g, unknown or other
  misc_feature (474)..(474): n is a, c, g, or t
  modified_base (488)..(488): a, c, t, g, unknown or other
  misc_feature (488)..(488): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggagcgtggtccagcctgggacgtccctgagactctcctgtgcagcctctggatttacattcagtagttatgctatgcactggtttcgccaggggtccaggcaaggggctgggagtgggtggctagttatatcgtatgatagggaaaacgtaaaatactacgcaagactccggtagaagggccgattccaccatcctacccgacactaataccaagaacacattgttctactgctgaacngccagagaagtgacgacacgctgtanatcaatgtgcgganacggacaaacgtagttaaacctacccggaaaggacctaacggtggggcctaaacgggg

SEQ ID NO: 49705 - DNA, 870 bp, Homo sapiens
  misc_feature: GYAE6OF01CBCTP.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgggggagcgtggtccagcctgggacgtcctgagactctcctgtcgcacgcctctggatttacattcagtagttatgtctatgctacgttggtttccgccgtagggtccaagggccgaagggggtcgtggggtacggtggggtcggtactaaggtttagtagttcggttaatggtaagtaacgggaaaaactaaaaaacgtacgtaaccggacgaacggtacccgttaccgggtaaggaaacggggtacccgtaacgtttacccgaaccctacgttaccccgttaaccccggtaaacctaaaccgttaaaaccgtttaaccccgaaaaacgaaaacccttaaccgttaacgttttttaccggttttaacccgtttaaaccgtacggtttacccgttaaaccgaaaccgttaaccgggtaccccgttaaagggtaaacccggttaaaagggtacccggtaaacccggaacccgttaacccgggttaacgttaagttaaccgtaaaccttccgtaaccggtttaagggtccgggtacccgggtaaaccgtacgggtaaaacccgtaaacccgggttaaacgttttaaacccccggaaaaccccgggtaaaaggggttaaccccgttaacccgggggttacccgggggtaaccccggttaaaacccggggg

SEQ ID NO: 49706 - DNA, 642 bp, Homo sapiens
  misc_feature: GYAE6OF01ERK28.49.5.A05.1.454.CMB.1.raw
  modified_base (507)..(507): a, c, t, g, unknown or other
  misc_feature (507)..(507): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggaggcggtggtccagccgtgggacgtccctgacgacctctcctgtgcagcctctggtatttacattcagttagttatgctatgcctacgttggtttccgccgtaggggtccagggtaccgaagggggtctgggaggtggggtggactagttaatagtcgtaatgaagtaaggaaaacaaaaatacctacgacaagtaccgtccggtaggaaacgggcctattaccaacctactccctacccgaactaactaaacgttaccaaagtactaactagtttctttactactgactagaaccngtcctagacgtaacgtcgaaccgacgacgtctagtactatccacgtggtacggccggtacgacggtaccaaacggtaacttaaccccggtaacccggaaggtaaccgtacgggtccggggaccgtaaacccgggg

SEQ ID NO: 49707 - DNA, 523 bp, Homo sapiens
  misc_feature: GYAE6OF01EKFTC.49.5.A05.1.454.CMB.1.raw
  modified_base (471)..(471): a, c, t, g, unknown or other
  misc_feature (471)..(471): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagcctgggacgtccctgagctctcctgtgcagcctctggatttacattcagttagttatgctatgctactggtttcgccagggtccaggcaaggggctggagtgggtgcagttatatcgtatgataggaaacaaaatactacgcagactcgtagaaggccatcaccatctccgacacaataccaagacacattcgttctactcgctgaacagcctgagaagtgacgacacggctagatatcactgtggcganaggccaacgacttaccgaacccggaaggaccgtacgtggggacccaacgggg

SEQ ID NO: 49708 - DNA, 744 bp, Homo sapiens
  misc_feature: GYAE6OF01BUOK7.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtggaggtcgggggggaggcggtggtccaggccgtgggaccgtccctggacgactctcctgtgcagcctcgtggtatttacattcagttagttatgctatgctactggtttcgccgagggtccaggcgaaggggctgggagtgggtggcagttatatcgtatgataggaaaacgaaaatctacgacagtacgtcgtaggaacgggtccattaccgactacgtaccctccccgaactaactaaacttaccgaaacgtaaacctaacgtactttaacggttttcctaaccgttagtaccttaacggaaacctaccgggtacccttaagggtaaacggtaaacgggtacggtaaaccgggaaccgtaacccggggtacttaacggttaacgtaaccttaccgaaccggtttagggtacggggtacccggtacggtaaacggggtaccctaaaaaccgggttaaccgtttaaacccgtaaaaccccggggtaaacgggtaacccgtttaaaccggggtaccggggggaaaccccggttaaaaccccgggggg

SEQ ID NO: 49709 - DNA, 642 bp, Homo sapiens
  misc_feature: GYAE6OF01CLX9A.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctgggtggaggtcggggggaggcgtggtccagccgtgggacgtccctgagactctcctgtgcagcctctggatttacattcagtagttactgctatgctacgttggtttccgctagggtccaggcgaaggggctgggaggtgggtggctagtttatagtcgtaatggaagtaggaaaaacgaaaaaattcgtaacgacaacggtactacccggtaggaacggccgtattaccgacctaactccctaccccgaacaactaaacttacccgaaagtaaaccaacttactttggtttacctaacgtcgactacgaacacgcccgtagaagtaacggtacgaacgaacgacggtctagtacttactaccgtacttggcgccggtacgacggacaaaccggttacttaacccgaaacccggaacgacccgtacggcggggcccctaaaccgggg

SEQ ID NO: 49710 - DNA, 587 bp, Homo sapiens
  misc_feature: GYAE6OF01AUNCE.49.5.A05.1.454.CMB.1.raw
  modified_base (336)..(336): a, c, t, g, unknown or other
  misc_feature (336)..(336): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggaggcgtggtccagcctggggacgtccctgagactctcctgtgcagcctctggatttacattcagtagttatgctatgcactggtttcgccaggtccaggcaaggggctggagtgggtggcagttanatcgtatgataggaaaacgaaaactactacgacgagtactaccgtagaacgggccgtattacaccataccctacccgaacaccgtaaacttaccaacgaaacctactatttacgtttacctacttgcctagaacacgcctagaacgaagtacgacgacacggctagtaatctcacgttgacggcggacgacggaccaacgtaattaacccgtaacccggtaagaccgtacggtcggggccgtaaacccggg

SEQ ID NO: 49711 - DNA, 520 bp, Homo sapiens
  misc_feature: GYAE6OF01CHGPG.49.5.A05.1.454.CMB.1.raw
  modified_base (412)..(412): a, c, t, g, unknown or other
  misc_feature (412)..(412): n is a, c, g, or t
  modified_base (471)..(471): a, c, t, g, unknown or other
  misc_feature (471)..(471): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggaggcgtggtccagcctgggacgtccctgagactctcctgtgcagcctctggatttacattcagtagttatgctatgcactggtttcgcctagggtccaggcaaggggctgggagtgggtgcagttatatcgtatgatggaaacgaaaatactacgcagactcgtgaggccgattcacatctcccgacacaacttccaagaacncattgtttcactgctgacagcctgagagtcgacgacacggctgtatatcactgtgcggnaggcaacgatttaccaacccggaggaacctacgtggggccctaacgggg

SEQ ID NO: 49712 - DNA, 157 bp, Homo sapiens; identical to SEQ ID NO: 49675
  misc_feature: GYAE6OF01CMK3Q.49.5.A05.1.454.CMB.1.raw
  modified_base (157)..(157): a, c, t, g, unknown or other
  misc_feature (157)..(157): n is a, c, g, or t

SEQ ID NO: 49713 - DNA, 524 bp, Homo sapiens
  misc_feature: GYAE6OF01B832J.49.5.A05.1.454.CMB.1.raw
  modified_base (438)..(438): a, c, t, g, unknown or other
  misc_feature (438)..(438): n is a, c, g, or t
  modified_base (472)..(472): a, c, t, g, unknown or other
  misc_feature (472)..(472): n is a, c, g, or t
  modified_base (477)..(477): a, c, t, g, unknown or other
  misc_feature (477)..(477): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggaggcgtggtccagcctgggacgtccctgagactctcctgtgcagcctctggatttacattcagtagttatgctatgcactggtttcgccagggtccaggcaaggggctgggagtgggtggcagttatatcgtatgataggaaacgaaaatactacgcagactcgtgaagggccattcaccatctccgacacaataccaagaacacattgttctactcgctacgacacncgtgaagacgtgacgacacgctgtatatcagtgngcggnacggcacgtactacgtaaccgacgacgtacgtgggaccgtaaccggg

SEQ ID NO: 49714 - DNA, 631 bp, Homo sapiens
  misc_feature: GYAE6OF01CVAY9.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagcctgggactcctgagactctcctgtgcagcctctggatttacattcagttagttatgctatgcactggtttccgccgagggtccaggcaaggggctgggagtgggtgcagttatagtcgtatgatagggaaaacaaaatactacgcagactcgtagaaggccgtattccaaccatccctaccccgaacaactaaacttccgaaagtaaccactatttcgttacctacgtgtcctagaaccacgtcctaagggaacgtaaacggttcgaaccgtacgaccggtacttagttaactactccgaacgttggtcggaccgggacgtaagggaacccaaacggttaactttaaacccgtaaccccgggaaaagggtaccctaaccgggtcgggggaaccccgttaaaacccgggg

SEQ ID NO: 49715 - DNA, 557 bp, Homo sapiens
  misc_feature: GYAE6OF01EGC6T.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagcctgggacgtccctgagactctcctgtgcagcctctggatttacattcagtagttatgctatgctactggtttcgccgagggtccaggcaaggggctgggagtgggtggctagttatatcgtatgagtaggaaacaaaatctaacgcagacctcggtaggaagggccattccaccactcctacccgacacaattaccaaagaaccactatttgtttactactgctagaacagcctagagaagtgacgacacgctagtatatcactggtcgcggacaggccaacgtacttaacccgtaacccggaacggtaccgtacggtcggggacctaaccgggg

SEQ ID NO: 49716 - DNA, 627 bp, Homo sapiens
  misc_feature: GYAE6OF01DWTGU.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggaggtcggggggagcgtggtccagcctgggacgtccctgagactctcctgtgcagcctctggtaatttacattcagttagttatgctatgctactggtttcgccgagggtccaggcgaaggggctgggagtgggtggctagttagtatcgtatgaagtaggaaaacgaaaatactacgacagactacggtaggaacgggcctagtccaacctactcccgtaacccgactaacgtaaacttaccaaacgtaaccgacttatttcgtttaccttacgtcgaccttaagaacctagtaccctaggaacgtaagtacggaacgtaaccgacggtcttagtattactctacgtgtacggcgacgaggaccaaacgtacgttaaacccgtacccgggaaacgtaccgtaacgggtcgggaccgtaaacccggg

SEQ ID NO: 49717 - DNA, 642 bp, Homo sapiens
  misc_feature: GYAE6OF01BUNOH.49.5.A05.1.454.CMB.1.raw
  modified_base (514)..(514): a, c, t, g, unknown or other
  misc_feature (514)..(514): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctgggtggaggtcggggggagcgtggtccaggccgtgggacctcctgagactctcctgtgcacgcctctggtatttacattcagttattatgctatgctacgttggtttcgccgtagggtccaggtacgaaggggctgggaggtgggtcggcgtagttatagtcgtagtagaagtaaagggaaaaccgtaaaataccgaacgacgaacggtaccgtccggtaaggaaccgggtcctattaccaaccgtctacccgtacccgaactaactaactaccgaaagtaacctatagtttacgtttacctaactcgtagtacgtaacncgaccgtagaacggtacggtaccgaaccgtaacgtacggtactagtactagtcactgggcgtcggacgtaggaccctaacggtacttaacccggaaccggaggtaccacggtcgggaccgtaaccggg

SEQ ID NO: 49718 - DNA, 723 bp, Homo sapiens
  misc_feature: GYAE6OF01DLO74.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgcttctttaagaggtgtccagtgtcaggtgcagcgtgggtggaggtcggggggaggcgtggtccagccgtgggaccgtcctgacgactctcctgtcgcacgtcctcgtaggtatttacattcgagttagttatgtctatgtctacgttcggtttccgccgtacgggtccgagggtcggaagggggtcgtaggggtacggttggggtcggtactaggtttagtacgttcgtaagtgaagtgggaaacgacgtaaagtattaagtactagtagtacgtaccgtcggtagggaaccgggtcgtacttacgactacgtactacccgtacgaagacgtaaccgaaccgtacccggaacgaaacccgtacgtaccgttaacgttaacgtcgttaacgaacgtaaacgtacggaacgtacgggaccgtagaacggtgtaccgtaaggaacgaacggttaacgttacgttttaagtaactttacggttggttacggtaaacccttaaaacgtttaaccggaacggtaaacccggggtaacgtaaccccgggtaaacccgggttaccccccgg

SEQ ID NO: 49719 - DNA, 694 bp, Homo sapiens
  misc_feature: GYAE6OF01BUWGR.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggaggcgtggtccagcctgggacgtccctgagactctcctgtgcagcctctggatttacattcagttagttatgctatgtacacgttggttcgccgaggggtccagggcgaagggggtctaggggagttggggtacgctaaggtttatagtcgttatgaagtaggaaaaacgtaaaatacgtacgactaagaccgtaccgtaggaaagggtcccgtaattcccaacctactcccgtaccccggaactaaacctaacgttacccaaacgtaacctaactacgttttcgttttacccaacctttggaccttagaaccgtagtaccctaggaacgtaacggtcgtaaccggtaccgtacgggtacttagtaacttacgtcctaacggtggtacggcggacggaaacgggcctaaaacccggttattaaaccccggtaacccggaaacggttacccgtaaccgggtccgggggaaccctaaacccggggg

SEQ ID NO: 49720 - DNA, 554 bp, Homo sapiens
  misc_feature: GYAE6OF01BGD0G.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggaggcgtggtccagcctggggacgtccctgagactctcctgtgcagcctctggatttacattcagttagttatgctatgctactggtttcgccaggggtccagggcaagggggctgggagtgggtgctagtttatatcgtatgataggaaaacgaaaatactaacgcagactcggtgaacggccatcacatcctaccgactacaattaccaagtaacactacttgtttacctactgctagaacagctagagaagtgaaccgacacggctaggtatactcactgtcgcggacaggcaacgtacttaaccgtaacccggaaggacctacggtcggggccgtaaccggg

SEQ ID NO: 49721 - DNA, 644 bp, Homo sapiens
  misc_feature: GYAE6OF01AX3LT.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctgggtggaggtcggggggagcgtggtccagcctgggactccctgagcctctcctgtgcagcctctggatttacattcagttagttatgctatgcctacgttggtttccgccgaggggtccagggcgaagggggtctggggagtggggtggctagtttatagtcggtatgaatagggaaaacaaaatcgtacgcgagacctcggaggaacggcctattccgactctcctacccgaactactaaacttaccaaacgaacctacgtatttcgtttacccactgtacctagaacctgaccttaggaacgtaacggtcgaaccgacgtaacggtccttaggtaactacgttacacgttggtacggcggtacgaacgggtaccctaaaacgtaccgttaaccccgtaacccgggaaaggttccgtaaaccgggtcgggggaaccgtaaacccgggg

SEQ ID NO: 49722 - DNA, 776 bp, Homo sapiens
  misc_feature: GYAE6OF01ECHY6.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtggaggtcggggggaggcgtggtccagccgtgggaccgtccctgagacctctcctgtgcagcctctggatttacattcagtagttatgctatgctacgttggtttcgccgtagggtccagggcgaaggggctgggaggtggggtcggctaggttatagtcgtatcgaagtagggaaaactaaaaatccaacgcaagtaccgtcggtaggaaacgggtccgtacttaccgaacctacttacccgtacccccgaactaaccgtaaacttacccgaaaacgtaaaccctaaccgtacgttttacggttttacccttaacgttcggaccgttaacggtaaaccaacgtacccgtagggaaaggtaacggttacgggaaacccgtaccgtaaaccggggttacttaacggttaacttaacgtacccgttaaaaccggttgggtacccgggaccgggtaacccggtaagggaacccctaaaacccgggttaaccggttttaaaacccccctaaacccggggaaaaccgggttaacccgttaacccggggtacccggggggtaacccccgttaaaaccccgggggg

SEQ ID NO: 49723 - DNA, 632 bp, Homo sapiens
  misc_feature: GYAE6OF01BM2R4.49.5.A05.1.454.CMB.1.raw
  modified_base (447)..(447): a, c, t, g, unknown or other
  misc_feature (447)..(447): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagcgtggtggagggtcggggggaggcggtggtccgagccgtggggaccgttccctggacgacctctcctggtcgcagcctcgtggtaatttacatttcaagttagttatgtactatgctacgttggtttccgccgtagggtccaggcgaaggggcgtgggaggtggggtgactagttatagtcgtatgaagtaggaaaacgtaaaatcgtacgacagtactaccggtagaacgggcctattcactactccacccganaactaataccaagaacctactatttacgtttaccactgacctagaacgacgtcgtagaagtaagtcgaacgtaacacggtcttagtaactactctacgtggtacggcggagaggaccaaacggtacttaaacccggtaacccgaaagggttaccctaaggtcccgggggtaccgtaaacccgggg

SEQ ID NO: 49724 - DNA, 615 bp, Homo sapiens
  misc_feature: GYAE6OF01A854P.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggaggcgtggtccagccgtgggactccctgagactctcctgtgcagcctctggatttacattcagttagttatgctatgctacgttggtttccgccgtaggggtcccagggccgaaggggtctgggaggtggggtgcgtagttatagtcgtatgaataggaaaactaaaatacgtacgacacgactcgtaggaacggcctattcactactcccaccgacaactaacttaccgaaataaccacttactttcgtttacctacgtgtacctacgaacctcgccttaaggaacgtaagtcggaacgacgacgtctagtatacgtctacgtggtccgcggacacgggtacctaaacgtactttaacccgaaccggtaacgtaccgtaccggtcggggtacccgtaaccgggg

SEQ ID NO: 49725 - DNA, 649 bp, Homo sapiens
  misc_feature: GYAE6OF01AM2L9.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggaggcgtggtccaggcctgggacgtccctgagactctcctgtgcagcctctggatttacattcagttagttatgctatgctacgttggtttccgccgtagggtccaggacgaaggggtctgggaggtggggtggactagtttatacgtcggtatagataaggaaaacgtaaaatactaacgcgaacgtacgtacggtaggaacggtaccgattaccacctactcctacccgacaccgtaaacttaccgaacgaacctaactagtttacgtttactaacgtgtaaccgtagaacctacggtaccctaaggaacggtaagtacggaacgaaccgtacggtactagtaactactactacgtggtacggcggacgaggtaccgaacgtaccgttaaccgtaaccggaaacggtaccgtacggtccggggtaccgtaaaccgggg

SEQ ID NO: 49726 - DNA, 552 bp, Homo sapiens
  misc_feature: GYAE6OF01AWW4K.49.5.A05.1.454.CMB.1.raw
  modified_base (298)..(298): a, c, t, g, unknown or other
  misc_feature (298)..(298): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggaggcgtggtccagcctgggacgtccctgagactctcctgtgcagcctctggtatttacattcagttagttatgctatgcactggtttcnccagggtccaggcaaggggctgggagtgggtggctagttatagtcgtatgataggaaaacaaaatactacgacagactcgtgaacgggccgattcaccatcctaccgacaacgtaacttaccgaaagaacaactatttgtttacctactgactagaacctaggacctggaataaggtgaacgacacggtctagtactatcagtgtcgcgcgagcaacgattaccgaccgaagtacctacgtgggacctaacggg

SEQ ID NO: 49727 - DNA, 723 bp, Homo sapiens
  misc_feature: GYAE6OF01CKNNY.49.5.A05.1.454.CMB.1.raw
  modified_base (130)..(130): a, c, t, g, unknown or other
  misc_feature (130)..(130): n is a, c, g, or t
  modified_base (139)..(139): a, c, t, g, unknown or other
  misc_feature (139)..(139): n is a, c, g, or t
  modified_base (224)..(224): a, c, t, g, unknown or other
  misc_feature (224)..(224): n is a, c, g, or t
  modified_base (250)..(250): a, c, t, g, unknown or other
  misc_feature (250)..(250): n is a, c, g, or t
  modified_base (372)..(372): a, c, t, g, unknown or other
  misc_feature (372)..(372): n is a, c, g, or t
tcagagtcgagagacacgaccggtgctcgatttagatagatagacaggggtctgggagacgagcccagcactggaagtcgccggtgtttccattcggtgatcatcactgaacacagaggactcacatggngttggctgngcgttggtttcctgttgcttagtttaaggaggtcgtcctaggttcgtacgaggtgcgagtcgttgggtaggacgggtcggggggngcgtggccaggtccgtggaccgtccngacgtcctctccgagcgacacggtcctgtaggtaactttacgtattagtaagttagttatgtactagtgtaacgtacgttcggttaccgacggtacgggtccgaacggtacggaacggggtntaggggaggtcggggtgtacgtaaggttaatcgttggtaagtaggtaaagtaaaacggaaaaacgtaaaactaccgtaacgacgtaacgtaaccgtaccggtaaggtacggaccgttaactaccgaccgtaacttcccgaaccgaactaactaacttaaccgaaagtaactagtttactttacggttacctacgtacacgtaacgaatccgagttaaacgagttaacgacacggtacgtaggtcttagacttaccggctacgtggtacgacggtagaacgtaaccgtaacgttaaaccgttaacccgaaccgggtaaagccctaacggggtcggaacccgttaaacccggg

SEQ ID NO: 49728 - DNA, 609 bp, Homo sapiens
  misc_feature: GYAE6OF01BMNAZ.49.5.A05.1.454.CMB.1.raw
  modified_base (384)..(384): a, c, t, g, unknown or other
  misc_feature (384)..(384): n is a, c, g, or t
  modified_base (473)..(473): a, c, t, g, unknown or other
  misc_feature (473)..(473): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggaggcgtggtccagccgtgggacgtccctgagactctcctgtgcagcctctggatttacattcagttagttatgactatgcctacttggtttcgccgtagggtcccaggcgaaggggctgggagtggggtgctagttatacgtcgtatgtaagtaggaaaactaaaatactacgnaagtacctcggtaggaacgggtccgattcccactactccctacccgaactacctaattacccaaagaaccactatttacgttactactncgtagaactacgcctaggaacgtaagtagaccgtacgacggtctagtactacgtcacgtaggtcggaccggcacgggaccaaccggtacttaaccgtaaccggaacggtaccgtacggtcgggacgtaacccgggg

SEQ ID NO: 49729 - DNA, 745 bp, Homo sapiens
  misc_feature: GYAE6OF01CVDJG.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcttgggttttcctcgttgtcttcttttaagaggtgtcctagtgtcaggtgcagcgtggtggaggtcggggggagcgtggtccaggccgtgggaccgtcctggacgacctctcctgtcgcacgtccttcgtggtatttacattctaggttagttatgtacttagtcgtcgtacgtttcgggtttccgaccggtacggggtcccgaagggccgggaacgggggtccgtgggggtaggttaggggtcggtaccgtaagttagttacgtacgttaagttaggaaacgttaaggaaaaacgtaaaactaaacgtacaacggtacgtaccgtacggtaacggtaaacgggtcccgtaacttacccgtaacgtaccttaacccgtacccccgtaaacaaccttaaacccgttaacccaaaagtaaaccccgtactttaacgtttccgtttaaccgttaactcgtaacttaacggtaacctacgtacgtataacggacgtacgacgacgttaccgagttagtatacgtctacgtggcggcgtacggtacggaactacgtaaaccttacgtaacccggtaaagaccgtacgggacggtccggtaaacccgg

SEQ ID NO: 49730 - DNA, 665 bp, Homo sapiens
  misc_feature: GYAE6OF01DMV6F.49.5.A05.1.454.CMB.1.raw
  modified_base (252)..(252): a, c, t, g, unknown or other
  misc_feature (252)..(252): n is a, c, g, or t
  modified_base (280)..(280): a, c, t, g, unknown or other
  misc_feature (280)..(280): n is a, c, g, or t
  modified_base (285)..(285): a, c, t, g, unknown or other
  misc_feature (285)..(285): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggagcgtggtccagcctgggactcccgtgagactctcctgtgcngcctctggatttacattcagtacgttangctangctagtggtttcgctagggtccaggcgaaggggctgggagtgggtagctaagttatatcgtatggaatagggaaaacaaaatcgaacgcaagccgtacgtaggaacggccgtaattccgaacctacgtccctaaccccgataaccaacttaccaaacgtaacacgttatttcgtttaccacgtgaccttagaacctagtccgtagtaacgtaacggtacgaccgaacgtacggtacgttagttaactacgttacgtaacgttggtaccgggaaccggtaccgtaacgggtaaccgtaaaaccgtaccgtttaaaccccggtaacccggtaaaacggtcccgttaaacgggtcccgggggaaacccgttaaaaccccgggg

SEQ ID NO: 49731 - DNA, 649 bp, Homo sapiens
  misc_feature: GYAE6OF01DM4ND.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctgggtggaggtcgggggggaggcgtggtccagccgtgggacgtccctgagacctctcctgtgcacgcctctggtatttacattcagttagttatgctatgctacgttggtttccgccgtacggggtccagggcgaaggggtctgggagtgggtggctagttatatcgtatgataggaaaacgaaaatacgacgcagtactccggtagaacgggcctattacacctactccctaccccgaacaactaaacttaccgaaagaacctaacttactttacgttttactaaccgtgtaccttacgaacaccggtaccgtaggaacgtaacggtacgaaccgaacgaccggtactacgtaatactctacgttgacggccggacacgggtaccaaacggtaacgttaacccgtaacccgggaaacggtaccttaaccgggtaccggggcccgtaaaccgggg

SEQ ID NO: 49732 - DNA, 726 bp, Homo sapiens
  misc_feature: GYAE6OF01B6X19.49.5.A05.1.454.CMB.1.raw
  modified_base (405)..(405): a, c, t, g, unknown or other
  misc_feature (405)..(405): n is a, c, g, or t
  modified_base (596)..(596): a, c, t, g, unknown or other
  misc_feature (596)..(596): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcgttgggttttcctcgttgcttacttttaagaggtgtccagtgtcgaggtgcagcgtgggtgggagggtcggggggaggcggtggtccagccgtgggacgtcctagacgactctcctggtcgcacggccttcgtaggtaacttttacatttacgtaagttaggttactgacttaagtcgacgtacgtttcggtttcgcccgtaggggtcccagggtccgaagggggtctaggggtaggtgggggtcgtacgtaaggtttaanagttacgtaagtaggtaaagtaacgggaaaaaaacctaaaaaagttcccgaacgacgtaaacggtaccgtaccggttaaggaaaccgggtaccgtacttacccgaacctaacgttcccgaaccgaacaacgttaaacttaacccgaaacgtaaacctcgttaacgttttcgttactaacgtcgaaccgtanaaacgcggtacctaaggagagtacgacgacgtaggtctagtatctacgacgttggaggccggtaagacggtacaaacgttactaaccccgacggtaaaggaccgttacggcggggacccttaacccgggg

SEQ ID NO: 49733 - DNA, 715 bp, Homo sapiens
  misc_feature: GYAE6OF01EH6UE.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagcgtgggtgggaggtcggggggaggcggtggtccgaggccgtgggacgtccctgagacctctccgtgtcgcagcctcgtggtatttacattctagttagttatgtctatcgctacgttggttccgccgtagggtccagggcgaaggggtcgtgggaggtgggtgctaggttatagtcgtatgaataagggaaaactaaaatcgtaacgacagtaccgtacggtaggaacgggtcctaagttccaaccgtctaccctacccgaactaacctaaacttaccaaagaactaccgtactttcgtttaccacgtagaccttaacgaaccgtacgaccgttaaggaacgtaacggtacgaaccggtaacgtacggtacttaggttaaaccttagtacccgtagtacgggtaccgggacccggtaagtaccgggtaacccctaaaacggggttaaccctttaaacccgggtaaccccggaaaggttaacccgtaaccggggttaccggggaacccgttaaaaccccgggg

SEQ ID NO: 49734 - DNA, 778 bp, Homo sapiens
  misc_feature: GYAE6OF01CZHWH.49.5.A05.1.454.CMB.1.raw
  modified_base (177)..(177): a, c, t, g, unknown or other
  misc_feature (177)..(177): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagtcttgggttttcctcgttgcttacgttttaaggnggttgtaccagtgtcgaggtgcagtcgtgggtgggagggtcgggggagcgtcggccaggccgtgggaccgtccgtgacgtccttctccgtgacgcacgtccgttgtggtaacttttacatttcagttattatcgtctatcgtacttcgttcgggtttccgaccggtacggggtccgagggtacgggaacggggttcgtaggggtagggttcggggtagtacgttaagtttagtacgttacggttagtaacggaaagttaaacgggaaaaacgttaaaaacgtaccgtaacgaccgtaacggtacccgttacgggaacggtaaccggtacctacgttacccaaccgtacgtaccccgtaacccgtaacaaaccttaaaccgttaacccgaaataacccgttactttaacgtttaccgtttactaccgtacgtaccgttaacgaaccggtcgtaccgaagaaccggtaacgtaccgaaccgacgttacgtacgtagttactacgttacgacgtgaccggtcggaacggaacggtaaactacccggtaaattacccggaaaccggtaggtaacccgtcgggtaaccgggtcccggtaaacccgg

SEQ ID NO: 49735 - DNA, 541 bp, Homo sapiens
  misc_feature: GYAE6OF01EW799.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggaggcgtggtccagcctgggacgtccctgagactctcctgtgcagcctctggatttacattcagttagttatgctatgcactggtttcgccaggggtccaggcaaggggctggagtgggtggcagttatatcgtatgataggaaaacgaaaaatactacgcaagactcgtagaagggccattcacatctccgacacaattaccaagaacacattgtttctactgctagaacagacctgaagaagtgacgaacgacggctagtataatcactggtgcggagaggcaaacgtattaacgtaacccgaaaggacctaacgtcggggactaacgggg

SEQ ID NO: 49736 - DNA, 637 bp, Homo sapiens
  misc_feature: GYAE6OF01BLN3B.49.5.A05.1.454.CMB.1.raw
  modified_base (347)..(347): a, c, t, g, unknown or other
  misc_feature (347)..(347): n is a, c, g, or t
  modified_base (376)..(376): a, c, t, g, unknown or other
  misc_feature (376)..(376): n is a, c, g, or t
  modified_base (511)..(511): a, c, t, g, unknown or other
  misc_feature (511)..(511): n is a, c, g, or t
  modified_base (552)..(552): a, c, t, g, unknown or other
  misc_feature (552)..(552): n is a, c, g, or t
tcagagtcgagagacacgaccggtgctcgatttagatagatagacgaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggaggcgtggtccagccgtgggacgtccctgagactctcctgtgcagcctctggtatttacattcagtagttatgactatgctacttggtttcgcctagggtccaggcgaaggggctgggagtggggtggctagttanagtcgtatgataggaaaacaaaatcacgnagtactcgtaggaacgggccattcacctatcctacccgaacactaattaccaaagtaaccactatttgtttaccacgttgaccttagaacctacgtccctaggaacgtaacggtcgaaccggaacgtaccgggtntaggttaaactacgtaccacggttgggtacggccgggtaanacgggacctaaacggttacctttaacccggaaaccccgggtaaggtaacccgttaccgggtccggggggacccttaaaccggggg

SEQ ID NO: 49737 - DNA, 648 bp, Homo sapiens
  misc_feature: GYAE6OF01CIN7W.49.5.A05.1.454.CMB.1.raw
  modified_base (171)..(171): a, c, t, g, unknown or other
  misc_feature (171)..(171): n is a, c, g, or t
  modified_base (345)..(345): a, c, t, g, unknown or other
  misc_feature (345)..(345): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagnggtgtccagtgtcaggtgcagctggtggaggtcggggggaggcgtggtccagccgtgggaccgtccctgagactctcctgtgcagcctctggtatttacattcagtagttatgctatgcacttggttcgccgtaggtccgaggcgaaggggctgggagtgggtggctagttatntcgtatgaagtaggaaaacgaaaatacgtacgacagtacgtccggtaggaacggccgtacgttccaacctactccctacccgacaacctaacttacccaagtaaacctactatttcgtttaacctacgtgacctagaacctacgtacgtagaacggtaacggtacgaacgtaaccgtacggtacgttagtacgtactcgtacgttggacggccgggacgaacgggtaccaaccgtaacgttaaccccgtaacccgggtaaacgtacccgtaaccgggtccggggtaacccggtaaacccgggg

SEQ ID NO: 49738 - DNA, 169 bp, Homo sapiens
  misc_feature: GYAE6OF01E015V.49.5.A05.1.454.CMB.1.raw
  modified_base (157)..(169): a, c, t, g, unknown or other
  misc_feature (157)..(169): n is a, c, g, or t
tcagagtcgagagacacgaccggtgctcgatttagatagatagacagggggtcaagctcacctgcactctgaacggtcagcccaaggctgccccctggtcactctgttcccgccctcctctctcgtcgactctgagcgggctggcaaggcgcatagnnnnnnnnnnnnn

SEQ ID NO: 49739 - DNA, 740 bp, Homo sapiens
  misc_feature: GYAE6OF01DTWQQ.49.5.A05.1.454.CMB.1.raw
  modified_base (676)..(676): a, c, t, g, unknown or other
  misc_feature (676)..(676): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctctttaagaggtgtccagtgtcaggtgcagctggtggaggtcggggggagcgtggtccagcctgggacctccctgagctctcctgtgcagcctctggtatttacattcagttagttatgctatcgctacgttcgggtttccgaccgaggggtacccagggaccgaaggggggtcctggggaggttgggggtggtccgtaaggtttattacgttacggttataggtaacgttaaggggaaaaaaccgtaaaaaacgtttaccgtaaaccggacctaaacggtacccgttaccccggtagggtaaaccggggtaccccgtaatttacccgaacccgtaacttccccgtaacccccggtaacctaaacctaaacgtttaacccgaaaaggtaaaccctaccgttaacgttttacgttttaccctaacgtcggtaaccttaggaaccgtacgtacccgttaagaacggtaaggtcgaacgtacccgaacggtcttagtatactcacgtgtcggaccggngaggaccaaagtacgttaacccgtaccggaaacggtactacccggtgggggccctaaaccgggg

SEQ ID NO: 49740 - DNA, 844 bp, Homo sapiens
  misc_feature: GYAE6OF01BJCB3.49.5.A05.1.454.CMB.1.raw
  modified_base (184)..(184): a, c, t, g, unknown or other
  misc_feature (184)..(184): n is a, c, g, or t
  modified_base (199)..(199): a, c, t, g, unknown or other
  misc_feature (199)..(199): n is a, c, g, or t
  modified_base (772)..(772): a, c, t, g, unknown or other
  misc_feature (772)..(772): n is a, c, g, or t
  modified_base (790)..(790): a, c, t, g, unknown or other
  misc_feature (790)..(790): n is a, c, g, or t
tcagagtcgagagacacgaccggtgctcgatttagatagatagacgaggggtctgggagacgagcccagcactggaagtcgccggtgtttccattcggtgatcatcactgaacacagaggactcaccagtgggtagttgggctggagtcgttgggttttcctcgttgcttacttttaagaggtntccagtgtcgaggtnctagcgtgggtggagggtcggggggaggtcggtcggtccaggccggtcggggaccgttcccgtaggaacgtaccttccttcccgtaggtcgaccgtacgtccttcgtacggttaactttactacgtttacgtaaggtttaacgtttagttcggttacttaacgtcggtacctaacgttttacggggtttccggacccggtaacggggtacccgaggggtaacccgggtaagggggtaccgggttgggtaacggggttgggggtacggtacttaaggtttaacgttaggttacgtaagtacggtaaagtaaacggggtaaaaaaacgtaaaacgtaccgttaaacgaacgtaacgtaacccggttaccgggtaaggtaaaccgggtaccgtaacgttacctaaaccctaccgttccccgtaaaccgaaacgtaaccttaaaccgttaaacccgaaaagtaaaccctacgtttacgttttaacgtttaccaaccgttacgacttaacgaacgtaccgtttacggaaagtaaacggtacggtacgaaccgtaaccgagtacgttatactacgtacncggtttagcggacgacgngaacgtaagtacccgtaaccgtacggaaggtcgaaccggtgggaactaacccgg

SEQ ID NO: 49741 - DNA, 593 bp, Homo sapiens
  misc_feature: GYAE6OF01EF4CV.49.5.A05.1.454.CMB.1.raw
  modified_base (467)..(467): a, c, t, g, unknown or other
  misc_feature (467)..(467): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagcctgggactccctgagctctctgtgcagcctctggatttacattcagttagttatgctatgctacgttggtttcgccgtagggtccaggccgaaggggctgggaggtgggtgctagttatatcgtatgaagtaggaaaacgaaaatctaacgcaagactccggtaggaacggccgtattccaacctattcccacccgaacaacctaacttaccaaagacactatttcgtttacacgtgactgaacngctagaacgtaagtgaccgacgtacggctaggtactatccgacgtggtcggcggtagaaggccgtaaacgtcttaaaccccgtaccggaaagggacccttacgggtcggggacccgtaaaccgggg

SEQ ID NO: 49742 - DNA, 804 bp, Homo sapiens
  misc_feature: GYAE6OF01C7P7M.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcaggtcgtgggtgggagggtcgggggggagtcggtggtccaggccgtgggaccgtcccgtgacgactctccgtgtcgcacgtcctcgtaggtatttacattcaagttagttatgacttagtgtcctacgttggtttccgaccgtacggggtaccagggcggaacgggggtctagggtagggtggggtacgggtactaaggttatagttccggtaagtaggtaaacgttaaacggaaaaaaccgtaaaaagttccgtaaacgggacgtaaaggtacccgtaccgggtaagggaaaccgggtaccctaagtttacccgaacccgtaccgtccgttacccccgaaataaccgttaaaacttacccaaaacggtaactaacgttaacgttttcggtttaacctaccgtacgtacccgtaacgtaaccgtaacgtaccgtaagggtaacggtaacggtacgggaaaccgtaaccgtaggttaccttaaggtaacttacgttaccgaaccggttgtacgggcggtaaccgacgggtaacctaaacgggttaacctaaccccggtaaacccgggtaacggaacccctttacggggtaccggggaacccgttaaaccgggg

SEQ ID NO: 49743 - DNA, 823 bp, Homo sapiens
  misc_feature: GYAE6OF01B3VZN.49.5.A05.1.454.CMB.1.raw
  modified_base (193)..(193): a, c, t, g, unknown or other
  misc_feature (193)..(193): n is a, c, g, or t
  modified_base (616)..(616): a, c, t, g, unknown or other
  misc_feature (616)..(616): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcgttgggttttcctcgttgcttacttttaagaggtgtccagtgtcaggtncagcgtgggtgggagggtcggggggaggtcgtggtccagtccgtggggaccgtccctggacgaccttccgtcctggtcgcacgtccctcgttggtaacttttacgactttacgtaaggtttaagttatggtacttatcggactacgttgggttttccggaccgtacggggtccgaacggggcggtaaaaggggggtccttaagggggagggttgggggtacggacgttaaggtttaattacgtacggttataggtaaagtaaacgggaaaaaacgtaaaatacccgtaacggacaaacgtcgtaccgggaggtaacggggtcctaacgttacccaacctacgtaccctaaccgaacctaaactaaacccttaaccgaaactaaacctactactttagttaccttacgtcgtactaggtaaacncggtaccgtaaggtaacgtaacggtacgaaccggtaccgtaaccgggttacttaacgttaaacgacttacccgtaaggtttccgggaacggtcccgggtaacggaaccgggtaacctaaaccggtttaaacccgttaaaccccggaaacccggttaaacggtaacccggttaacccgggtacggggtaaccccggttaaaacccggg

SEQ ID NO: 49744 - DNA, 649 bp, Homo sapiens
  misc_feature: GYAE6OF01ETQLX.49.5.A05.1.454.CMB.1.raw
  modified_base (385)..(385): a, c, t, g, unknown or other
  misc_feature (385)..(385): n is a, c, g, or t
  modified_base (479)..(479): a, c, t, g, unknown or other
  misc_feature (479)..(479): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcgggggggaggcgtggtccgagccgtgggacgtccctgacgctctctgtgcagcctcgtggtatttacattcgagttagttatgctatgcctagttggtttcgccgtaggggtccaggcgaaggggctgggagtgggtgactagttatagtcgtatgaagtaggaaaacaaaatcgtacganaagacgtcgtaggaacggtcacttccaactctccgtacccgacaacctaatacccaaagaccacttagtttcgtttactactgctagtaaccgngacctgaagaacgtgaaccgaccgtacggcttaggtaactacgttaccgacgttgggtcggtaccgggacgtacgggtaaaccgaaccgtaaaccgtttaaaccccgtaaaccccggtaaagggtaaccccggttacgggtaacccgggggtacccggtaaaccccgggg

SEQ ID NO: 49745 - DNA, 618 bp, Homo sapiens
  misc_feature: GYAE6OF01BNRJX.49.5.A05.1.454.CMB.1.raw
tcagagtcgagagacacgaccggtgctcgatttagatagatagacaggggtcgtgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggaggcgtggtccagcctgggacgtccctgagactctcctgtgcagcctctggtactttacattcagtagttatgctatgcactggttccgccgtagggtccaggcgaaggggctgggagtgggtgctagttatatcgtagtgatacggaaaacgtaaaatcgtacgcaagtaccgtacgtaggaacgggccctattaccacctactcccgtacccgacaacctaacttaccaaagaactactagtttcgttactactcgactagaacctagcctaggaacgtaacggtcgaaccgacaccggattacgtaatactactacgtagtcggacggacagggacctaaacgtactttaacccggaacccggtaaggaaccgttacgggtccggggtacccgtaaacccgggg

SEQ ID NO: 49746 - DNA, 682 bp, Homo sapiens
  misc_feature: GYAE6OF01C6JFF.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcacatggagtttgggctgagctgggttttcctcgttgcttcttttaagaggtgtccagtgtcaggtgcagctggtggaggtcggggggagcgtggtccagccgtgggaccgtcctgacgactctcctgtgcacgcctctggtaatttacattcaagttagttatgctatcgctacgttcggtttccgccgtagggtaccgaggcgaagggggctgggaggtgggtggctaggttatagtcgtatgaagtaaggaaaacgtaaaatacgtacgacaaggacctacggtaggaacggtccattccaacctactcccgtaccgaaccaactaacttaccaaacgtaaacacttatttacgttacctacgtgaccttagaacctaggtacctaaggaacggtaaacggttacggaaccgaacgtacgggtaccttagttaacgtaacttccgaaccggtttgtccggacggtaccgaaagggtaccaaaaccggttacttaaccccggtaaacccgggaaaggttacccgtaaaccgggtcgggggaaccccgttaaaccgggg

SEQ ID NO: 49747 - DNA, 826 bp, Homo sapiens
  misc_feature: GYAE6OF01BA268.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctgggtggaggtcggggggaggcgtggtccagccgtgggacgtccctgacgctctcctgtgcagcctctggtatttacattcagttagttatgtctatcgctacgttggttccgccgagggtccagggcgaaggggtctgggaggtggggtggacgtaagtttatagttcgtagtagaagtaaaggaaaaacgtaaaactaccgtaacgacgtaaggtaccgtaccgggtaaggaaccggggtacctaacgttaccaacccgttaccgttaccccgacccccgtaaacgtaaaccctaaaccgttaacccgaaaaggtaaaccctaacgttacgtttttaccggttttacccgtaaccgttcggtaaccgttaaggaaacccggtaacgtaccggttaacgggaaacgggttaaccggtaccgggtaaacccggtacccggtaacggggttaccctttaaggttaaaccgttaactacccgttaacgggttccggtaaccggggaccggaacccggtaacgggtaaacccgtaaaccggttaaacccggtttaaaccccgtaaaccccgggggtaaacgtaaccccggttaaaccgggggttcccgggggaaaccccggttaaaacccccgggg

SEQ ID NO: 49748 - DNA, 817 bp, Homo sapiens
  misc_feature: GYAE6OF01A8PSW.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggtttcctcgttgctcttttaagaggtgtccagtgtcaggtgcagctgggtggaggtcggggggaggcgtggtccaggccgtgggaccgttcccgtggacgacctcctccgtggtgccaggccttcgtggtaattttactatttcgaagtttaggttatggcttaagtcgcctacgtttcggttttccggcccgtacggggtccctaggggcggaaagggggtccttaggggaggtttgggggtacgggccgtaaaggtttataagttcggtaagttaggaaagttaacggggaaaaacctaaaaagttaccgtaaacggccgaagggttaaccccgtaccggtaaggaaaccggggtccctaatttacccgaaccctaacgttccccgttaacccccgaactaaaccctaaacttaaccccgaaaagaacctaaacgttaattttcgttttaccaacgtttcgacctttaaggaaccctacgggcccgttaaggaaacggtaacggtaccgaaaccggtaccgttaacggtcgttaaggttaactcgtaaccgtacgttcgggtacggccgggaccgtaaaggcccgtaaaaccgttacggttaacccggtaaacccgggaacgggtaaacccttacgggggtcccggggaaaccccggtaaacccgggg

SEQ ID NO: 49749 - DNA, 169 bp, Homo sapiens
  misc_feature: GYAE6OF01B009F.49.5.A05.1.454.CMB.1.raw
  modified_base (143)..(143): a, c, t, g, unknown or other
  misc_feature (143)..(143): n is a, c, g, or t
  modified_base (152)..(152): a, c, t, g, unknown or other
  misc_feature (152)..(152): n is a, c, g, or t
  modified_base (157)..(169): a, c, t, g, unknown or other
  misc_feature (157)..(169): n is a, c, g, or t
tcagagtcgagagacacgaccggtgctcgatttagatagatagacgagggggtcaagctcacctgcactctgaacggtcagcccaaggctgccccctcggtcactctgttcccaccctcctctctctcgactctgaggcgggntggcaggcncatgnnnnnnnnnnnnn

SEQ ID NO: 49750 - DNA, 598 bp, Homo sapiens
  misc_feature: GYAE6OF01EIUF0.49.5.A05.1.454.CMB.1.raw
  modified_base (541)..(541): a, c, t, g, unknown or other
  misc_feature (541)..(541): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagcctgggacgtccctgagactctcctgtgcagcctctggtatttacattcagttagttatgctatgcctacgttggtttcgccgtaggggtcccaagggccgaagggggctgggaggtggggtggctaggttatagtcgtagtgaagtagggaaaacgtaaaaatactacgacagacctccggtggaaagggccaattccaccacgtcctaccccgactaacctaattaccaaagaacctactatttcgtttactacttcgcttagaacacgctagaagagtacgacgacgacggtctagtatactcgtagtcgtcgcggngaggcctaacgtacttaaccgtaccggaagtaccgtacggtcgggaccgtaaccggg

SEQ ID NO: 49751 - DNA, 973 bp, Homo sapiens
  misc_feature: GYAE6OF01DVSP9.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccagtggtagtttgggctgagtcgttgggttttcctcgttgtcttcgttttaaggaggttgtccgtaggtgtcgaggtgcgagtcgtgggtgggagggtcggggggaggtccggtcgggtccgacggcccggtggggacccgttcccgtggaacgtccttccgtccgtggtacgccgtacgtcctcgttggttaactttaacgtatttcgtaagtttacgttaagtgtacttagtcgtaccgttacggtttcgggtttcccgaccggtacgggtaccgaaggggtacggtaacgggggtcgtaggggtagggttcggggtaggtacgtaaggtttacgtagtcggttaaggtaggtaaacgtaaacgggtaaaaacctaaaagttaccggaacgtacgtaacggtaacccgttaccggaaggggtaaccggtaccgtaaccttcccgaaccgtacccgttacccgtaaccccgtaactaaacccgttaaacgtttaacccgaaaacgttaacccgttaaactttaacggtttttacccgttttaaccgttaaccgtacggtaacccgtttaacggaaaacgttaccggtaaccggttaaagggtaaaccggttacgggtaaaccggtaacccggtaacccgggttacgggttaaccgtttaaggttaaacctaccggtttaaccggtaccggttaggggttaccccggaacccgggtaacgggaaacccgttaaacccgttaaaaccggggttaaaccccttaaacccccggggtaaaccggtaacccgggtaaacccgggtttaacccgggggtaacccggggtaacccccggttaaaaccccggggg

SEQ ID NO: 49752 - DNA, 687 bp, Homo sapiens
  misc_feature: GYAE6OF01AXVCR.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggaggcgtggtccagccgtggggacgtccctgagacctctcctgtgcagcctctggtatttacattcagttagttatgctatgctacgttggtttccgccgtagggtccaggcgaaggggctgggaggtgggtggctagttatagtcgtatgaagtaggaaaacgaaaatacgtacgacaagaccgtccggtaggaacgggcctattaccaccctatccctacccgaactaacctaacttaccaacgaacctactagtttcgtttacctactcgacctagaacctagacctagaacgtaacggtacgaaccggacgtaaccgggtccttagtaacttacgtaccgtaacggttcgggttacggtcccgggaccggaacgggtaccctaaaaccgggtaacttttaaccccggaaaccccgggtaaacgggtaaacccgttacccggggtacccgggggaccccggttaaaacccggggg

SEQ ID NO: 49753 - DNA, 785 bp, Homo sapiens
  misc_feature: GYAE6OF01BGIL9.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgcttcttttaagaggtgtcagtgtcaggtgcagcgtgggtgggaggtcggggggagcggtggtccagcccgtggggacctccgtgacgctctccgtgtgcaggcctctggtatttacgattcagttagttatgcttatgctacgttggtttccgcgtacggtccgaggcgaaggggcgtggaggtggtggctagtatagtcgtagtgaagtaacggaaaacgtaaaatacgtacgacaagtaccgtacggtaggaacggtccgtattaccgaccgtacttacccgtacccgaacctaactaaaccttaacccgaaacggtaaaccaacgtttacttttacggtttaccaacgttacgtaccgtaagtaaacccgtacgggacccttaaggaaacggtaaacggtaccgtaaaaccgggtaaccccgaaggggttaccccgtttaaataacccgtttaagtaccccgttaaacggttacgggtaccggggtaacccggaacgtaaccggggtaaaacccgtaaacccgttaaaaccggtttaacccccggtaaaacccgggtaaaccggggtaaacccgtttacgggggtaaaccccggggtaaccccgggtttaaaaacccggggg

SEQ ID NO: 49754 - DNA, 780 bp, Homo sapiens
  misc_feature: GYAE6OF01BS7MX.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggttgtccagtgtcaggtgcagcgtgggtgggaggtcgggggggaggcggtgggtccaggccgtggggaccgtcccgtgacgacctctcctggtgcacgcctcgtggtactttactattcaggttagtttatgtctatcgtctacgttcgggtttccgccggtacggggtccagggcgaagggggtcgtgggtaggtggggtcggtacgtagtttagtagtacggttaagtaggtaagtaacggggaaaaacgaaaaaagttaaccgtaaccggtactaaacggtaaccgtaccgggtaagggaacgggtacccggtaacttacccgtaaccctactacccgtaccccgaactaaccctaaacgttaacccaaacgtaaacctaaccttagttttacgtttaccttaacttaccggtataacgtaaccgtacgtaccgtaggaaacggtaaacggtacgggaaacccggtacgtacccggtacgttaggttaacttaccttacgtaccgtacggttcgggaccggtacgacggtactaaacccgtacgtttaaacccgtaaccggtaaacggaccggtaccgggtaacccggggccgtaaaccccgggg

SEQ ID NO: 49755 - DNA, 722 bp, Homo sapiens
  misc_feature: GYAE6OF01CBQJK.49.5.A05.1.454.CMB.1.raw
  modified_base (284)..(284): a, c, t, g, unknown or other
  misc_feature (284)..(284): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggagcgtggtccaggccgtgggacgtccctgagacctctcctgtgcagcctctggtatttacattcagttagttangctatgactacgtggtttcgccagggtccaggacgaggggtctagggaggtgggtgcgtagttagtagtcgtagtagaagtaacggaaaacgtaaaaatccgaacgtacgaacgtaccgtccgggttaaggaaaccgggtccgtaagtttacccgaaccgtacgtacccctacccggaactaacccttaacttaacccgaaagaacctaacgttacgttttaccggttttacctaaccgtggtaccgttacggaacacggtacgtaggaagtaacggtccggaaccgaaaccggtcgggtaaccttggtaacttacgtaccgtaccgttgggtaccggacgggacccgacggaacccgttaaaaccggtaaccgtttaacccggaaacccgggaacgttaaaccgggtccggtaccgggggaacccgtaaacccgggg

SEQ ID NO: 49756 - DNA, 898 bp, Homo sapiens
  misc_feature: GYAE6OF01BS6S2.49.5.A05.1.454.CMB.1.raw
  modified_base (175)..(175): a, c, t, g, unknown or other
  misc_feature (175)..(175): n is a, c, g, or t
  modified_base (260)..(260): a, c, t, g, unknown or other
  misc_feature (260)..(260): n is a, c, g, or t
  modified_base (266)..(266): a, c, t, g, unknown or other
  misc_feature (266)..(266): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccagtggagtttgggctgagcttgggttttcctcgttgcttcttttaaagnggttgtccagtgtcaggtgcagcgtgggtggaggtcggggggagcgtggtccagccgtgggacctcctgacgcctctcctgtgcncgcctntggtactttacattcgagtttagttatgtacttagtcgtactacgtttcgggtttaccgacccggtaacggggtacccgaaggggaccgggtaaaggggggtccgttagggggtaagggttcggggggttacgggtaacgtttaaaggtttaacgttaacgttacgggttaaagttacggtaaaaggttaaaacggggaaaaaaaccttaaaaacgttaccgtaaaccggacgtaacggtacccggtaccggtaaacgggaaccgggtacccgtaatttaccccgaaacccttacgtacccccgtaacccggtaactaaacccgttaaacgttaaaccccgaaaagtaaaccctacgtttaacgtttttccgttttaacccgtaaccgtttacgaccgtttaacggaaaaccgttccggtacgttaaagggaaacgggttaaacgttccgggaaccgtaaacggttaccgggtacgtttacgttaaacgttcgtaacccggttaggttacgggtcgggtacccggaacgtaaccgggtaaaccgaaaacgtttaaccgtttaaaccccggaaacccggggtaaacggttaacccggtaccggggtacccgggggtaacccttaaacccgggg

SEQ ID NO: 49757 - DNA, 718 bp, Homo sapiens
  misc_feature: GYAE6OF01B3DH2.49.5.A05.1.454.CMB.1.raw
  modified_base (514)..(514): a, c, t, g, unknown or other
  misc_feature (514)..(514): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcttgggttttcctcgttgcttcttttaagaggtgtcagtgtcaggtgcagcgtggtggaggtcgggggaggcgtgtccagccgtgggacgtccctgacgtactctcctgtcgcacgcctctaggtactttacacttcgtaagttagttactgtcttagtgccgtacgtttcgggtttccgacccgtacggggtccgtagggaccggaaggggtctaggggaggttgggtcggatagttaagtattacgtagtagtaagtaaacggtaaaaacgtaaatacgtacgactaacggaccgtaccggtaaggaaacggggtcctacgttcccaaccgtactccccggtaaccaacgtaacctaacgtaccgaaanaacgtacctagttttaccgttacgtactacgtcgtaaccaagttaacggtcctaaggaacgtaacggtacgtaacccggtaacgtaccggtacttagttaacacgttaaccgacgttaggtaccggtcggacgtaacggaactaacggtaaacttacccggaaccggtaacggtacctaaccggtcgggtaacccggtaaccgg

SEQ ID NO: 49758 - DNA, 588 bp, Homo sapiens
  misc_feature: GYAE6OF01DFIMG.49.5.A05.1.454.CMB.1.raw
  modified_base (521)..(521): a, c, t, g, unknown or other
  misc_feature (521)..(521): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggagcgtggtccagcctgggacgtccctgagactctcctgtgcagcctctggatttacattcagttagttatgctatgcacttggtttccgcagggtccaggcaaggggctggagtgggtgcagttatagtcgtatgataggaaaacgaaaatactacgcaacgacgtccgtaggaacgggccattcaacctactcctacccgaacaactaacttccgaaagtaaccactatttgtttacctactgtacctagaacctgtcctagaagtaacgtcgacgacacggtctagtatacgtcacgttgacggcgganacgggactaaacgtacttaaccgtaacccggaaaggtaccttaacggcgggggtccctaaaccgggg

SEQ ID NO: 49759 - DNA, 751 bp, Homo sapiens
  misc_feature: GYAE6OF01CC37F.49.5.A05.1.454.CMB.1.raw
  modified_base (665)..(665): a, c, t, g, unknown or other
  misc_feature (665)..(665): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagcgtgggtgggaggtcggggggaggcggtggtccaggtccgtggggaccgtcccgtgagtacctctccgtgtcgcacgtcctcgtggtactttactattacgtaagttagttatcgacttagtcgtactacggttcggtttccgaccggtcgggtaccgtagggacggtaaggggcgtagggtacgggttggggtcggtactaaggtttaatacgttacggtaagtaggtaaacggttaaaacggaaaaacgtaaaacgtaccgtaacggaccgtaacgggtaaccgttacgggtaacgggtaaacggggacccttaacgttacccgtaaccgtaaccgttacccccgtaccccgtaaacctaaacctaaacccgttaaccgaaaacggtaaacctactttacgtttcgtttaactacgtcgtactaacgacgtacgtcgtaggaaatcggtacgacacgtaacgtgtactanactcgacgtggtcggcgtacgtaacgtctaaaccggtaacttaacccgaccggtaagacccggtacggtaccgggcctaaaccggg

SEQ ID NO: 49760 - DNA, 685 bp, Homo sapiens
  misc_feature: GYAE6OF01DI6V4.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtggaggtcggggggagcgtggtccaggcctgggaccgtccctgacgactctcctgtgcagcctctggatttacattcagttagttatgctatgctacgttggtttccgccgtaggggtccagggcgaaggggctgggaggtgggtggctaagttatagtcgtatgaataggaaaacaaaatactacgcaagacgtccgtaggaacgggccgtaagttccaacctactaccctaccccgaactaaacctaactttaccgaaaactaacaaccttacgtttacgtttaccttacgtacgaccttaggaacctacgtccttaaggaacgtaaacggtggtaaccgaccgacggtacttaggttaacttacgttacgaccgttggtacgggaccggacgacgggtaccctaaaacggtaccttaaacccggtaaccccgggtaaacggtacccggtttaaccgggccggggtacccggttaaaccccgggg

SEQ ID NO: 49761 - DNA, 772 bp, Homo sapiens
  misc_feature: GYAE6OF01ER6DO.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagcgtgggtggaggtcgggggggagcgtggtccagccgtgggaccgtccctgacgactctcctgtgcagcctctggtatttacattcagttagttatgctatgcctagttggtttcgccgagggtccaggcgaaggggtctggacgtggggtcgactaggttactagttcgtaagtacggtaagttaagggaaaaaacgtaaaaacttccgaacgacctaacggtaaccgtacccggtaaggaacggggtacccgttaacgttccaaccgtaccttaccccgaacccgtaacaaacccttaaacgttaaacccgaaaggtaaccctaaccgttagtttaccggttttaacctaacgtcgtaaccgttaacgaaaccgtacgtacccgtaagggtaaactaacggttacggaaacccgtacggaaccggttaccgtagttaaacgttcgtaaccggtaccggttacgtacgggtacccggaaggttaaccggaaccttaaaacggttacccttaaacccgggtaaaaccggaaccggttaccggtaaacccgggcggggtaaaccccgttaaaccccgggg

SEQ ID NO: 49762 - DNA, 714 bp, Homo sapiens
  misc_feature: GYAE6OF01A4ZO2.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctgggtggagggtcggggggaggcgtggtccagccgtgggacgtccctgagcctctcctgtgcagcctgtggatttacattcagttattatgctatgctacgttgggtttccgccgtagggtccaggcgaggggcgtgggaggtgggtgactaggttatagtcgtagtagaagtacggaaaacgtaaaagtacgacgtagacgtaccgtaccggtaggaaccgggacgtacttacccaccataccccgtaccgacctaactaaaccgttaaccaaacgtaaccgtaacttacttttacgtttaaccgttaccgtacgtaccgtaacgaactacggtacttaagggtaagtaacggtacggtaaccgaaccgtaccgggtacctaaggttaataccgttacggacgtacggtacgggacccggtagaaccgggtaaccgtaaaccgtacccggttaaacccgtaacccgggtaacgtaaaccccggttacgggtaacccgggggtaccctaaacccggggg

SEQ ID NO: 49763 - DNA, 794 bp, Homo sapiens
  misc_feature: GYAE6OF01EOLGF.49.5.A05.1.454.CMB.1.raw
  modified_base (190)..(190): a, c, t, g, unknown or other
  misc_feature (190)..(190): n is a, c, g, or t
  modified_base (700)..(700): a, c, t, g, unknown or other
  misc_feature (700)..(700): n is a, c, g, or t
tcagagtcgagagacacgaccggtgctcgatttagatagatagacagggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtncagcgtggtggaggtcgggggaggtcgtggtccaggtccgtgggaccgtccctggacgtacccttccgtccgtggtcgcctacggtcccttcgtagggttaacttttaaccgagtttaccgtaaggtttaagttacgtgaccttaagtcgtccgttacgttcggtttccggccgtacggggtccgacggacggtaagggtccgtagggtcggtgggtgacgtaaggttactacgtagtagtagaacgtaacggaaaaacgtaaaactaccgtaacgacgtaagtacccgtacgggtaacggaaccggtccgtaacgtaacctacccgtaccttaccccgtaacccgaactaaaccgttaaaccttaaccgaaaactaaccctaactttacttttacgttacccttaacgtcgtacgtaacgtaaccgtagtaccgtaaggaacggtaacgtacgaaccggtacgtaacgtctagttaactctacgtaaccggtgtacggtccgggaaccncgggtaaacctaacccgttaaacttaaaccccggtaaaccccgggtaaagttacccgtaaacccggggttccggggaacccgttaaacccgggg

SEQ ID NO: 49764 - DNA, 697 bp, Homo sapiens
  misc_feature: GYAE6OF01APO7Z.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctgggtggaggtcggggggagcgtggtccaggccgtgggacgtccctgagctctcctgtgcagcctctggtatttacattcagttagttatgtctatcgctacgttggtttcgccgtagggtccaggcgaaggggctgggagtgggtgacgtagttatgtcgtatgaagtaggaaaacgtaaaatctaacggactacggaccttcggaggacgggtaccgtacttcccgaacctagttccccgtaaccccgaacctaaaccgtaaaccgttacccgaaaacgtaaacctacttagttttaccggtttacctaacgttacgaccgttaacgaacccgtagtacccgtaggaaacggtaacggtacggaaccggaccgttacggtcttagtaacgtactaccgtacgtggtaccggccgggtacgacggtacctaaaccggtaccgtttaacccgaaacccgggtaaggtaaccgttaccggggtaccgggtaccccgttaaccggg

SEQ ID NO: 49765 - DNA, 808 bp, Homo sapiens
  misc_feature: GYAE6OF01ERHQ6.49.5.A05.1.454.CMB.1.raw
  modified_base (257)..(257): a, c, t, g, unknown or other
  misc_feature (257)..(257): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcttgggttttcctcgttgcttcttttaaggaggtgtccagtgtcaggtgcagcgtggtggaggtcggggggagcgtggtccagccgtgggacctccctgacgtctctccgtgtncacgcctctggtacttacgtattacgtagttagttatcgtacttagtcgtctacgttcggtttccgacccggtacggggtaccccgaagggaccggtaagggggtccgttaggggtagggttggggtaggacgttaaggtttaatagttaccgttaaggtggtaaagtaaacggtaaaaaccgtaaaaacttaccgaaccgtacgaacgtaccgtaccggtagggtaaacgggtcccgtaacttacccaaccgtacctacccgtaccccgaactaaccgtaaacttaaccgaaaacgtaacctaaccgttaattttaccggtttaaccctacgttacgtaaccgtaacgtaaacccgtacgttaacccgtaaggtaaccggtaaacggtaccggtaaacccggtaccggtacgggttaccttaacgggttaacttacgtaccgtacggttacggtacggaccggtacgaacggtaaccgtaaaccgttacgttaaaccccgtaccgggtaaacgtacccggttacgggacccgggtaccgggtaaacccgg

SEQ ID NO: 49766 - DNA, 810 bp, Homo sapiens
  misc_feature: GYAE6OF01BJR0D.49.5.A05.1.454.CMB.1.raw
  modified_base (685)..(685): a, c, t, g, unknown or other
  misc_feature (685)..(685): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagtcgttgggttttcctcgttgcttcttttaaggaggttgtccagtgtcagggtgcagcgtgggtgggagggtcgggggggaggtcggtcgggtccgaggtccgtcgggaccgtcccgtagacgtaccttccgtccgtggtcgccgacgtcccttcgttacggttaacttttaacgtactttacgtaaggtttaagtttaagtcgtacttagtcgtaccgttaccggtttcgggtttcccgccggtaacggggtacccgtaacgggacggaacgggggtcgtaggggtagggttggggtacgggtacgttaaggtttatagttcgtagtaggtaagtaaggaaaaacgtaaaatacgtaacgacgaacgtacgtacggtaaggaacggtacctacgttaccaacctaccgttaccccacccgtaacaacgtaaacttacccgaaagtaaccctacttacttttaccgttaacctacgtgtacctaacgacctacgttccgtaaggtaaacgtacggtaccggaaaccggtccgtaaaccggttntaacgtaactaacgtacgtacgtcgggacggaccggtagaccggtaaacctaaggttaaccccttaaaccccggaaccgggtaaacgtacccggtaacggggtacccggggacccgttaaaccgg

SEQ ID NO: 49767 - DNA, 768 bp, Homo sapiens
  misc_feature: GYAE6OF01BKCJW.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggaggcgtggtccagccgtgggacgtccctgacgactctcctgtcgcagcctcgtggtatttacgattcagttagttatgtctatgcacttggtttccgaccgtagggtccgagggcgaagggggcctggggacggtggggtggacgtagtttatatcgttatcggaagttaacgggaaaaacgtaaaaatacgtaaccgacgtacggtacctccggtaggaacgggcctagttaccgaacctatcccgtaccccgaactaacctaacttaacccaaagtaaacctacgtactttcggtttaacctacgttacggtaccgttagaaaccacgtaccgtagggaaacggtaacggttaccgggaaccggtaaccgtaaccgggtactttacgggtaaacgttcgttaccgtaacgttacgggtacggacccgggtaccggtaacggggtaacccctaaaccggtaaacccgttttaaccccgggaaaacccccgggtaaaggggttaaacccccttacgggggtaacccggggggtaacccccgttaaaaccccggggggg

SEQ ID NO: 49768 - DNA, 649 bp, Homo sapiens
  misc_feature: GYAE6OF01DN6AP.49.5.A05.1.454.CMB.1.raw
  modified_base (257)..(257): a, c, t, g, unknown or other
  misc_feature (257)..(257): n is a, c, g, or t
  modified_base (341)..(341): a, c, t, g, unknown or other
  misc_feature (341)..(341): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggagcgtggtccagcctgggactccctgagactctcctgtgctagcctntgtatttacgattcagttagttatgctatcgactacgttggtttcgcctaggggtccaggcgaaggggtctagggagttggggngacgtagttaactatacgtatggaagttaggaaaacgtaaaatactacgactagactccggtaggaacgggtccattaccgacctatcctaccccgaactaacgaacttaccaaagtaaccactatttcgtttactaccgtggactaacgaacgtacgaccgtagaagtaagttcggaacgtaacgcggtactgttaactactacgtacgtaggtacggccggacaagggtacccaaaccggttaccttaaaccgtaaccccggaaaaggtacccgttaacgggtacgggggacccgtaaacccgggg

SEQ ID NO: 49769 - DNA, 870 bp, Homo sapiens
  misc_feature: GYAE6OF01E418N.49.5.A05.1.454.CMB.1.raw
  modified_base (99)..(99): a, c, t, g, unknown or other
  misc_feature (99)..(99): n is a, c, g, or t
tcagagtcgagagacacgaccggtgctcgatttagatagatagacaggggtctgggagacgagcccagcactggaagtcgccggtgtttccattcggtnatcatcactagaacacaggacggacctcacctagtgggtaggtttcgggctggtacgtccgtttcgggttttcctcggttgtactttacggttttaacggcggttacgtaccgtaggttcgtacgtaggttcggtagtaccgttaaggttacgtaacggttacgggtcgggttcggggggtaggggccggttccggtccggtaccgggtaccggtccgggtacgggtcccgtacgtcgtaccgttcctccgtacgtgtcctaccgtcgtcccgttggttaccgttactccggttctacggtacgttccttaccacggttcgccgtaaccggtccgggtaccgcccgacgggtcgtaaccgggtcgggaacggggtaccggtagggtttaccgggaaggttaccgggttaccttacttaacttcccgtttaccgtacgttaccggtaagttaacgggtacgggttaacgtttaaccgtagttaacgttccgtttaaccgtccgtaccgggaaccccgttcggtttaccgggaacggtaccggaacctttaccgaccctacgttaacgtaccgttaaccggaacgtaaaccgtaactaaaccgtaactaaccgtaaactacccttaagtacttactacgtaaactcgaaccgtctaccgtaggtaacgtaccggtacgacgttaaccgacgtacgttactagttaccgtttcgacggttggaagttacgacgtttgtaaccttagttacccgtaagtttccgacggttacccg

SEQ ID NO: 49770 - DNA, 748 bp, Homo sapiens
  misc_feature: GYAE6OF01DGVM9.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggtagttgggctgagcttgggttttcctcgttgcttcgttttaagaggtgtccagtgtcaggtgcagctgggtggaggtcggggggagcgtggtccaggccgtgggaccgtccctggacgtcctctccgtgtgctacgtcctcgtaggtattacattacagttagttactgacttagtgccgttacgttcggtttccgccggtacgggtccgagggacggtacgggggtcgtgggtaggtggggtaggtacgtagttaagtagtcggtaataggtaaagtaaacggtaaaaacgaaaaagttaccgtacgacgtaacgtaccgttaccggaagggtaacgggtcctacgttacccaaccgtacctacccgtaaccgaactaacctaaacgtaaccaaacgaactacttacgtttcgttaacctacgtcgtaactaacgaactacgtacgtaagaacgtaacggtccgaacgtacgtacggtacttagttaactcgttacgtacgtagggccggtacggaacccggaaggtaacccgtaaaccgggttaaccttaaacccccggaaacggtaacccggtaacccggtaacggggtacccggggtaaccggtaaaccccggg

SEQ ID NO: 49771 - DNA, 755 bp, Homo sapiens
  misc_feature: GYAE6OF01DYC54.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcgttgggttttcctcgttgcttcttttaaagaggtgtccagtgtcaggtgcgagcgtgggtggagggtcggggggaggcggtcggtccacggtccgtcgggaccgtcccgtgacgaccttcctccgtggtcgccgacgtccgttcgtaggttaacttttacctagttacgtaaggttacgtttaatcgtaccttaagtcgtaccgtaccggtttcgggtttcccggaccggtacggggtacccgaaggggtaccggtaaggggtccggtagggtagggttgggtacggtacgttaagttattacggtacgttagtaggaacgttaaacggaaaaacgtaaaactacgtaaccgacgtaacgtaccgtaccggtaggaaccggtaccgtacgttacccacgtactaccccgtacccgaactaacgtaacctacaaacgtaacctacgttacgttttcgtttacaacgttcgacgtaacaacgtacgctaggaagtacgacgaacgcgtacgtctagtatcctagtcgcgtacggccgaacgtaggtacctaaacgttaacccgtacccggtaaccggaacggttaacgtccggggaccggacgttaacccggg

SEQ ID NO: 49772 - DNA, 558 bp, Homo sapiens
  misc_feature: GYAE6OF01DEPCO.49.5.A05.1.454.CMB.1.raw
  modified_base (387)..(387): a, c, t, g, unknown or other
  misc_feature (387)..(387): n is a, c, g, or t
  modified_base (405)..(405): a, c, t, g, unknown or other
  misc_feature (405)..(405): n is a, c, g, or t
  modified_base (457)..(457): a, c, t, g, unknown or other
  misc_feature (457)..(457): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgggaggtcggggggaggcgtggtccagcctgggacgtccctgagactctccctgtgcagcctctggattttacatttcagttagttatgctatgcacttggtttcgccgagggtccaggcgaaggggctgggagtggggtggcaggttatagtcgtatgataggaaaacgaaaatacacgcagactccgnggaaggccatcaccatcncccgacacaacttaccaagtaacactatttcgtttctactcgtctacgaacncgacctgagaacgtcgacgacacgctgtatatacacgtgtcgcggcacggcaacgtacgttaactaaccccggtaagacctaacgtggggcccgtaacggg

SEQ ID NO: 49773 - DNA, 578 bp, Homo sapiens
  misc_feature: GYAE6OF01EDTVC.49.5.A05.1.454.CMB.1.raw
  modified_base (396)..(396): a, c, t, g, unknown or other
  misc_feature (396)..(396): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagcctgggacgtccctgagactctcctgtgcagcctctggatttacattcagtagttatgctatgcattggtttcgccagggtccaggcgaaggggctggagtgggtgcagttatatcgtatgaagtaggaaaacgaaaatactacgcagactcgagaggccattcacatcaccganactaatccaagaacacatttgttctactgctagaacagacctagaacgtaagacggtacgacgtacgggtctagtaatcgtacgacgtgtcggaccggtacgacgggtcctaaacgtaccgtttaacccgtaacccggaaacggtaccgttaaccgggtcgggggaacccgtaaaccggggg

SEQ ID NO: 49774 - DNA, 662 bp, Homo sapiens
  misc_feature: GYAE6OF01B0R3S.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggaggcgtggtccagccgtgggacgtccctgagactctcctgtgcagcctcgtggactttacattcagtagttatgctatgcacttggtttcgccgtagggtccagggcgaagggggctgggagtgggtggctagttatgtcgtatggaataggaaaacgtaaaatactacgacgtaagacctccggtaggaagggcccgtattaccacctactcctacccggactaactaaacttacccaaagaacctactacgtttacgtttaccttacctgtaccttagaaccgtacgaccgtaggaacgaagggttcgaaccggaccgaacgggtctacggttaatacgttacctacgtgggttcggccgggtacaaccgggtacaaaccggttacttaaaccccggtaacccggaacgggtaacccgttacggtaccggggggtccctaaacccggggg

SEQ ID NO: 49775 - DNA, 835 bp, Homo sapiens
  misc_feature: GYAE6OF01BV7B1.49.5.A05.1.454.CMB.1.raw
  modified_base (170)..(170): a, c, t, g, unknown or other
  misc_feature (170)..(170): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttggctgagctgggttttcctcgttgcttctttaagnggtgtccagtgtcaggtgcagcgtgggtggaggtcggggggagcgtggtccagccgtgggaccgtccgtagacgtacctctccgtgtcgcgacgccttcgtggtaattttaccatttccaaggtttagttatcggtacttagtcggtacctaccggtttcgggttttacccgacccgtaggggttccccaaggggtaccgaaaggggggtcctaggggagggttggggtcgggtactaaggtttaagtacgttacggttaagtcggtaaagtaacgggaaaaaaccgtaaaaacgtccgtaaaccggtactaaacgggtacccgttacccgggtaagggaaacccggggtccgtaacgtttacccaacccgtacgttacccccgtaaccccgggaaactaaaccgttaaaccgtttaaacccgaaacgtaaaccctaacgttacgttttaccggtttacctaacgtcgtacttaacgaaccgtagtacccgtaaggaacggttaagaccggaaccgtacgtccggtattcggtaaacttaccgtaccgtaggttaggtcggaccggtacgaacgggtaaccctaaacccgggtacctttaaacccggaaaccccggtaagggttaaccccgtacgggttacccggggaccggttaaaaccccggg

SEQ ID NO: 49776 - DNA, 789 bp, Homo sapiens
  misc_feature: GYAE6OF01CTHQQ.49.5.A05.1.454.CMB.1.raw
  modified_base (172)..(172): a, c, t, g, unknown or other
  misc_feature (172)..(172): n is a, c, g, or t
tcagagtcgagagacacgaccggtgctcgatttagatagatagacaggggtctgggagacgagcccagcactggaagtcgccggtgtttccattcggtgatcatcactgaacacagagactcaccatggagtttgggctgagcttgggttttcctcgttgcttcttttaagnggttgtccagtgtacaggtgcagcgtggtgggaggtcggggggagtcgtaggtccaggccgtggggacctcccgtgacgactccgtccgtgtagcgacgtccgtcgtggtaacttttaccatttcgaagtttacgttaatgtcctaagtcgtctaccgtttgggttttcccgaccgtaggggttccacgggaccggtaacgggggtctacggggaggtaggggtcggacgtaggtttataagttccgtagtacgtaagtaacgggaaaaactaaaatacgtaccgagtaacgaccgtcggtaaggaacgggtccctaagttcccaaccgtacttacccgttaccccgaaactaaccgtaaacgttacccgaaaagtaaccctacgttactttccggttttaaccgtaaccgtgtaacccttaacggaaacccgtacggtaacccgtttaggaaacgggttacggtacggtacccgaacgttacgggtccctttagggttaacttaccggtaccagtttaccgggagtacccgggacgtaaacgccgttaaaaccgcccgtttaaacccgaacccgggtaagtaccggttaaccgggccgggtacccctaaacggggg

SEQ ID NO: 49777 - DNA, 614 bp, Homo sapiens
  misc_feature: GYAE6OF01A6CSQ.49.5.A05.1.454.CMB.1.raw
  modified_base (431)..(431): a, c, t, g, unknown or other
  misc_feature (431)..(431): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagcgtgggtgggaggtcggggggaggcgtggtccaggccgtgggaccgtccctaggacgactctcctgtcgcacgcctcgtgactttacgattcagttacgttatgctagtgctacgttcggtttccgccgtagggtccgaggcgagggcgtggaggtgggtggctagttatagtcggtatggaatacggaaaactaaaacgtctaacgcaagacctacggtagaacgggctactcaccnctaccgaccacaacaacttaccaaagtaacactatttcgttctactcgctaacgaacacgcctagaagtaacgtacgaacgacgacgtactatacactacgtctcggtaggaccgtagaacgcccaaacgttactaacccggtaacccgtaaggacccgtacggtaccgggcggtaacccggg

SEQ ID NO: 49778 - DNA, 843 bp, Homo sapiens
  misc_feature: GYAE6OF01B1XIA.49.5.A05.1.454.CMB.1.raw
  modified_base (176)..(176): a, c, t, g, unknown or other
  misc_feature (176)..(176): n is a, c, g, or t
  modified_base (342)..(342): a, c, t, g, unknown or other
  misc_feature (342)..(342): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcttgggttttcctcgttgctcttttaagaggtntccagtgtcaggtgcagctggtggaggtcggggggaggcgtggtccaggccgtgggaccgtccctgacgactctcctgtgcagcctcgtggtatttacattcagtagtttatgctatgccacgttggtttccgccgtagggtccgagggcgaagggggtcgtgggnggttgggtggtacgtaagttagtagtcggtaagtcggaagtaacgggaaaaacgtaaaaactacgtaaccgactaacggtaccgtaccggttagggaaacgggtcccgtaactttaccgaacccttactaccccgtaaccccgaacctaaaccgttaaaccctttaacccgaaaacgtaaacccttaaacgtttaacgttttaaccggtttttacccgtaacccgttttacgggtaacccttaacgggaaacccgttaccgggtacccgtttaaagggaaaccggtaaacgggtaacgggtaaacccggaacccggttaaccgggtacccttaggttaaccgttaccgttaccgttaaccgtacgggtacggcccgggtaacggaacgggtaaacccgtaaaacgggttaacccctttaaacccgggtaaacccccgggtaaacgggtaaccccggtttaaaccggggtcccgggggtaacccccggtaaaacccgggggg

SEQ ID NO: 49779 - DNA, 886 bp, Homo sapiens
  misc_feature: GYAE6OF01BDAJ7.49.5.A05.1.454.CMB.1.raw
  modified_base (179)..(179): a, c, t, g, unknown or other
  misc_feature (179)..(179): n is a, c, g, or t
tcagagtcgagagacacgaccggtgctcgatttagatagatagacagggtctgggagacgagcccagcactggaagtcgccggtgtttccattcggtgatcatcactgaacacagaggactcaccagtggtagtttgggctgagtcgttgggttttcctcgttgtcttacgttttaagnggtgtccagtgtcgaggtgcgagcgtgggtggaggggtcggggggaggtcggttcggtaccgacggtccggtcgggtaccgttcccgtaggtacgtaccttcctccgtggtcgccgtacgtccgttacgtaggttaactttacgtactttacgtaaggtttaagttagtcggtattagtcgtacttacggtttcgggttaccgaccggtacgggtacccgacgggtacggtaacggggtcggtaggggtagggttacggggtacggtagttaagtttaagtacgttcgggttaagtaaggtaaacgtaaaagggaaaaaaacccttaaaacgtacgtaaaccggtacgaaacggtaccgtaccggtaagggtaaccggtacctattacccgaccttaccgtaccccaccgtaaacctaaacttaacccgtaaaccgtaaagaaccttagtttcttttaccgtttacgacgttgaaccttaggaaccgtacgacgttaacggaaacgggttacgtacggaaaccctaggtaacccgttacggttaacttaaacgtaccgttaaccggttaccgtagggtaccggtaccggtaaccgtaaacggtaaccgttaaaaccgggttaaccccgtaaaaccggtaaaaccccggggacgttaaaccggggttacccggggtaaaccccgggtaacccggtttaaaaccccggg

SEQ ID NO: 49780 - DNA, 771 bp, Homo sapiens
  misc_feature: GYAE6OF01A5UJT.49.5.A05.1.454.CMB.1.raw
  modified_base (172)..(172): a, c, t, g, unknown or other
  misc_feature (172)..(172): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgcttcttttaagnggtgtccagtgtcaggtgcagcgtggtggaggtcggggggaggcgtggtccagccgtgggacgtccctgacgacctctcctgtcgcagcctctggactttacattcagttagttatgtctatgctacgttcggtttccgccgtaggggtcccaagggccgaagggggtcgtggggacggttggggtcggactaaggtttagtacgttcggtaagtaggtaagtaaacgggaaaaaacgtaaaaaacgttaccgtaaccggaaccgaagtaacccgtaccggttaagggaaacggggtcctaacgtttacccgaccctaacgttaccccgtaccccgaaactaaaccgttaaaccttaacccgaaaacgtaaaccctaaaccttaacgttttacggtttaacctaaccgttacgaccttaacgaaaccgtacgtaccgttaggaaacgtaacggtacgacgtaacgaccggtactaggttaaacctgtaccgtacgttaggtccggaccggtaggaaccggtaccaaaacggttacgttaaaccccgtaacccgggaaggtaaccccgttacgggtaccggggtacccggtaaacccggg

SEQ ID NO: 49781 - DNA, 919 bp, Homo sapiens
  misc_feature: GYAE6OF01DCGYL.49.5.A05.1.454.CMB.1.raw
  modified_base (125)..(125): a, c, t, g, unknown or other
  misc_feature (125)..(125): n is a, c, g, or t
  modified_base (817)..(817): a, c, t, g, unknown or other
  misc_feature (817)..(817): n is a, c, g, or t
  modified_base (832)..(832): a, c, t, g, unknown or other
  misc_feature (832)..(832): n is a, c, g, or t
tcagagtcgagagacacgaccggtgctcgatttagatagatagacaggggtcgtgggagacgagcccagcactggaagtcgccggtgtttccattcggtgatcatcactgaacacgagacggacncaccagtggtaggttggctggagtcgttcgggttttcctcgttgtcttagtttaaggaggtgtaccgagtgtacgaggtcgacgtaggtcgtgggtaggggacgggggtcggggggacgtcggtcggtccgacggtccggtggggtaccgtccgtagtaccgtccttccgttccgtgtcgtaccgacgtcccgttaggttacggttaacctttacgtaactttaacgtaagtttaacggttactacggtatttacgtccggtaccgtttaccgggtttcgggtttaccccggaccgggttaccggggtaaccgtaacggggaccgggtaacggggttcggtaacgggtaggggtcgggtcggtaacgttaagtttacgtacggttaagtagtaaaggtaaacggttaaaaacggaaaaacggttaaaacgtacccgtaacggaccgaaaggttacccggtacgggtaacgggaaccggttaaccgttaactcccggtaaccctaacgaccccgttaaccccgaaactaaaccgttaaaccgtaaaccgaaacttaaccaagttttacccgtttagtttaaccctaacggtacccgttaacgaaccgtaacgtaacccggtacgtaagggtaaagaaccgggtaccaaccgggtaacgtacgttacttaaggttcgtaaccgtgggtaaccgnggtcccgacgggtanaaaccggttaacgacccggttaaaccttaccggggtaaacccgaacggttaacccgggaccgggtaccgggacccggtttaaaccgg

SEQ ID NO: 49782 - DNA, 988 bp, Homo sapiens
  misc_feature: GYAE6OF01DVM6J.49.5.A05.1.454.CMB.1.raw
  modified_base (255)..(255): a, c, t, g, unknown or other
  misc_feature (255)..(255): n is a, c, g, or t
  modified_base (273)..(273): a, c, t, g, unknown or other
  misc_feature (273)..(273): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccagtggagtttgggctgagtcttgggttttcctcgttgcttcttttaagaggtgtccagtgtcgaggtgcagcgtgggtggagggtcggggggagcgtggtccagccgtggacgtcctgacgctctctgngcagctcgtgtacttacnttcagttagttatgtcttagtgtcctacggtttcggtttccggaccgtacggggtaccgacggggtaccggaaggggtcgtagggacgggtttggggtacggtacgttaaggttttaattacgtacggtttaagtaagggtaaacgttaaaacgggaaaaaaccgttaaaaacgtacccgtaaacggaccgtaaacgtacccgtaccgggtaaggtaaacccgggtcccgttaaacgtttaccccaacccgttaaccgttaccccgttaaaccccccggtaaactaaaccccgttaaaaccgtttaaaccccgaaaaccggtaaaccttaacccgttttaacgttttttaaccggtttttaacccgtaacccgtttacggtacccgttaaacccgggtaaaacccgtccgggttacccggttaaacgggtaaaaacggtaacgggtttaacccggaaacccggttaaaccgggttcccgggtttaacgtttaaccgtttaaaccgttcccggttaacccgttaacggggttaccggggtaccgggtaccccggggaaaccggttaaacccgggtaaaccccgttaaaaacccgggtttaaaccccgtttaaaaaccccccggggtaacccccggggttaaaaacgggtaaccccgggtttaaccccggggggtaaccccgggtttaaaccccccggggtttaaaacccccggggg

SEQ ID NO: 49783 - DNA, 697 bp, Homo sapiens
  misc_feature: GYAE6OF01BSRWQ.49.5.A05.1.454.CMB.1.raw
  modified_base (601)..(601): a, c, t, g, unknown or other
  misc_feature (601)..(601): n is a, c, g, or t
  modified_base (671)..(671): a, c, t, g, unknown or other
  misc_feature (671)..(671): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcttgggtttttcctcgttgcttacttttaagaggtgtccagtgtcaggtgcagcgtggtggaggtcgggggaggcgtggtccagccgtgggactcccgtgacgtacctctccgtgtcgcacgcctcgtggtacttttacatttcgaagttagttatgctatcgcttagtttcggttcgccgtagggtccgaggacggtaaggggcgttagggaggttcggggtacggcgtaaggttacttacgtcggtaagtaggaaagttaacgggaaaactaaaaagtaccgtacggacgtaaggtaccctacgggtaaggaaccgggtcctaagttcccaagtaccgtaccctaccccgactaacctaacgtaccaaacgtaactacgtaatttcgtttacctagtacgtaacgtaacgaacctcgtacgtaggtaacgtagtacgaaaccgtacgtaaccggtnttacgtaaactcgtacctacgggtgtaccgggccgaggtaacggctaaacggtctaaccgaccggtaacncggtacggtccgggaacggtacccgg

SEQ ID NO: 49784 - DNA, 957 bp, Homo sapiens
  misc_feature: GYAE6OF01APRZT.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagagactcaccatggaggtttgggctgagtcgttgggttttcctcgttgcttcgttttaagaggtgtccagtgtcgaggtcgcgagcgtgggtgggagggtcgggggggaggtccggttcggtccgacggtccgttcggggtaccgttccccgtaggacggtacccttccgttccgtggtcgccgtacgtcccttcgttaggttaacttttaccgtattacgtaagtttagtttatcgtctaatcgtccgtacggtttcgggtttaccggccggtacggggtacccgaaggggaccggtaagggggcgttaggggtacgggtggggtagtacgttagtttagtacgttacggttagtaggtaaacggtaaaggaaaaaccgtaaaacgtaccgtaacggacgaacggtacccgttaccgggaaggtaaaccgggtacctaacgttacccgaacgttaccctacccggttaacccgaaacctaaccgtaaacccgttaaacccgaaacgttaaacccttaacgtttacgtttttaccggtttaaccctaacgttacccgtaacccgtaacggtaaaacccgtccgggttaaacccgggttaagaaacgggtaaaccgggtaccggtaaacccgggtaacccgttacccggggttaatttaaggtaaacctttaaccggttacccgttacgggtacgggtacccggggtacccgtaaacccgggtaaacgggtaacccttaaaaacccgggtttacgtttaaaaccccccgggaaacccggtaaacggggttaacccccggttacccgggggaaccgggggtaaacccccggtttaaacccgggg

SEQ ID NO: 49785 - DNA, 768 bp, Homo sapiens
  misc_feature: GYAE6OF01D9XLH.49.5.A05.1.454.CMB.1.raw
  modified_base (334)..(334): a, c, t, g, unknown or other
  misc_feature (334)..(334): n is a, c, g, or t
  modified_base (668)..(668): a, c, t, g, unknown or other
  misc_feature (668)..(668): n is a, c, g, or t
tcagagtcgagagacacgaccggtgctcgatttagatagatagacaggggtctgggagacgagcccagcactggaagtcgccggtgtttccattcggtgatcatcattgaacacagagactcaccagtggtagtttgggctgagtcgttgggttttcctcgttgtcttacgttttaagaggtgtcctagtgtcgaggtgctagtcgtgggtgggtagggtcggggggaggtcggtcggtcccgaggcccgtcgggaccgtccgtggacgtaccgttcctccgtgtcgcgtacgtccgttcgtaggtaactttactagttacgtagttagtttancgttacttacgtgtccgttacggtttcggtttccggacggtacgggtaccggagggtacggtaggggtcggtggggtaggtgggtacgtacgttaaggtttagtacgttacggtaagtaggtaaacggtaaacggtaaaaacgtaaaacgtcgtaaccgacgtaacggtacccggtacggtaggaaccggtaccgttactacccgaactactccccgtaacacgtaaacttacgtaaccgaaacgtacgtacctttattttccggttaactcctacgtaacctaacgaaccgtagtacggtacggaaactagggtacctaccggacttacggtntttacgaactcgtaccgtggtacgtcggaacggtcgaaacggacgtaaaccttacggaacccgacggtaacgttacgacgggcgggtaaccccgtaacgg

SEQ ID NO: 49786 - DNA, 726 bp, Homo sapiens
  misc_feature: GYAE6OF01BWMIQ.49.5.A05.1.454.CMB.1.raw
  modified_base (623)..(623): a, c, t, g, unknown or other
  misc_feature (623)..(623): n is a, c, g, or t
  modified_base (631)..(631): a, c, t, g, unknown or other
  misc_feature (631)..(631): n is a, c, g, or t
  modified_base (702)..(702): a, c, t, g, unknown or other
  misc_feature (702)..(702): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcttgggttttcctcgttgcttcttttaagaggtgtcctagtgtcaggtgcgagtcgtggtaggagggtcggggggagcggtggtccgagccgtcgggaccgtccgtggtactactctccgtgtcgcacgtcccgttagtaggttacttttacgacttacgtaagtttacggttatacggtccttagtcgtaccgttcgtttgggtttcccgaccggtacgggttaccgaacggggcggtaacggggtcgtgggtacggtggggttcgaagttagttaagtcgtacggtagtacgtaagtaacggtaaaactaaagtttaccgaacgacgtacgtaacgtccggtaggaaaccggtcgttaactccgataccgtccgtaaccaccgtaataacccggttaacaaagtacactttacgtttacgtttactacgtaggacctaagaccgacgttcgtaaggaacggtacgttacgaacccgtntaccggtnttaggtactagtcgtactaggtcgcggtaaccgacggtacctaacgttcgtaaacccgtacggacgttaancccgggttaaggacccgtaaccgg

SEQ ID NO: 49787 - DNA, 823 bp, Homo sapiens
  misc_feature: GYAE6OF01EGDLA.49.5.A05.1.454.CMB.1.raw
  modified_base (172)..(172): a, c, t, g, unknown or other
  misc_feature (172)..(172): n is a, c, g, or t
tcagagtcgagagacacgaccggtgctcgatttagatagatagacagggggtctgggagacgagcccagcactggaagtcgccggtgtttccattcggtgatcatcactgaacacagaggactcaccatggagtttgggctgagcttgggttttcctgttgcttctttaagnggtcgtccagtgtcaggtgcagcgtggtggaggtcgggggggagcggtggtccgaggccgtggggtaccgtcccgtgacgtacctctccgtgtcgcacgtcctgtggtatttacattcgtagttagttatggtacttaagtgaccttacggttcgggtttccggaccggtacggggggtaccccgaaggggtaccggtaaaaggggggtccgttgggggtaagggttgggggttacgggtaccgttaaggtttaatacggttacggttaagtggtaaaggtaaacgggtaaaaacggtaaaattaccggtaacgacgtaacggtaccgtaccgggtaacggaaacggggcctaacgtttaccaacccgttactaccccgtaccccgaagtaaacctaaaccgttacccaaaagtaacctaaccttaagtttttacggttaccttaaccgtcggtaaccttaacggaaccgtacggtaccgtaacgtaaaggaacggtacgggtaacccgaaccgtacgggtcttaacggtaatccgttaacgtacggtggtaccgggaccggaggtaacggtaaccaaaccgggttaccttaaacccggtaaacccgggaagtaccccggttaacgggtacggggaccccgtaaacccggg

SEQ ID NO: 49788 - DNA, 809 bp, Homo sapiens
  misc_feature: GYAE6OF01CAUGZ.49.5.A05.1.454.CMB.1.raw
  modified_base (738)..(738): a, c, t, g, unknown or other
  misc_feature (738)..(738): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggaggtttgggctgagtcgttgggttttcctcgttgcttcttttaaagaggtgtccagtgtcaggtgcagcgtgggtggaggtcggggggaggcgtggccaggccgtgggaccgtcccgtgacgacctctccgtgtcgcacgtccttcgtaggtactttaaccgtatttcgaaggttagttacgtgtacttagtgtacctacggtttcggtttcccgaccggtacggggtaccgaggggtacggtaacgggggtcgtaggggtacgggttggggtcgggtaacgttaaggttttaataacggttacggtttaagtacgggtaaacggtaaaacggggtaaaaaaaccgttaaaaacgttaccgttaaacggaaccgtaacggtacccggttaccgggtaacgggaaaccgggtaccctaacgttacccgaacccgtaacgttccccgtaaaccccgaactaaaacgtaaccgttaaaccgaaaacgtaacctacgttacgttttaccgtttactaaccgttgaacgttaacgaacgtacgtaccgtaagaacgtacggtacgtaccgaacgtcggtactagtactacgacgtacgtcggacgccggtaanacggaacctaacggtaccttaacccggaaccggttaggaacccgtcggtaccggggcccgtaaaacccggg

SEQ ID NO: 49789 - DNA, 771 bp, Homo sapiens
  misc_feature: GYAE6OF01AIL4R.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcttgggttttcctcgttgcttcttttaagaggtgtccagttgtcaggtgcagcgtgggtggagggtcggggggagcgtggtccagccgtgggaccgtcccgtgagactctcctgtgcgagcctgtaggtatttacattcagttattatgactatcgtctacgttcggtttccgaccgtagggtaccgagggtacggtaacgggggtctaggggtacggttggggtcgggtacgtaggtttaactagttaccggttagtacggaaaggtaaacgggtaaaaaacgtaaaactaaccgtacgaccgtaacggtacccgtaaccgggtaggaaaccgggtaccgttaacttacccgaaccgtaccgttacccgtaaccccgtaacgtaaaccttaaaccctaaccgaaacgtaaccgttaacttaccgttttacggtttaccctacgtacgtaacgtaacggtaaactaccgtaccgtaaggaacgtaacgggtaccgtaaccgaaccgtcgggtacctagttaactactacgtaggtggtaccgggacgacggaacggtacctaaacgtacttaacccggtaaccggaaaggtacccgttaaccgggtacgggtacccggtaaacccggg

SEQ ID NO: 49790 - DNA, 555 bp, Homo sapiens
  misc_feature: GYAE6OF01B4D93.49.5.A05.1.454.CMB.1.raw
  modified_base (158)..(158): a, c, t, g, unknown or other
  misc_feature (158)..(158): n is a, c, g, or t
  modified_base (178)..(178): a, c, t, g, unknown or other
  misc_feature (178)..(178): n is a, c, g, or t
  modified_base (180)..(180): a, c, t, g, unknown or other
  misc_feature (180)..(180): n is a, c, g, or t
  modified_base (183)..(183): a, c, t, g, unknown or other
  misc_feature (183)..(183): n is a, c, g, or t
  modified_base (206)..(206): a, c, t, g, unknown or other
  misc_feature (206)..(206): n is a, c, g, or t
  modified_base (210)..(210): a, c, t, g, unknown or other
  misc_feature (210)..(210): n is a, c, g, or t
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
  modified_base (236)..(236): a, c, t, g, unknown or other
  misc_feature (236)..(236): n is a, c, g, or t
  modified_base (245)..(245): a, c, t, g, unknown or other
  misc_feature (245)..(245): n is a, c, g, or t
  modified_base (247)..(248): a, c, t, g, unknown or other
  misc_feature (247)..(248): n is a, c, g, or t
  modified_base (281)..(281): a, c, t, g, unknown or other
  misc_feature (281)..(281): n is a, c, g, or t
tcagagtcgagagacacgaccggtgctcgatttagatagatagacagggtctgggagacgagcccagcactggaagtcgccggtgtttccattcggtgatcatcactgaacacagaggactcaccagtggagtttggctgagcggcgttgctagcgtntaagagtgcagtgcagtgcngntgngagcggagcgtagcagctggacncgtnagatcactgngcgngctgtgtatatntgtatagtntnntatgtgcgtcgtgtcgacgagagcgagtgaggngtgtagtagtagtagtagtacgtagtagtagtaagtaacgtaagtacgtacgtacgtacgacgtacgacgtacgtacgtactacgactacgtacgtacgtactactaactacgacgtacgagtacgttactagtactacgtacgacgacgacgtacgaagacgtacgtacgacgtacgtacgtacgtacgtacgtacgtacgtacgtacgtacggtacgtacgacgtacgacgtacgtacgtaaccgtacggtaacgtacgtacggtacgtacg

SEQ ID NO: 49791 - DNA, 851 bp, Homo sapiens
  misc_feature: GYAE6OF01BGADT.49.5.A05.1.454.CMB.1.raw
  modified_base (619)..(619): a, c, t, g, unknown or other
  misc_feature (619)..(619): n is a, c, g, or t
tcagagtcgagagacacgaccggtgctcgatttagatagatagacaggggtctgggagacgagcccagcactggaagtcgccggtgtttccattcggtgatcatcactgaacacagaggactcacatggagtttgggctggagcgttgggttttcctcgttgcttacttttaagaggtgtccagtgtcaggtgcagcgtggtggagggtcgggggagtcgtggtccaggtccgtgggactccgtagacgtacctccgtctgtcgctacgtcctacgtaggtactttacgattacgtagttagttatcgtctagtcgtacgtcggtttcggtaccggaccgtacgggtaccgaacgggcggtaacggggtccgttagggtagggttgggtacggtactaggtttaatacgttacggtaagtacggtaacggtaaaacgggtaaaaactaaaacgttccgtaacgacgtaacgtaccgttacgggtaacggggtaaccggtcccgttaacgttacccgaacccgtttacgtaccccccgtaaacccgtaagttaaaaccgttaacccaaaccggtaaaaacgtacccgtttaaacgttactttttcccgggttttaaaccnccggtaccgttaccgaaacgtaaccccggtacggtacccggttaaaggaacgggttacgtaacccggtaacgacccggttagtaacggttactttaacaccgttaccgtacgttacggggtaccggaccccgggtaagtaacccggaaccttaaaaccggtacccggttaaacgtaacccccggggaattaaccgggtaaacccggggtcgggtaaaccccgttaacccggg

SEQ ID NO: 49792 - DNA, 845 bp, Homo sapiens
  misc_feature: GYAE6OF01E1VCJ.49.5.A05.1.454.CMB.1.raw
  modified_base (677)..(677): a, c, t, g, unknown or other
  misc_feature (677)..(677): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggtagtttgggctgagtcgttgggtttttcctcgttgcttcttttaagaggtcgtccagtgtcaggtgcagcgtgggtggagggtcgggggggaggtcggtggtcccaggccgtcggggaccgttccccgtggacgtaccttcctccgtggtggccacggtcctcgtaggtactttactattcgagttagttagtcgtcttagtcgtaccttacggttcgggtttaccggccggtacgggggtaccgaggggaccgggtaaacgggggtcggttaggggtacgggttgggggttacggtccggttaaaggtttaacgttaggtacgttaaggtaggtaaacgttaaacggggaaaaaaacccttaaaaagtaaccggtaaaccggaacgtaaccggtaaacccgggtaccgggttaagggaaacggggtacccttaacgttacccaacccgtaccgttacccctaacccggtaaactaacccgtaaacttaacccgaaaagtaaccaacgtttagttttacgttacctaacgttcgaccgttacgaacncggtactaaggtaacggacgtcgaaaccggtacgacggtaccttaagttactaacgtccgtacggtgtaccgggacgaccggtaacgtaaccgaaaccggtttaaccgtaaaccccggtaaccgggaaacgttaaccggtcgggtaaccggggacccgggtaaacggg

SEQ ID NO: 49793 - DNA, 845 bp, Homo sapiens
  misc_feature: GYAE6OF01EIO60.49.5.A05.1.454.CMB.1.raw
  modified_base (144)..(144): a, c, t, g, unknown or other
  misc_feature (144)..(144): n is a, c, g, or t
  modified_base (158)..(158): a, c, t, g, unknown or other
  misc_feature (158)..(158): n is a, c, g, or t
  modified_base (174)..(174): a, c, t, g, unknown or other
  misc_feature (174)..(174): n is a, c, g, or t
  modified_base (194)..(194): a, c, t, g, unknown or other
  misc_feature (194)..(194): n is a, c, g, or t
tcagagtcgagagacacgaccggtgctcgatttagatagatagacagggtctgggagacgagcccagcactggaagtcgccggtgtttccattcggtgatcatcgactgaacacgagaggacctcacagtggtagtttggctgngtcgttggtttccngttgcttagtttaagnggtcgtccagtgtcgaggtncaggtcgttgggtgggacggggtcgggggagtccggttcggtaccgaggtcccgtcggggtacctccggtaggaaccgttcccgttctcccggttaggaccgaccggtcgttcccgttacgttaggttaacctttaacgtacgttcgtaaaaggtttcgttaacgtcgtcgttaacgttccggaccgtttaacgggtttcgggttcccggaaccggttaacggggtaccgacgggttaacgggaaccggggttcgtacggggtagggttccgggtacgttaacgttaagttagttaccgttacggtaagtaacggtaaacgtaaaacggtaaaaaacgtactaccggtaacgcggttaaacgccggttaccggaaacggtaccggtaccttaaccgtaacctacccgttaccgtaaccccgtaaccgtaagtaacccgttaaactaaccgtaaacgtaccgtttaacttacggtttactttaacgccgtttactaacggtaacgtaaccgtgtaaccgtcgggtaaataccggtaccgtaaccgacggtacgttaccgtagtaacccgtgtacgtcgtaccggtacgcgaacgttacgaaccgaagttaccccgtagtaacccggagttaccgacgggtcgaaccgtacgg

SEQ ID NO: 49794 - DNA, 829 bp, Homo sapiens
  misc_feature: GYAE6OF01BEL2L.49.5.A05.1.454.CMB.1.raw
  modified_base (99)..(99): a, c, t, g, unknown or other
  misc_feature (99)..(99): n is a, c, g, or t
  modified_base (174)..(174): a, c, t, g, unknown or other
  misc_feature (174)..(174): n is a, c, g, or t
  modified_base (178)..(178): a, c, t, g, unknown or other
  misc_feature (178)..(178): n is a, c, g, or t
  modified_base (192)..(192): a, c, t, g, unknown or other
  misc_feature (192)..(192): n is a, c, g, or t
  modified_base (749)..(749): a, c, t, g, unknown or other
  misc_feature (749)..(749): n is a, c, g, or t
tcagagtcgagagacacgaccggtgctcgatttagatagatagacaggggtctgggagacgagcccagcactggaagtcgccggtgtttccattcggtnatcatcactgaacacagaggacctcaccatggagtttgggctgagcttgggttttcctgttgcttcgttttaagnggtntccagtgtcaggtncagcgtgggtggagggtcggggggagcggtcggtcaggccgtcgggacgtccctagacgaccttctcgtgtgccagtcctcgtggttaactttactactttcgagtttattacgtgtcttagtcggtccttacggtttcgggtttcccggccggtacggggtacccgaaggggaccgggtaagggggtcggttaggggtacggggttgggggtacggtaccggttaaggtttaattacggtccggttaaggtacggtaaaggttaaacggggaaaaaacctaaaacgttacccggtaaccggaacgtaaaccgggttacccggttaaccgggtacgggaaaccggggttcctaacgtttaacccaacccgtcgtttaacccccgaccccgaaacctaaccgttaaacccttaaccgaaacggtaaacctaacggtttacttttccgtttaaccgctttacgggaccttaacgggacctacggtacctaagggtaacgttaacggacgggaacccgtacgtaggtaccttagtacgtacgtcctacggtcgggtacgngggtacccaaggttacaaccggttaaacttaccccggaacggttacggtaacccgtcggggccgggtacctaacccgggg

SEQ ID NO: 49795 - DNA, 690 bp, Homo sapiens
  misc_feature: GYAE6OF01DBSHI.49.5.A05.1.454.CMB.1.raw
  modified_base (101)..(101): a, c, t, g, unknown or other
  misc_feature (101)..(101): n is a, c, g, or t
  modified_base (142)..(142): a, c, t, g, unknown or other
  misc_feature (142)..(142): n is a, c, g, or t
  modified_base (188)..(188): a, c, t, g, unknown or other
  misc_feature (188)..(188): n is a, c, g, or t
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (228)..(228): a, c, t, g, unknown or other
  misc_feature (228)..(228): n is a, c, g, or t
  modified_base (246)..(246): a, c, t, g, unknown or other
  misc_feature (246)..(246): n is a, c, g, or t
  modified_base (317)..(317): a, c, t, g, unknown or other
  misc_feature (317)..(317): n is a, c, g, or t
  modified_base (476)..(476): a, c, t, g, unknown or other
  misc_feature (476)..(476): n is a, c, g, or t
  modified_base (523)..(523): a, c, t, g, unknown or other
  misc_feature (523)..(523): n is a, c, g, or t
tcagagtcgagagacacgaccggtgctcgatttagatagatagacaggggtctgggagacgagcccagcacgtggaagtcgccggttgtttccattcggtnatcatcactgaacacagagactcacagtggtagttggctgngtcgttcggtttcctgttgtcttgtttaaggagtgtcgagtgtcgnggtgcagtcgtgggtaggngggtcggggngcgtggtaccnggtccgtaggaccgtccngacgtctctcgtgcgcgtacgtcttcgtagttacttactagttagtaaggttagttactcgtactagttancgttacggtttccggtaccggccggtacggtacggaggaccggaggggtcgtaggggtacggttggggtatacgttaagttgtaacgttaggtaagttagaaaggtaaaacgaaaaactaagtacgtacgaacgtacgtacggtcgtagacggtacctntacccactccgtacaaccgtacaactactacaagtacctatacgttnttacgtatcgtacgtaacagcgtaagtaggagtaacggacgacgtacgtacgtattaacgtactctacggcggttacgaccggtacggtaactacggaacctaacgttaaccggtacccgtaacgggaacggttaccgaacccggggtccggaaacggttacccggg

SEQ ID NO: 49796 - DNA, 762 bp, Homo sapiens
  misc_feature: GYAE6OF01DCH8U.49.5.A05.1.454.CMB.1.raw
tcagagtcgagagacacgaccggtgctcgatttagatagatagacagggtctgggagacgagcccagcactggaagtcgccggtgtttccattcggtgatcatcactgaacacagaggactcaccatggagtttgggctgagcttgggttttcctcgttgtcttcttttaaggaggtgtccagtgtcaggtgcagcgtggtggaggtcggggggaggcgtggtccaggccgtgggacctccctgacgacctctcctgtgcgacgcctcgtggtaatttacattctaagttagttatgtctatgcctacgttcggtttccgccgaggtccagggacgaggggcgtgggaggtgggtacggctaaggttacttagtcgttagtagaagtaaacggaaaacgtaaaacgtacgtaacgacgtaacgtaccgtaccggtaggtaacgggtcccgtaagttccaacccgacgttcccctaacccggaaccaaaccgtaaaccttacccgaaaaagtaaccctaaccgtttatttaccggtttaccttacgtcgtaaccttacggaaaccctagggtacccgtaaggtaacggtaacggtacggtaacccgaacgtacccggttagtacgttaacgtaccgttaccgtaaacggttcgacgggtccggaaccggacggtaacccgtaaaacgttaaccgtttaaacccggtaacccgggaaacggttaaccggttaccggggtcccggggtaaaccccgtaaccgggg

SEQ ID NO: 49797 - DNA, 738 bp, Homo sapiens
  misc_feature: GYAE6OF01EF1JR.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagcgtggtgggaggtcggggggaggcgtggtccgacgccgtcgggaccgtcccgtgagtacctcctcctgtgccgacgccttcgtggtactttactattactagttagttatgtctatgtctacgttcggtttccgccggtacgggtccgagggacggaggggtcgtgggtaggtgggtggactagttatagtcgtagtacgtaagtaacggaaaactaaaagtactaacgacgacgtaccgtcggtacggaacgggtcccgtaatacccaaccgtcttaccccgaacccgtacaaacctaaccttaccgaaacgtaacctactttacgtttacgtttaccaacgttcgaccgttacgaaaccgtcggtacgtaaggaaggtaacggtaccgaaccgtaccggtaaccggtacttacgttaactaccgtaccgtacgttgggaccgggtaccggactaaccgggtaacggtaaaccctaacgtttaaaccccggacccgtaagggtaacccggttacggggtacccggggaaccgttaaccccggg

SEQ ID NO: 49798 - DNA, 659 bp, Homo sapiens
  misc_feature: GYAE6OF01EXBH0.49.5.A05.1.454.CMB.1.raw
  modified_base (169)..(169): a, c, t, g, unknown or other
  misc_feature (169)..(169): n is a, c, g, or t
  modified_base (172)..(172): a, c, t, g, unknown or other
  misc_feature (172)..(172): n is a, c, g, or t
  modified_base (175)..(175): a, c, t, g, unknown or other
  misc_feature (175)..(175): n is a, c, g, or t
  modified_base (207)..(207): a, c, t, g, unknown or other
  misc_feature (207)..(207): n is a, c, g, or t
  modified_base (573)..(573): a, c, t, g, unknown or other
  misc_feature (573)..(573): n is a, c, g, or t
tcagagtcgagagacacgaccggtgctcgatttagatagatagacaggggtctgggagacgagcccagcactggaagtcgccggttgtttccattcggtgatcatcactgaacacagaggactcacatggagtttgggctgagcgtggttttctgttgctacttttagngtntcngtgtcaggtgcagcgtggtggaggtcgggggngcgtgtccgagcccgtgggaccgttccgtagacgtacctctccgtgtcgacacgtccttgtaggttactttacgattacgaagttagttagtcgtaactctcgtaaccgtcggttacggtttccggaccggttacgggttacccgaggtaccggtaaggggtcgtaagggtcgggtacgggagtacgttaggttattacgtgttaacgtggaagttaacggaaaactaaaacgtcgtaacgacctaagacgtaccggtaggacggtactataccacgtacttaccacgtacaactaacgtacaacgataacttattcttacgactgtactacgaccatccgaagaacgtacgagtaccgagtccgntaagtcagacgttagcgtcggtcgacgtacggtaacccaagtaacccgtaaccgtaagtacggtacctgggccgtaacgtacccgg

SEQ ID NO: 49799 - DNA, 745 bp, Homo sapiens
  misc_feature: GYAE6OF01C0I3S.49.5.A05.1.454.CMB.1.raw
  modified_base (178)..(178): a, c, t, g, unknown or other
  misc_feature (178)..(178): n is a, c, g, or t
  modified_base (212)..(212): a, c, t, g, unknown or other
  misc_feature (212)..(212): n is a, c, g, or t
  modified_base (226)..(226): a, c, t, g, unknown or other
  misc_feature (226)..(226): n is a, c, g, or t
  modified_base (253)..(253): a, c, t, g, unknown or other
  misc_feature (253)..(253): n is a, c, g, or t
  modified_base (257)..(257): a, c, t, g, unknown or other
  misc_feature (257)..(257): n is a, c, g, or t
  modified_base (270)..(270): a, c, t, g, unknown or other
  misc_feature (270)..(270): n is a, c, g, or t
  modified_base (314)..(314): a, c, t, g, unknown or other
  misc_feature (314)..(314): n is a, c, g, or t
  modified_base (544)..(544): a, c, t, g, unknown or other
  misc_feature (544)..(544): n is a, c, g, or t
tcagagtcgagagacacgaccggtgctcgatttagatagatagacgagggtctgggagacgagcccagcactggaagtcgccggtgtttccattcggtgatcatcactgaacacagaggactcaccagtggagtttggctgagtcgttggttttcctcgttgcttacgttttaaaggnggttgtcctagtgtctaggtcgcgagtcgtgggnggagggtcgggggngtcgtcggtccagccgtggacctccgngacnctctaccgtgtcncagtccgtcgtaggttactttacattacgtaaggttacgttagngtactagtcggtctacgttcggttcgaccgtgggtaccacgggacgtagggtcgtagggtacggttgggactaggttaagttacgtagttcggtaaggtagtaaagggttaacgaaaaacgtaaaatccgtagaccgtaagtaacctcgggaaggtaaccgcctaatccgacttaccgaccgtaccgaactacgtaacttaaccgaacgtaactagttactttcgtaacncgtagacctagaacctacgacgtaggaaccgtaggtaaccgtacaaccggtcgtacgttagtaaccgttacgaccgtaaaccggttggacccggtacgaccggtaaaagacccgtttaaacccggtactaaaaccccccgggtaacccggtaaggttaccccggttaacccgggtaacggggaccccccttaaaaccgggg

SEQ ID NO: 49800 - DNA, 742 bp, Homo sapiens
  misc_feature: GYAE6OF01D8C08.49.5.A05.1.454.CMB.1.raw
tcagagtcgagagacacgaccggtgctcgatttagatagatagacagggtctgggagacgagcccagcactggaaaagtcgccggtgtttccattcggtgatcatcactgaacacagaggactcaccagtggagtttggctgagtcttgggttttcctgttgcttacgttttaaggagtcgtccagtgtcgaggtgacgagcgtgggtggagggtcggggggagtcgtggtccaggccgtcgggacctcctagacgtacctccgtcgtgtcgcacgtccttgtaggtacttttaccgagtttacgtaaggttagttatcgtacttagtcgtacgttaccgtttcggtttaccggaccggtacgggtaccgagggtaccggaaggggtcgtagggtacggttagggtcgtacgttagttaagtcgtacgtaagtagaagtaaacggaaaactaagtaccgtagacgtaagtaccgtacgaaggacgtaccgtactaccgaaccttacgtacccgtacccgaactaaccttaaacctaaccgaaagtaactaccgttagttttaccttaccgtactacgtaccgtaacgtaaccgattaccggaagtaaccggtaagaccggtaccgacgtacgttaccgtagttaactcgtaccgtacggtcggtcggaccgtacgacggtaaccgtaacgttaacgtacccggtaacgacggtaccgtaccgggtccggtaaccgtaccggg

SEQ ID NO: 49801 - DNA, 628 bp, Homo sapiens
  misc_feature: GYAE6OF01CMI90.49.5.A05.1.454.CMB.1.raw
  modified_base (376)..(376): a, c, t, g, unknown or other
  misc_feature (376)..(376): n is a, c, g, or t
  modified_base (411)..(411): a, c, t, g, unknown or other
  misc_feature (411)..(411): n is a, c, g, or t
  modified_base (497)..(497): a, c, t, g, unknown or other
  misc_feature (497)..(497): n is a, c, g, or t
  modified_base (502)..(502): a, c, t, g, unknown or other
  misc_feature (502)..(502): n is a, c, g, or t
  modified_base (507)..(507): a, c, t, g, unknown or other
  misc_feature (507)..(507): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcaggtgcagctggtgggaggtcgggggggaggcggtggtccaggcccgtgggacgtccccgtgacgacctcctcctggtcgcacgcctcgtaggaattttacatttacgagttagttatgctatcgctacgttgggtttccgccgtaggggtccagggcgaagggggctgggacgtgggtggctaggttanagtcgtagtgaagtaaggaaaacgaaaatcgacgngaagtacctccggagaacggcgtacttacaccgattcccgccccgaacaactaattaccaaagtaacactatttcgtttacacgtnacctnaaccncgtcgtagagaacgtcgaccgagacgtactagtatactcgacgtggtcgcggacgaggaccctaagtaaccgttaacccgaacggtaacgaccgttacgggcgggtaacccgtaacccggg

SEQ ID NO: 49802 - DNA, 725 bp, Homo sapiens
  misc_feature: GYAE6OF01AU372.49.5.A05.1.454.CMB.1.raw
  modified_base (591)..(591): a, c, t, g, unknown or other
  misc_feature (591)..(591): n is a, c, g, or t
  modified_base (624)..(624): a, c, t, g, unknown or other
  misc_feature (624)..(624): n is a, c, g, or t
  modified_base (629)..(629): a, c, t, g, unknown or other
  misc_feature (629)..(629): n is a, c, g, or t
tcagagtcgagagacacgaccggtgctcgatttagatagatagacgaggggtctgggagacgagcccagcactggaagtcgccggtgtttccattcggtgatcatcactgaacacagagactcaccagtggtagtttggctgagtcgttgggttttcctcgttgtactttacgttttaaaggaggttcgtaccgtagttgtcgaggtgacgagtcgtgggtggagggtcggggggagtccgtcggtccgagtccgtacgggtaccgttccctaggactaccgttccgtccgtaggtacgcgacgtcccgtttagttaggttaacttttacgtactttacgtaaggttacgtttagcgtactaagtcgtaccgttacggttcggtttccgaccgtaacggggtcccgaagggtaccggtaaggggtcgttaaggggtagggttacgggtaccgtaacgttaaggttttaagcggtttaacgtaagtacggtaaaagtaaacgggaaaaactaaagttcgaacgcgtaacgtacgtacggtagaacggtcctataccgactacgtccaaccgtaactaacgtaactaccgaanaacctgtttacgttcgttacactgaactgaaancgtanagaactagtcgacgacagtacttgacattcgaagttgacgtcgacgtagaacctacgtaaaccctcggaacgaacgactcgggaacggtcctaacg

SEQ ID NO: 49803 - DNA, 812 bp, Homo sapiens
  misc_feature: GYAE6OF01CQ24H.49.5.A05.1.454.CMB.1.raw
  modified_base (257)..(257): a, c, t, g, unknown or other
  misc_feature (257)..(257): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcttgggttttcctcgttgcttcttttaaagaggtgtccagtgtcaggtgcagctgggtggaggtcgggggagcgtggtccagccgtgggacgtccctgacgactctcctgtgcncgcctcgtggatttacattcagttagtatgctatcgctacgttggtttccgcgtacgggtccaggaccgtaagggggctaggggaaggttgggggagcgtaaggtttactagtcgtagtaggaagtaacgggtaaaaaacgtaaaaatccgttaaacggaccgtaaggaacccgttacggttaaggaacggggtcccgtaaatttaccaacccgttacttaccccgtaaccccgaactaaacctaaacctttaccgaaaacgtaaaaccctacgttaacttttacggtttaaccgttaacgtacgggtacctaacggtaaacctacgggcccgttaaagggaaccgtaaacggttaaccggaaccgtaaacggtacccggtagtttacgtaacttacggtaaccttaccgttaggggttacccgaacggggtaccgtaaaacgggggaccctaaaaaccggtttactttaaaacccccgggtaaccccggggaaaaaccggttaccggttaaaccccggggttgggggtaaacccccccggttaaaacccggggg

SEQ ID NO: 49804 - DNA, 833 bp, Homo sapiens
  misc_feature: GYAE6OF01A2B8N.49.5.A05.1.454.CMB.1.raw
  modified_base (142)..(142): a, c, t, g, unknown or other
  misc_feature (142)..(142): n is a, c, g, or t
  modified_base (271)..(271): a, c, t, g, unknown or other
  misc_feature (271)..(271): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgngtctgggttttcctcgttgcttcttttaagaggtgtccagtgtcgaggtgcgagcgtgggtgggagggtcggggggaggcggtggtccgaggccgtgggaccgttccgtgacgtacttctccgtggtcncgacgtcctctggtattttacattacgaagttagttatacgtacttagtcggactacgtttcgggtttccgccggtacgggtaccgacgggacggtaaacgggggccgttggggaacgggttggggtacgggtacgtaagtttaagtagtaccgttaagtacggtaaaggtaaacggaaaaacgtaaaacgtacgtaaccgacgtaacgtaccgttacggtaaggaaaccgggtcctaacttcccgaacctataccccgtacccgaacgaaacttaaaccgttaaccgaaaacgtaacctaagtttaaccgtttagttttaacccgttaacgttaccggtaactacggtaaaccgttaaccgtacgtaaaccggtaaggttaaaccgggtagggtaaacccctacgggtaacccggttaggttaaccgttaaacgttctaccgtacgggtggtaacccgggccggtagaaacgggtaacccaacggttaaacttaccccggtaaacccgggttaaggtaaaccccggttaccgggtccggggtaaacccggttaacccgggg

SEQ ID NO: 49805 - DNA, 817 bp, Homo sapiens
  misc_feature: GYAE6OF01C2B1R.49.5.A05.1.454.CMB.1.raw
  modified_base (186)..(186): a, c, t, g, unknown or other
  misc_feature (186)..(186): n is a, c, g, or t
  modified_base (705)..(705): a, c, t, g, unknown or other
  misc_feature (705)..(705): n is a, c, g, or t
tcagagtcgagagacacgaccggtgctcgatttagatagatagacaggggtctgggagacgagcccagcacgtggaagtcgccggttgtttccattcggtgatcatcactgaacacagaggactcaccatggtaggtttgggctgagtcgttcgggtttttcctcgttgtccttacttttaaaggnggtgtccagtgtcagggtgcaggtcggtggggtagggacggggtcgggggggaggtccggttcggtacccgacgggtcccgttacggggtcccgttccccgtaggaacggtacccttcctccgtggtcggcctaccgtccttacggtaggttaacttttacctaggtttaccgtaaggtttaagtttagtcggtacttaagtcggttaccgttacggtttcgggtttaccgtaccgtacggggtacccgaggggaccgggtaacggggtcggtaggggtagggttcggggtacggtacgtaagtttaacggtcttaggtaagtaagggaagttaaaacggaaaaccttaaaagtacgaacgcgtaaccgtcgtaccgggaaggacggttcctaacgtccaacgtcctaccctaaccgacaaacttaactaaccgaataaccctgttaacctttcgtaccttacgtcgactaacgtaaccgagacgtaagaacggtaacgagtacccgaagtccgtagtnttaaactctacgaggtcgagggacccgaggtaaacgtaaccccgtaaagttacccggtaacccgaaaccggtacggttccccggaagggtacccggtaccggttaaaccggg

SEQ ID NO: 49806 - DNA, 866 bp, Homo sapiens
  misc_feature: GYAE6OF01DHIWS.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagagactcacatggagttgggctgagtcttcgggtttttccctcgttgtcttacgttttaaggaggtcgtcctagtgtcaggtgcagcgtgggtgggacgggtcggggggagcggtcggtccaggtcccgtggggtaccgtcccgtggaccgtaccttccgtccgtggtcgcctacgtccttcgtaggttaacttttacactttacgtaaggtttacgtttatgtcttagtcgtaccgttacggtttcgggtttccgacccgggtacgggggtacccgacggggacgggtaagggggtcgtaggggtaggggttcgggggtacggtacgttaagggtttaacttacggttaaggttagttaagggtaaacggtaaaaccggggtaaaaaacttaaaaacctacgtaaccggaacctaacggtacccgtttaccgggaagggtaaacgggtaccctaacttaccccgaaccttaccctaccccgtaaccccgtaactaaaccctaacgttaacccgaaaaccgtacgttaaccctttaagttttcgtttaacctaccgtagtaccgttaacgaacccgttgtaaccggtaaaggtaacggtaacggtaccgtaaccggtaccgtacgttcttagttactaccgttcgacccgttaggccgggaccgtacggaacgttaccgaaaccgtaccttaacccgggaacccggttaacggacccggtttaacggggcccgggttaacgtaaccccggg

SEQ ID NO: 49807 - DNA, 872 bp, Homo sapiens
  misc_feature: GYAE6OF01BPZ6W.49.5.A05.1.454.CMB.1.raw
  modified_base (188)..(188): a, c, t, g, unknown or other
  misc_feature (188)..(188): n is a, c, g, or t
  modified_base (264)..(264): a, c, t, g, unknown or other
  misc_feature (264)..(264): n is a, c, g, or t
  modified_base (757)..(757): a, c, t, g, unknown or other
  misc_feature (757)..(757): n is a, c, g, or t
  modified_base (772)..(772): a, c, t, g, unknown or other
  misc_feature (772)..(772): n is a, c, g, or t
tcagagtcgagagacacgaccggtgctcgatttagatagatagacaggggtctgggagacgagcccagcactggaagtcgccggttgtttccattcggtgatcatcactgaacacagaggactcaccagtggtaggtttgggctggagtcgttcgggtttttcctcgtttcgtcttacgttttaaggnggttcgtcctaggttgtacgaggtcgctaggtcgttgggtgggacggggtcgggggggaggccggttcgggtaccngggtcccggtggggtaccttcccgaggtacgtccttcgttccgtggtacgccgtacgtcccgttagttggttaacttttaccgtactttaccggtaagtttacgtttacgtagtccgtagttcggttaccggtaccgttttcgggttccgaccggttacgggttacccggaacgggtacgggtaacgggggtccgttacggggtggggtttacgggacggtacgttaagttttaacggtagttacggtaagtaggtaaacgttaaaggggtaaaaacctaaacggtaccgtaggtacccgtaacggtacggtaaccgggtacggttaaacggccctttaacgtccctaaccgtaccgttacccacccgtaactactaaaccttaacaaccgtaaccttagtttacttcggtttaccacgtttaccaacgttagaaccgtgtaaccggtaagtaaccgtacggacgaaccgtcgacggtttacagtttaaccgntacggtttaaccggngtacccgtggaccggttaacgacccgaaacgtttaaacccggcccggttaaaacgggtacggtaacccgtcgggggtaaaccgttacccggggttaaccg

SEQ ID NO: 49808 - DNA, 730 bp, Homo sapiens
  misc_feature: GYAE6OF01BN02Y.49.5.A05.1.454.CMB.1.raw
  modified_base (580)..(580): a, c, t, g, unknown or other
  misc_feature (580)..(580): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagttgggctgagcgtgggtttcctgttgcttctttaagagtgtccgagtgtcaggtgcagcgtggtggaggtcggggagcgtggtccagccgtgggacctccgtagacgtacctctccgtgtcgccgacgtccgtacgtggtaacttttacctagttaccaaggtttagttaacgtgtacgtaacgtcgtaccgttacggtttcggtttccccggaccggtaaccgggggttacccaagggggtaccggaaacgggggtccgtagggtagggtcggggttacgacgttaagttacgtacgtacgttagaggtaacgttaaacgggaaaaactaaacgtaccgtaacgacgtacgtaccgtacggtagacggtctactactacgacctcccgaccgaatactaacgtacaaacgtactatactttacgttcacgttacctataagtaccgngtacgagaacggtacgtagaacccggtactcgggtactttagaaccgttcaccggtattcggtaccgggagtacccggaaggtacccgtaccgttaacgtaaacccggtacggtaacgtaccggtccggtaacgggccccgtaaaccggg

SEQ ID NO: 49809 - DNA, 830 bp, Homo sapiens
  misc_feature: GYAE6OF01BTJZB.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttggctgagctcgggttttcctcgttgcttcgttttaagaggtgtccagttgtcgaggtgcagctgggtggaggtcggggggaggcgtggtccgagccgtgggaccgtccctggagtaccttctcccgttggtcgccgtacgtcccgttcgtggtaacttttaacattctaagttacgttatgacttatcgtctacgtttcggtttccgccggtacggtccgagggaccggaggggtcgtagggtacgggtgggtggtacgtagtttaagtacgtcggtattaggtaaacgtaaaacgggtaaaaaacgtaaaaactttaacctaacgggacaaacccggtaacccgtttacccgggtaaggggaaaacccggggtccttaacggttccctaaaccctacgttacccctaaccccgtaaacccgaaaacctaaacccgtttaaacccgaaacgtaaaccttaaccgttaaccgtttttacgttttaaccgtaccttacgtaccgtaagaaccgtacgtcgtaagaagtaacggtacgaaccggtagtacccgtagtgttaacacgttaccgacggttcggtaggaccggtaccaaccgggtaaacggttaaaccccttaaccgttaaaacccgtaacccggggtaaaacgtaccggttaaacccggggcccggggtaaacccgttaaaacccggggg

SEQ ID NO: 49810 - DNA, 794 bp, Homo sapiens
  misc_feature: GYAE6OF01BKFE4.49.5.A05.1.454.CMB.1.raw
tcagagtcgagagacacgaccggtgctcgatttagatagatagacagggtctgggagacgagcccagcactggaagtcgccggtgtttccattcggtgatcatcactgaacacagaggactcaccatggagtttgggctgagcttgggttttcctcgttgcttacttttaagaggtgtccagtgtcaggtgctagctgggtggagggtcggggggagtcggtggtccagccgtgggaccgtccctgagacctctcctgtgcagtcctcgtgtactttacattcagttagttatgtctatcgctacgttcggtttccgccgtacgggttcccgagggtaccgaaaggggtccgtagggtagggttggggtggacgtaggtttatagttacgtagtggtaacgtaaggtaaaaacgtaaaagtaccgtaacgtacgacgaacgttacccggaggaaacgggccgtacttacctaaccgaccttacccgtacccggaacctaacctaaacgttaacccaaagtaaacccttaacgttagtttttaccgttttaaccgtaccgttacggtaaccgttacgaaaccgtaccggtaccgtaagggtaacggtaaacggttaccgaaaccgggtacgaaccccgggttagtttacccggttaattaccgttacgtaacggtcgggtcggtacccggggcctaaacggggtacctaaaaccccgggtatttaaacccccgggtaaacccgggtaaaccgggtacccgttaccggggtccggggtaacccggtaaccccgggg

SEQ ID NO: 49811 - DNA, 772 bp, Homo sapiens
  misc_feature: GYAE6OF01BGOEO.49.5.A05.1.454.CMB.1.raw
  modified_base (502)..(502): a, c, t, g, unknown or other
  misc_feature (502)..(502): n is a, c, g, or t
  modified_base (684)..(684): a, c, t, g, unknown or other
  misc_feature (684)..(684): n is a, c, g, or t
tcagagtcgagagacacgaccggtgctcgatttagatagatagacagggggtctgggagacgagcccagcactggaagtcgccggtgtttccattcggtgatcatcactgaacacagaggactcaccatggagtttgggctgagctgggttttcctcgttgcttcttttaagaggtgtccagtgtcgaggtgcagcgtggtggaggtcggggggagcgtggtccagccgtgggcgtcctgacgacctctcctgtgcagcctcgtggtatttcgattccgagttagttatgctatgctacgttcggtttccgcgtacggggtccaaggtcggaacgggggtctaggggtacggtcggggtaggacgtaagtttatacgttcgtaagtaggtaacgtaaagggtaaaaacctaaaagtaccgtaacgtcgaacggtacccgttaccgggtaaggtaacggggtacccttaaggtacccaaccgtacttcccgaaccccggtaanaacccgtaaactttacccgaaacgtaacctaacgtttaacgttttcgttttaacccgcgtttacggtacctttaaccgaaccggtaccgttacccggtaggtaaaccggtaaacgttcggaaaccggtaccgtagtacccggttagtaacctacgttacgtacgttcggtccggaccgggtnaaccggggaactaaccggttaaccgtttaacccgtaaacccgggacgtaacccggttcgggtacccggggtaaccccttaaccggggg

SEQ ID NO: 49812 - DNA, 692 bp, Homo sapiens
  misc_feature: GYAE6OF01DAGE4.49.5.A05.1.454.CMB.1.raw
  modified_base (319)..(319): a, c, t, g, unknown or other
  misc_feature (319)..(319): n is a, c, g, or t
  modified_base (421)..(421): a, c, t, g, unknown or other
  misc_feature (421)..(421): n is a, c, g, or t
  modified_base (596)..(596): a, c, t, g, unknown or other
  misc_feature (596)..(596): n is a, c, g, or t
tcagagtcgagagacacgaccggtgctcgatttagatagatagacagggtctgggagacgagcccagcactggaagtcgccggtgtttccagttcggtgatcatcactgaacacagaggactcacagtggagtttgggctgagtcgttgggttttcctcgttgcttacgttttaaggaggttcgtcctagtgtcgaggtgcgagtcgtgggtggacgggtcgggggagtcggtgggtaccaggccgtgggaccgtccgtggacgtctcgtccgtgcgcacgtcctcgtaggtaactttcagttcgtaggttagtttagngtacctagtcgtaccgttacgttgggtttccgacccggttacggaccgaagggtcgaaaggggttctagggtaggtcgggtagtcgtaagttctagtcgtanaggaacgtaaagggaaaaacaaacgttcgacgagtacgaaccgtcggtaggaaccgtccggtaattccaaccgtccgtacctaaccacgaaacgttacctaacgaaagtaccaagtttagttcgttacgacgtcactaacgaacaggtacctaggacgtaggtacgaacgtaccncggttatacgtattaaccgcgtaagttcggtacgcggtagtacggacttaacgtactaacccgtacggaactagggtccgtacgggacccgttacg

SEQ ID NO: 49813 - DNA, 768 bp, Homo sapiens
  misc_feature: GYAE6OF01BA8PC.49.5.A05.1.454.CMB.1.raw
  modified_base (268)..(268): a, c, t, g, unknown or other
  misc_feature (268)..(268): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggagcgtggtccagccgtgggactcctgacgactcctctgtgcagcctgtggtatttacnttcagttacgttatgtactatcgtcacgttgggttttcgaccgtagggttcccagggccgtaagggggtccttgggacggttgggggtggaccgtaaggtttatacgtacggttaatggtaacgtaacggggtaaaaaacgtaaaactaccgttaacggacgtaacggtaaccgtccggtaaggggaaccggggcccgtacttacccaaccgtaccgtccgtaccccgtaacctaacgtaaacttacccgaaacgaaacctacctagttttaccgtttaccgtaacctggtacctacggtaaaccgcgtacccgtaggaacgtaacggtcggaaccgtaccgtaacggtcgttacggttaaacttctacccgtaaacgttcgggtaccggaccgggtacgaacgggtacccgtaaacccgtaaccgttttaaccccggtaaacccggggtaaacggtaccggttaaccgggtccggggggtaacccgtaaacccccgggg

SEQ ID NO: 49814 - DNA, 792 bp, Homo sapiens
  misc_feature: GYAE6OF01B4ZGL.49.5.A05.1.454.CMB.1.raw
  modified_base (655)..(655): a, c, t, g, unknown or other
  misc_feature (655)..(655): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggtagtttgggctgagcgttgggttttcctcgttgtcttacttttaaggaggtcgtcctaggtgtcgaggtgcagcgtgggtgggacgggtcggggggaggcggttcgggtccacggtccgtggggtaccgttcccgtaggacgtaccttccgtccgttggtcgcacggtcccgttcgtacggttactttaactactttacgagtttaagttactcgtcttacgtgtacctacgttcggtttccggaccggtacgggtccgagggacggtacggggtcgtagggaggggtcgggtaggacgttaagttagtagtacgtagtagtaaagtaaacggggtaaaaacgtaaagtaccgtaacggactaacggtaacccgtcgggtaaggaaccgggtaccgtaactacccgaccctagtccccgtaccgaacctaacctaaacgttaaccaaacgtactaccgttaatttcgttactactcgactacgaactcgtacgtagtagaccggtaggaacccgtagaccggttnttacgggttactacgttaccgtacggtcggtacggacgggtaccgaacggtaccgtaaccgttaacccgtaaaccccggtaacccgggtaacggttaacccggtaaccggggtccgggaacccgggttaaacccggg

SEQ ID NO: 49815 - DNA, 848 bp, Homo sapiens
  misc_feature: GYAE6OF01BN25D.49.5.A05.1.454.CMB.1.raw
  modified_base (772)..(772): a, c, t, g, unknown or other
  misc_feature (772)..(772): n is a, c, g, or t
tcagagtcgagagacacgaccggtgctcgatttagatagatagacagggtctgggagacgagcccagcactggaagtcgccggtgtttccattcggtgatcatcactgaacacagaggactcaccatggtaggtttgggctgagcgttcgggttttccttcggttgtcttacgtttttaaaggaggttcgtccgtaggtgtaccgagggtgcgaggcgttgggtagggaggggtccgggggggaggtccggtgggttccacggcccggttcggggtacccgttcccgtggaaccgtccgttccgtcccgttggtcgaccaggtccctacgttcggttaattttactacgttacgtaagttacgttagtcgtacttagtcgtccgttacgttcgggtttccggccggtagggtaccgtacgggacggtaagggggtcggttaggggtacgggttggggtacgggtacgttaaggtttacgttacggtacggttaagtaccggtaaagtaaaacgggtaaaaaaccgtaaaacgttaacgtaaccggtacgtaacgtaccggtaccggtaagggaacggttaccgttacgtacccgtaactaccgttaccctaaccccgtaactaaacgttaacctaacgaaaacgtacctaaccgtttaagtttaccctttagtaccgtacgttaccgtaacgtaacgtacgtccgtaagaacgggtacgtaccgggaaccgtaacgtaccgtcttaagtacgtacgtccgtacgtgggtacnccggaggaaccgtacgaaaccgttacgtaacccggtaacggaacgtaccggtacggtccgggtaccgtaacccggg

SEQ ID NO: 49816 - DNA, 880 bp, Homo sapiens
  misc_feature: GYAE6OF01ECXMD.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagtcgttgggttttcctcgttgcttactttaagaggtcgtccagtgtcgaggtgcagcgtgggtgggagggtcggggggaggcggtcggtccgacggtccgtggggaccgttccctaggacgtacctctccgtgtcgcagtccgtgtaggtactttaactattactaagttagttagtcgtacgtagtcgtccgtacgttcggtttccgccgtaacgggtccgaggtcggaaggggtcgtaggggtagggttgggtcggtacgttaaggttacgttagttacgtaagtagtaaacggtaaaggtaaaaaacgtaaacgtaacgtaaccgacgtaaccgtaccggttaccgggtaaggaaccgggtacccgttaacgttaccaaccgtacccgttacccgtaaccccgtaactaaaccgttaacctaaaccggaaacttaaccggtaactttacggttttaaccgtttaccgtaacgttaccggtaaccgttaacgaaccgtaccggtaaccggtaggtaaaaccggtacggtaacccgtaaccggtaaccggtaccgtacgtttaaggtactttaaaccggtacgttaaccggtcgggttaacccggcgggtaaccggaaccggttaaacccggtaaaaccggtttaaccccgttaaaaccccgggtaaaccccgggttaaaaccggaaacccgggtttaccgggggtaaacccggggacccggtttaaaaccccgggg

SEQ ID NO: 49817 - DNA, 704 bp, Homo sapiens
  misc_feature: GYAE6OF01CYG8Z.49.5.A05.1.454.CMB.1.raw
  modified_base (554)..(554): a, c, t, g, unknown or other
  misc_feature (554)..(554): n is a, c, g, or t
tcagagtcgagagacacgaccggtgctcgatttagatagatagacaggggtctgggagacgagcccagcactggaagtcgcccggtgtttccattcggtgatcatcactgaacacagaggactcaccatggagtttgggctgagctgggttttcctcgttgcttctttaagaggtgtccagtgtcaggtgcagctgggtggaggtcgggggggaggcgtggtcccaggcctggggaccgtcccgtgacgacctctcctgtcgcagccctgtcggatttaccattccgagttattatgtctagtgacctacgttcggtttccgcgtacgggtccgaggacggaacgggggtctggggaacggttgggggtcggactaggtttaatacgtacgttagtagaaagttaaacggaaaaacgtaaaaagttaccaacggacctaacggaccttaccgaggaacggtcctattaccacgtactccgaccccgtaataactaaccttaccgaaacgtaaactcgttaactttcgttaccctaagtcgtactacggtaaccncggtacctaacggaaggtaaacggttcgaaccggtaccgtacggtaccttggttaactacgtcgtacgtggaccgtcggaccaggacctaaacggtaccttaacgtaaccccggaaggtaccgttacgggcccgggtacctaacccgggg

SEQ ID NO: 49818 - DNA, 642 bp, Homo sapiens
  misc_feature: GYAE6OF01A3E9I.49.5.A05.1.454.CMB.1.raw
  modified_base (171)..(171): a, c, t, g, unknown or other
  misc_feature (171)..(171): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctagggttttcctgttgcttctttaagnggtgtccagtgtcaggtgcagcgtggtggaggtcgggggagtcgtgtccagcctgggactcctgagactctccgtgtgctagcctcgtggtatttccattccagttagttatgctagtcgcctacgttggtttcgcgtacgggtaccaggcgaacggggctgggtagtgggtgtccgtagttagtagtcgtatacgtacgtaaggaaaactaaaagtacgttaacgcgaacgtaccgtacggtaggtaacggggtcctacgtaccgacgacgttacccgtacccgactaaccgtaacttaccgaacgtaacgtactacgtttacgttcctacgtcgtacgtacgtaacgtaccgtacgtacgaagtaacggcgtaacgacgacggtacgtacgtacgttactcgactcgtcgcgtaccgaggtaccgaactcgttaccgaacgacggtactacggttcggccggtaaccgg

SEQ ID NO: 49819 - DNA, 883 bp, Homo sapiens
  misc_feature: GYAE6OF01CSVP3.49.5.A05.1.454.CMB.1.raw
  modified_base (173)..(173): a, c, t, g, unknown or other
  misc_feature (173)..(173): n is a, c, g, or t
  modified_base (303)..(303): a, c, t, g, unknown or other
  misc_feature (303)..(303): n is a, c, g, or t
tcagagtcgagagacacgaccggtgctcgatttagatagatagacagggggtctgggagacgagcccagcactggaagtcgccggtgtttccattcggtgatcatcactgaacacagaggactcaccatggagtttgggctgagctgggttttcctgttgcttcgttttaagnggtgtccagtgtcaggtgcagcgtggtgggagggtcggggggagtcgtcggtccaggccgtgggtaccctccgtgacgtaccttcttaccgtggcgcgtaccgtccttacggttaggtaacttttaaccntttaaccgtagtttaaggtttactacggacttagtcgtacctaacggtttccggggtttaccgacccggtaacggggttacccagggaccgggtaacggggggtacgttgggggaagggtttcggggtacgggtaccttaagggttacgttaacgtttccggttaaagtacgggtaaacggtaaaacggggttaaaaaccttaaaaaacggttccgtaaccgtaacgtaaccggtacccgttaaaccggggttacgggaaacgggtttaccctactttacccgaaaccgtttacccggtaccctaaccccggtaaactaacccgttaaacgtttaaccccggaaaagtaaccccttaacggtttacgttttcgtttaaaccccgttgttaccggtaacctaaacggtaacgaccgttacgtaagggaacgtaccgggtacgaaccgaccggtagttccgtaacgttactacttacgacgttcgggacggtacccggtagaaaccgtacggtaaccttaacgggtttacccaaaccggggtaacttaccggaccgggtacggggtacccttaaacccgggg

SEQ ID NO: 49820 - DNA, 814 bp, Homo sapiens
  misc_feature: GYAE6OF01CPCOB.49.5.A05.1.454.CMB.1.raw
  modified_base (184)..(184): a, c, t, g, unknown or other
  misc_feature (184)..(184): n is a, c, g, or t
  modified_base (478)..(478): a, c, t, g, unknown or other
  misc_feature (478)..(478): n is a, c, g, or t
  modified_base (607)..(607): a, c, t, g, unknown or other
  misc_feature (607)..(607): n is a, c, g, or t
  modified_base (627)..(627): a, c, t, g, unknown or other
  misc_feature (627)..(627): n is a, c, g, or t
  modified_base (687)..(687): a, c, t, g, unknown or other
  misc_feature (687)..(687): n is a, c, g, or t
  modified_base (695)..(695): a, c, t, g, unknown or other
  misc_feature (695)..(695): n is a, c, g, or t
  modified_base (781)..(781): a, c, t, g, unknown or other
  misc_feature (781)..(781): n is a, c, g, or t
tcagagtcgagagacacgaccggtgctcgatttagatagatagacaggggtctgggagacgagcccagcacgtggaagtcgccggtgtttccattcggtgatcatcactgaacacagaggactcaccatggaggtttgggctgagtcgttgggttttccctcgttgtacttacgttttaaaggnggtcgtccgtagtgtcgaggtcgacgagtcgtgggtagggtaggggtccgggggggaggtccggttggtacccgaacggcccggtacggggtacccgtcccgttaggaacgtccttccgtccgtggtcggccacgtcctacgttaaggttaactttactacgttaacgtagttaacgttagtcgtacttagtcggaccgttacggtttcggggttcccgaccggttacggggtaccgagggtaaccgggagggggtacgtaggggtcgggttggggacgtagtagttttaacgngttacggtagtaaggtaacgtaaaacgggaaaaaactaaactccgtacgacgtaaccggtccgtaacggtaggaaccggtcctaacgttccacccttacgtacccaccgaactaacaactaaccgaaanactacctttgtccgtttacncgcgtaactacggaaccctgtaccgtgaaaggtaccgaccggacctaacggtactaggtnttaaaccngttaaggccgtagggaccggtcccgggaataaccggtaaactacccgggtaaacccttaacccgggaacgggaaacccggtttacncccggggggtaaccggtaacccgggtttacccg

SEQ ID NO: 49821 - DNA, 965 bp, Homo sapiens
  misc_feature: GYAE6OF01A1ZKT.49.5.A05.1.454.CMB.1.raw
tcagagtcgagagacacgaccggtgctcgatttagatagatagacaggggtctgggagacgagcccagcaatggaagtcgccggtgtttccattcggtgatcatcactgaacacagaggactcaccagtggtagtttgggctgagtcttgggttttcctcgtttgcttacttttaaggaggttcgtacctaggttgtacgagggtgcgagtcgtgggtgggaggggtcggggggaggtcggtcggtccaggtcccggtggggtaccgttcccgtggaacgtacccttccgttccgtggtcgccgtacgtccttgttaggtaactttactacttacgtaaggttacgttatcgtactatccgtacgtttaccggtttacggtttccggcccggttaacggggtacccgacggggaacgggtaaccgggggtcggttaggggtaagggttcggggtacggttacgttaaggtttaggttacgttacggtaaggtacgtaaaggttaaaacgggaaaaacgttaaaaccttacggtaccgtaacgtaacggtacccggttaccgggtaacggaaccgggtaccgtaacttacccgtaacctacccgttaaccccgtaccaacccgtaaacgttaaacccgttaaaccgaaaacggtaaaccttacggtttaactttacgttttaaccccgagttaacccgtacgttaacggtaaccgtaccggtttacggtaaaggtaaccggttaacgggtacccggaaaccgggttacccggtaaccgttaaaggtttccgttaaaaccggttaaccgtccgggttaaacggtcgggttaacccgggtaacggaaccggttaacccggggaaccccttaaaaaccggtttcccggggttaaaaccccgtacggggaaaacccggtttacggggaccccggggttacggggggttaaaaccccgttaaaccccgggg

SEQ ID NO: 49822 - DNA, 768 bp, Homo sapiens
  misc_feature: GYAE6OF01CG179.49.5.A05.1.454.CMB.1.raw
  modified_base (140)..(140): a, c, t, g, unknown or other
  misc_feature (140)..(140): n is a, c, g, or t
  modified_base (177)..(177): a, c, t, g, unknown or other
  misc_feature (177)..(177): n is a, c, g, or t
tcagagtcgagagacacgaccggtgctcgatttagatagatagacaggggtctgggagacgagcccagcactggaagtcgccggtgtttccattcggtgatcatcactgaacacagagactcaccagtggaggtttgggntgagtcttgggttttcctcgttgtacttattttaagnggtgtacctagtgtacaggtgcagcgtgggtacggagggtcgggggagcggtacggtccgaggccgtcggggtaccgtcccaggtaacgccttccgtccgtgtacgcgagtcctaggttagtaattttacaagtttacgaagtttacgtagtacgtattaggtcaacgttcgaccgggttttccgaccggtacggtccgaaaggccggttaaagggcgtacgggtaggtggggacgtagttaagttaactagttacggttaaagagtaacggtaaaaggaaaaacgtaaaaatccgtacgaacgtacgaccgtacggtaagaaccggtactaacttacccgacttacctacaaccccgtaataaacccaagtaacccgaataacacgtactttcgtaactgagtcgtaacggaactaccgtacgataaacgtacgaacggtacgaacccgtaggttacagtttaaaccggctatacccgggtgtacccgaacggggaacttacggaaaacccgaaagttaaaccccggttaaaacggaccccggttaaaaacggcccgtaaacggggttacccgggaaacgttaacccggg

SEQ ID NO: 49823 - DNA, 823 bp, Homo sapiens
  misc_feature: GYAE6OF01CA0P3.49.5.A05.1.454.CMB.1.raw
  modified_base (185)..(185): a, c, t, g, unknown or other
  misc_feature (185)..(185): n is a, c, g, or t
  modified_base (337)..(337): a, c, t, g, unknown or other
  misc_feature (337)..(337): n is a, c, g, or t
  modified_base (730)..(730): a, c, t, g, unknown or other
  misc_feature (730)..(730): n is a, c, g, or t
tcagagtcgagagacacgaccggtgctcgatttagatagatagacaggggtctggggagacgagcccagcactggaagtcgccggtgtttccattcggtgatcatcactgaacacagaggactcacagtggtagtttgggctgagtcgttgggtttttcctcgttcgactttacgttttaaaggnggttgtccgagttggtcgaggtgcgagtcgtgggtgggagggtcgggggagtcggttcggaccgaggtccgtacgggaccttccgtagacgtaccttctccgtggtacgctacgtccttcgtaggttaactttacagttacgagttagttancgtattagtcggtactacggttcggtttacccggaccggtacgggtcgaacggggtaccggtaaggggtccgtaagggggtcggtacggggtacggtacgttaacgtttaagtacgttaccgggttgtaacggtaaaggtaaaccgggaaaaaaacgtaaacgtaccggtacgacgtaacgtaccgttaacggtaacggaacggtcccgtaacgttacccgaaccgttacgtaccccgttaccgaaactaccgttaaacgttacgaaaacgttaccttagtttacgtttcgtttaacgtacctagtacgttaacgaacgtacgttaacgtaagggaagtaacccgggtcgtaaacgaccggttcgaacgtttagtaacgtaccgagttacggngttaaccggcgaacggaaccggtaacttacccgttaaacgtaaaccccgtaggtaaccgtacgttaaccggggtccggaaacgtttacccggg

SEQ ID NO: 49824 - DNA, 753 bp, Homo sapiens
  misc_feature: GYAE6OF01AT3A4.49.5.A05.1.454.CMB.1.raw
  modified_base (299)..(299): a, c, t, g, unknown or other
  misc_feature (299)..(299): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggaggtttgggctgagcttggggttttcctcgttgcttcttttaagaggttgtccagtgtcgaggtgcagtcgtgggtgggtagggtcgggggggaggcggtggtccgaggccgtcggggaccgtcccgtagacgacctcctccgtgtggcacgtcctcgtggtactttanacttcagttattatgctatgctacgttggtttccgccgacgggtccgaggacggaggggcgtgggtagggtgggtggacgtaggtttatagtcgttaagtaggaagtaagggaaaaactaaaactccgtaacgacgtacggtaaccgtcggtacgggaaccgggaccgtaagtcctaaccgtacctacccgtaccccgaaaccgtaacctaaacctttaacgaaacccgtaaactacgttacttttaacggtttcctaacgtcgtacctacgaactacgtacgtacgggaatacggtaccggaacgtaccgtacgtagtttcggtaaactcgtacgtacggttcggaccgggtaccgaggtaacccggaacgttaaacccggtaacgttaaacccgtaacccgggtaaaggtaccgggtaaccgggtaccgggggtaacccggttaacccgggg

SEQ ID NO: 49825 - DNA, 751 bp, Homo sapiens
  misc_feature: GYAE6OF01BYECJ.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagcgtggtggaggtcggggggaggcgtggtccagccgtgggacctcctgagacctctctgtcgcacgcctcgtagtactttacacttcagttagttatgtactatcgacgtacgttcggtttccgccgtacggggtccgtagggacggaaacgggggtcgtaggggtagggttggggtacgggtacgttaaggttttaagtacgtttacggttaagttacggaaaggttaaaggaaaaacgtaaaaacgttaaccgtaaccggaccgtaacgtaacccgttcgggtaaacggaaccgggtacctacgttaccctaacctaccgttcccctaaccccgtaactaaacgtaaaccgttaacccgaacgtaaaccgtacctttagtttacgtttacctacgtgtaccgtaacgaacgtaacgcgtaaggaacgtaacgtacgaaccgacggtaccgtacgttagtactacgtctaccgtggtaccgcggtcgaacggacgtaaccgtaacgttaacccgtaacccggaaggtaaccgaccgggtaggcccggttaaacccggg

SEQ ID NO: 49826 - DNA, 754 bp, Homo sapiens
  misc_feature: GYAE6OF01CMSEI.49.5.A05.1.454.CMB.1.raw
  modified_base (302)..(302): a, c, t, g, unknown or other
  misc_feature (302)..(302): n is a, c, g, or t
  modified_base (336)..(336): a, c, t, g, unknown or other
  misc_feature (336)..(336): n is a, c, g, or t
  modified_base (496)..(496): a, c, t, g, unknown or other
  misc_feature (496)..(496): n is a, c, g, or t
  modified_base (721)..(721): a, c, t, g, unknown or other
  misc_feature (721)..(721): n is a, c, g, or t
  modified_base (735)..(735): a, c, t, g, unknown or other
  misc_feature (735)..(735): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctggagtcttgggttttcctcgttgccttacttttaaggaggtcgtcctagttcgtcgaggtgaccaggtcgtgggtagggacggggtcgggggggaggtcggtcggtcccgacggtcccgtgggacccgttccccgtggtaacgtccttcctccgtcggtacnccgtacgtccttacgtacggtaactttaaccgtntttaccgtaagttaacgttagtcgtacttagtcgcgtacgtttcgggtttccgacggacgggttaccgacggaccggtaggggtccgttagggtgggttgggtcgtaccgttaagttagtacgttcgtagtacggtaagtaaacggaaaactaaaacgtntaaaccgcgtaacgccgttacgggagtacgggctaacttccaccgtactcccgaaccgactaacgtaaactacgaaactaactacgttctttaacgttctactacgtactacgactaggtcctaggaacgagtaaccgtcgaccgtacggtctagtaatccgttagacgttgggaccgcggacgaggtaaccgtaacgtaccgtttaaaccggaccgttaaacgnggttaaacccgggngggtaccccggtaaacggg

SEQ ID NO: 49827 - DNA, 861 bp, Homo sapiens
  misc_feature: GYAE6OF01E3JW9.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttggctgagtcgttgggttttcctcgttgcttacttttaaggaggtgtccgagtgtcgaggtgcgagcgtggtggaggtcggggggaggtcgtggtccagccgtgggaccgtcccgtgacgtactcctcgtgtcgccgacgtccttcgtaggtactttactcgttcgtaggttattagtcgtacttaggtcgtaccttaccggtttcgggtttccggacccggtaacggggttaccgacggggtaacggtaaacgggggtccggttaggggtagggttcggggacgggtactttaagggtttaaactccggtacggtttagaggggttaaaccgtaaacgggtaaaaaaccgttaaaaacttccggtaaccgggtaacgtaacgggtaccccggttaccggggtaagggaaaccgggtccccgttaaacctaacccgtaaccgaccccggttaccctaaccccgaaacgtaaccccgttaaccctttaaaccgaaacgttaaacctaccttaggttttaacctttccgtaaccgtcggtaactacggaaccgaccggtaggttacggaaagggtaacgacccggtaacggtaccgtacggtcgtaacggttaactaccggtaccgtaagtaccgttcgggccgtaaccgacggtaccctaaaacggttcccctaacggaacccggtaacggttaacccggtccgggtaacccgggccgttaaacccgg

SEQ ID NO: 49828 - DNA, 732 bp, Homo sapiens
  misc_feature: GYAE6OF01AGK61.49.5.A05.1.454.CMB.1.raw
  modified_base (117)..(117): a, c, t, g, unknown or other
  misc_feature (117)..(117): n is a, c, g, or t
  modified_base (215)..(215): a, c, t, g, unknown or other
  misc_feature (215)..(215): n is a, c, g, or t
  modified_base (306)..(306): a, c, t, g, unknown or other
  misc_feature (306)..(306): n is a, c, g, or t
  modified_base (439)..(439): a, c, t, g, unknown or other
  misc_feature (439)..(439): n is a, c, g, or t
  modified_base (470)..(470): a, c, t, g, unknown or other
  misc_feature (470)..(470): n is a, c, g, or t
  modified_base (599)..(599): a, c, t, g, unknown or other
  misc_feature (599)..(599): n is a, c, g, or t
tcagagtcgagagacacgaccggtgctcgatttagatagatagacgaggggtctgggagacgagccccagcacgtggaagtcgccggtgtttccattcggtgatcatcactgaacanagaggactcaccagtggtaggtttgggctgagtcgtttcgggtttttcctcgttgtcgttacgtttttaaggaggttcgtccgaggttcgtcagggtncgtagtcgttggggtgggaggggtcggggggagtcggtcggtccgaggcccggtcgggtaccgtccgtagacgtccgttccttcgtggtcnccgtacgtccgttcgttacgttaactttactagtttccggtaaggttttagttacgtcggtaccttagtacggtaccgtttaccgggtttcggttccggaccggtaccgggtacgaggggacgggtacggggngtagggtagggtcgggtaggtacttaagttntacgtgtacgtaggaaacgtaaaggaaaactatacgacgtagaccgtacgacggttaacggacgtaccgtactaccaccgtcctaccgtaccgaacactaacgtaacgaactactagtctttcgtatcntaccagactcgagcggaacgtaggtactacgacgtaccgattacgtacgatctaggtcgacggcgacgaacgaccgttaagtacccgaaccggttaacggacgttcccggacgggtacgggcccggtaaccgg

SEQ ID NO: 49829 - DNA, 165 bp, Homo sapiens
  misc_feature: GYAE6OF02GMLU8.49.5.A05.1.454.CMB.1.raw
  modified_base (155)..(165): a, c, t, g, unknown or other
  misc_feature (155)..(165): n is a, c, g, or t
tcagagtcgagagacacgaccggtgctcgatttagatagatagacagggtcaagctcacctgcactctgaacggtcagcccaaggctgcccctcggtcactctgttcccaccctcctcgtctctcgactctgagcgggctggcaaggcgcatagnnnnnnnnnnn

SEQ ID NO: 49830 - DNA, 155 bp, Homo sapiens; identical to SEQ ID NO: 49669
  misc_feature: GYAE6OF02I6IUL.49.5.A05.1.454.CMB.1.raw
  modified_base (155)..(155): a, c, t, g, unknown or other
  misc_feature (155)..(155): n is a, c, g, or t

SEQ ID NO: 49831 - DNA, 156 bp, Homo sapiens
  misc_feature: GYAE6OF02IQ5A3.49.5.A05.1.454.CMB.1.raw
  modified_base (155)..(156): a, c, t, g, unknown or other
  misc_feature (155)..(156): n is a, c, g, or t
tcagagtcgagagacacgaccggtgctcgatttagatagatagacaggggtcaagctcacctgcactctgaacggtcagcccaaggctgcccctcggtcactctgttcccgccctcctctctctcgactctgagcgggctggcaaggcgcatagnn

SEQ ID NO: 49832 - DNA, 161 bp, Homo sapiens
  misc_feature: GYAE6OF02HM4JB.49.5.A05.1.454.CMB.1.raw
  modified_base (156)..(161): a, c, t, g, unknown or other
  misc_feature (156)..(161): n is a, c, g, or t
tcagagtcgagagacacgaccggtgctcgatttagatagatagacaggggtcaagctcacctgcactctgaacggtcagcccaaggctgccccctcggtcactctgttcccgccctcctctctctcgactctgagcgggctggcaaggcgcatagnnnnnn

SEQ ID NO: 49833 - DNA, 156 bp, Homo sapiens
  misc_feature: GYAE6OF02GSZ2M.49.5.A05.1.454.CMB.1.raw
  modified_base (155)..(156): a, c, t, g, unknown or other
  misc_feature (155)..(156): n is a, c, g, or t
tcagagtcgagagacacgaccggtgctcgatttagatagatagacaggggtcaagctcacctgcactctgaacggtcagcccaaggctgcccctcggtcactctgttcccaccctcctctctctcgactctgagcgggctggcaaggcgcatagnn

SEQ ID NO: 49834 - DNA, 175 bp, Homo sapiens
  misc_feature: GYAE6OF02JEXXU.49.5.A05.1.454.CMB.1.raw
  modified_base (156)..(175): a, c, t, g, unknown or other
  misc_feature (156)..(175): n is a, c, g, or t
tcagagtcgagagacacgaccggtgctcgatttagatagatagacgaggggtcgaagctcacctgcactctgaacggtcagcccaaggctgcccctcggtcactctgttcccgcctcctctctctcgactctgagcgggctggcaaggcgcatagnnnnnnnnnnnnnnnnnnnn

SEQ ID NO: 49835 - DNA, 157 bp, Homo sapiens
  misc_feature: GYAE6OF02GUS2J.49.5.A05.1.454.CMB.1.raw
  modified_base (155)..(157): a, c, t, g, unknown or other
  misc_feature (155)..(157): n is a, c, g, or t
tcagagtcgagagacacgaccggtgctcgatttagatagatagacaggggtcaagctcacctgcactctgaacggtcagcccaaggctgcccctcggtcactctgttcccgccctcctctctctcgactctgagcgggctggcaaggcgcatagnnn

SEQ ID NO: 49836 - DNA, 163 bp, Homo sapiens
  misc_feature: GYAE6OF02H4AY2.49.5.A05.1.454.CMB.1.raw
  modified_base (157)..(163): a, c, t, g, unknown or other
  misc_feature (157)..(163): n is a, c, g, or t
tcagagtcgagagacacgaccggtgctcgatttagatagatagacagggggtcaagcgtcacctgcactctgaacggtcagcccaaggctgcccctcggtcactctgttcccgccctcctctctctcgactctgagcgggctggcaaggcgcatagnnnnnnn

SEQ ID NO: 49837 - DNA, 157 bp, Homo sapiens
  misc_feature: GYAE6OF02GDIIQ.49.5.A05.1.454.CMB.1.raw
  modified_base (156)..(157): a, c, t, g, unknown or other
  misc_feature (156)..(157): n is a, c, g, or t
tcagagtcgagagacacgaccggtgctcgatttagatagatagacaggggtcaagctcacctgcactatgaacggtcagcccaaggctgccccctcggtcactctgttcccgccctcctctctctcgactctgagcgggctggcaaggcgcatagnn

SEQ ID NO: 49838 - DNA, 155 bp, Homo sapiens; identical to SEQ ID NO: 49669
  misc_feature: GYAE6OF02FI8DD.49.5.A05.1.454.CMB.1.raw
  modified_base (155)..(155): a, c, t, g, unknown or other
  misc_feature (155)..(155): n is a, c, g, or t

SEQ ID NO: 49839 - DNA, 519 bp, Homo sapiens
  misc_feature: GYAE6OF02IZZM2.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggaggcgtggtccagcctgggacgtccctgagactctcctgtgcagcctctggatttacattcagtagttatgctatgcactggtttcgccagggtccaggcaaggggctggagtgggtggcagttatatcgtatgatggaaacgaaaatactacgcagactccgtgaagggccgattcacatctccgacacaattccaagaacacattgtttctactgctgaacagcctgagaagtgacgacacggctgtaatatcactgtgcggcaggcaacgattacctacccgaaggactacgtggggacctaacggg

SEQ ID NO: 49840 - DNA, 166 bp, Homo sapiens
  misc_feature: GYAE6OF02GBXGN.49.5.A05.1.454.CMB.1.raw
  modified_base (157)..(166): a, c, t, g, unknown or other
  misc_feature (157)..(166): n is a, c, g, or t
tcagagtcgagagacacgaccggtgctcgatttagatagatagacagggggtcaagctcacctgcactctgaacggtcagcccaaggctgccccctcggtcactctgttcccgccctcctctctctcgactctgagcgggctggcaaggcgcatagnnnnnnnnnn

SEQ ID NO: 49841 - DNA, 516 bp, Homo sapiens
  misc_feature: GYAE6OF02GJMTA.49.5.A05.1.454.CMB.1.raw
  modified_base (455)..(455): a, c, t, g, unknown or other
  misc_feature (455)..(455): n is a, c, g, or t
  modified_base (473)..(473): a, c, t, g, unknown or other
  misc_feature (473)..(473): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggaggcgtggtccagcctgggacgtccctgagactctcctgtgcagcctctggatttacattcagtagttatgctatgcactggtttcgccagggtccaggcaaggggctggagtgggtggcagttatatcgtatgataggaaacgaaaaatactacgcagactccgtgaagggccgatcacatctcccgacacaattccaagaacacattgttctactgctgaacagcctgagagtgacgacacggntgtatatcactgtgcggnaggcaacgattacacccgaaggactacgtcgggacctaacggg

SEQ ID NO: 49842 - DNA, 555 bp, Homo sapiens
  misc_feature: GYAE6OF02IEA1W.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggaggcgtggtccagcctgggacgtccctgagactctcctgtgcagcctctggatttacattcagtagttatgctatgctacttggtttcgccgaggggtccagggcaaggggctgggagtggggtgctagttatatcgtatgataggaaaacgaaaatactacgcagactccgtaggaacgggccgtattccacactcctacccgacacaattaccaagaacacatttcgttactactgctagaacacgcctagaagaagtcgaacgacgacggcgtagtactatacacgtgtggcggacgaggcaacgattaaccgaccgaacggactacgtcgggacctaacggg

SEQ ID NO: 49843 - DNA, 159 bp, Homo sapiens
  misc_feature: GYAE6OF02ILLWB.49.5.A05.1.454.CMB.1.raw
  modified_base (157)..(159): a, c, t, g, unknown or other
  misc_feature (157)..(159): n is a, c, g, or t
tcagagtcgagagacacgaccggtgctcgatttagatagatagacagggggtcaagctcacctgcactctgaacggtcagcccaaggctgccccctcggtcactctgttcccgccctcctctctctcgactctgagcgggctggcaaggcgcatagnnn

SEQ ID NO: 49844 - DNA, 158 bp, Homo sapiens
  misc_feature: GYAE6OF02G04WD.49.5.A05.1.454.CMB.1.raw
  modified_base (157)..(158): a, c, t, g, unknown or other
  misc_feature (157)..(158): n is a, c, g, or t
tcagagtcgagagacacgaccggtgctcgatttagatagatagacagggggtcaagctcacctgcactctgaacggtcagcccaaggctgccccctcggtcactctgttcccaccctcctctctctcgactctgagcgggctggcaaggcgcatagnn

SEQ ID NO: 49845 - DNA, 157 bp, Homo sapiens; identical to SEQ ID NO: 49675
  misc_feature: GYAE6OF02IN8I0.49.5.A05.1.454.CMB.1.raw
  modified_base (157)..(157): a, c, t, g, unknown or other
  misc_feature (157)..(157): n is a, c, g, or t

SEQ ID NO: 49846 - DNA, 523 bp, Homo sapiens
  misc_feature: GYAE6OF02F0ZED.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcgtggtttcgcgttagctctttaagaggtgtcagtgtcaggtgcagctggtggagtcggggggaggcgtggtccagcctgggacgtccctgagactctcctgtgcagcctctggatttacattcagtagttatgctatgcactggtttcgccagggtccaggcaaggggctggagtgggtgctagttatatcgtatgataggaaacgaaaatctacgcagactcgtgaaggccgatcacatctaccgacacaattccaaagaacactatttacgtttcacttgccttagaacagtcctagagtaagtgacgacacggtctgtatatcatgtgcggcaggacaacgattacgaccggaagactacgtcgggacctaacggg

SEQ ID NO: 49847 - DNA, 906 bp, Homo sapiens
  misc_feature: GYAE6OF02HU2IZ.49.5.A05.1.454.CMB.1.raw
  modified_base (171)..(171): a, c, t, g, unknown or other
  misc_feature (171)..(171): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctctttaaggnggtgtccagtgtcgaggtgcagcgtgggtggagggtcggggggaggcggtcggtccgacggtccggtggggtacccgtcccgtggacgtaccttccgtccgttggtcgccgacggtccttcgtaggttaacttttaacctattacgtaaggttagttagtcgtacttagtcgacctacgtttcgggttttccgacccggtacggggttccgaacggggtaccggtaaacgggggtcgttaggggtaagggttgggggtcgggtaccgttaaggttttaagttacgttacggttaagttaggtaaaggtaaacgggaaaaaaacgtaaaaacgttaccgtaaaccggaccgtaaacggtaccgttaccggtaagggaaccgggtaccgtaacttacccgaacctacgttaccccgtaaccccggaacaaaccttaaacgttaacccgaaaacgtaaacctaacctttagttttaccgtttaaccttaaccgtcgtaccgttaaacggaaaccgtaccggtccgttaagggaaaacggttaaccggtaccggaaacccggtaaccggtaaccgggttcgttaaacggtaaaccttacgtaccctacggttagggttaccgggaaccgggtacgtaaacggaaccttaaaacgggttaaccctttaaaccccggaaacccggggaaaaggtttaccccgggttaacgggtacccgggggtaacccgtaaacccggggg

SEQ ID NO: 49848 - DNA, 514 bp, Homo sapiens
  misc_feature: GYAE6OF02IRXWU.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgggggagcgtggtccagcctgggactccctgagactctcctgtgcagcctctggatttacattcagtagttatgctatgcactggtttcgccagggtccaggcaaggggctggagtgggtggcagttatatcgtatgataggaaacgaaaaatactacgcagactccgtgaagggccgaattcaccatcaccgacacaattccaagaacacattgttctactgctgaacagcctgagaagtgacgacacggctgtaatatcactgtgcggcaggcaacgattacaccgaagactacgtgggacctaacggg

SEQ ID NO: 49849 - DNA, 536 bp, Homo sapiens
  misc_feature: GYAE6OF02F9OMP.49.5.A05.1.454.CMB.1.raw
  modified_base (468)..(468): a, c, t, g, unknown or other
  misc_feature (468)..(468): n is a, c, g, or t
tcagagtcgagagacacgaccggtgctcgatttagatagatagacaggggtctgggagacgagcccagccacctggaagtcgccggtgtttccattcggtgatcatcactgaacacagaggactcaccatggagtttgggctgagctgggttttcctcgttgctcttttaagaggtgtccagtgtcaggtgcagctggtggagtcggggggaggcgtggtccagcctgggactccctgagactctcctgtgcagcctctggatttacattcagttagttatgctatgcactggtttcgccagggtccaggcgaaggggctgggagtgggtggctagttatagtcgtatgataggaaacaaaatactacgcagactccgtagaagggccattcaccatcctaccgacacaattaccaagaacacattgtttactactgactagaacagcctgaagagtgacgacgacgntagtaatatcagtgtgcggacaggcaacgtattaccaccggaagaccgtacgtacgggacctaacggg

SEQ ID NO: 49850 - DNA, 557 bp, Homo sapiens
  misc_feature: GYAE6OF02GLLLI.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggaggcgtggtccagcctgggacgtccctgagactctcctgtgcagcctctggatttacattcagtagttatgctatgcactggtttcgccagggtccaggcaaggggctgggagtggggtggctagttatagtcgtatgataggaaacgaaaaatactacgacagactccgtagaagggccattcaccatcctacccgacacaattccaaagaaccactattgttactacttgctagaacagcctagagtaagtcgaacgacgacggctagtatactctacgtgtgcggtacacgggacaacgtattaccgtacccggaaggacctacggtacggggaccctaacggg

SEQ ID NO: 49851 - DNA, 582 bp, Homo sapiens
  misc_feature: GYAE6OF02GAGNW.49.5.A05.1.454.CMB.1.raw
  modified_base (177)..(177): a, c, t, g, unknown or other
  misc_feature (177)..(177): n is a, c, g, or t
  modified_base (364)..(364): a, c, t, g, unknown or other
  misc_feature (364)..(364): n is a, c, g, or t
  modified_base (375)..(375): a, c, t, g, unknown or other
  misc_feature (375)..(375): n is a, c, g, or t
tcagagtcgagagacacgaccggtgctcgatttagatagatagacagggggtctgggagacgagcccagcactggaagtcgccggtgtttccattcggtgatcatcactgaacacagaggactcaccatggagtttgggctgagcggtggtttcgcgtaggcgtctttaagtaggtntccagtgtcaggtgcagctggtggagtcgggggagcgtggtccagcctgggacgtccctgagactctcctgtgcagcctctggatttacattcagtagttatgctatgcactggtttcgcgtaggtccaggcgaagggctggagtgggtgctagttatatcgtatgagtagaaacgaaaatcacganacgacttccgnggaacggccgattcaccatcctaccgacacaacttccaagaacaactatttcgttactactgtactacgaacctagcctaggaagtagtgaaccgacgtaccgggtataggttaattataccgtatcggtacggacggacgaacgggtacgtaaacggtacttaaccgaaccggtaaacggactacgggtacgggaccgtaaccggg

SEQ ID NO: 49852 - DNA, 533 bp, Homo sapiens
  misc_feature: GYAE6OF02G5YS5.49.5.A05.1.454.CMB.1.raw
  modified_base (487)..(487): a, c, t, g, unknown or other
  misc_feature (487)..(487): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggaggcgtggtccagcctgggacgtccctgagactctcctgtgcagcctctggatttacattcagtagttatgctatgcactggtttcgccagggtccaggcaaggggctgggagtgggtggcagttatatcgtatgataggaaaacgaaaatactaacgcagacctccgtaggaaacgggccgattccgaaccatcctcccgacacaattccaagaacacattcgtttactactgctagaacagcctagaagagtgacgacgacggctgtatatcatgngcgcaggcaacgattacgaccgaagactacgtcgggacctaacggg

SEQ ID NO: 49853 - DNA, 915 bp, Homo sapiens
  misc_feature: GYAE6OF02H796Y.49.5.A05.1.454.CMB.1.raw
tcagagtcgagagacacgaccggtgctcgatttagatagatagacaggggtctgggagacgagcccagcactggaagtcgccggtgtttccattcggtgactcatcactagaacacaggaggactccaaccagtggtaggtttgggctggagtcggtttcgggttttcccttcggttcgtccttttacgttttaaagggtaggttcgtaccgtaggttcgtacggtagggtcgacgacgtcggttggggtagggtacgggggtacgggggggacggtcgggttcgggtaccgacggtccgggtacggggtacccgttcccgtaggaacgtaccttccttccgttggtcgaccgaccgtcccttcggtaggttaacttttaactactttacgtaaggtttagtttagtcgtacttagtcgacctacgtttcgggtttccaccggtacgggtccgaggacgggaacgggtcgtagggtagggttgggggtcggtacgttaaggtttatacgttacgtagtaggtaagttaaacgggaaaaaactaaaattaccgtacgacgtaacgtaccgttcggtaagggaaccgggccttaacttacccgaaccgtacgttaccccgtaaccccggaacaaaccgtttaaaccttaaccgaaaacgtaaaccctaacgttaacgtttttaccgtttaaccttaacgtcgtaccgttaacgaaaccgtaccgtccgtaaggaaacggtaacggtaccgaaaccggtaaccgtaaccgggtcttaacggttaaacttacgtacccgtacggttcgggtacggcccggtaacggacgggaaacccgtaaacgttaaccgtttaaccccggaaccgggtaaacggttaacccgttacggggtacccgggggaccgttaaaccccgggg

SEQ ID NO: 49854 - DNA, 543 bp, Homo sapiens
  misc_feature: GYAE6OF02IVWK3.49.5.A05.1.454.CMB.1.raw
  modified_base (439)..(439): a, c, t, g, unknown or other
  misc_feature (439)..(439): n is a, c, g, or t
tcagagtcgagagacacgaccggtgctcgatttagatagatagacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagcctgggacgtccctgagactctcctgtgcagcctctggatttacattcagtagttatgctatgctactggtttcgccagggtccaggcgaaggggctgggagtgggtgctagttatatcgtatgataggaaacaaaatactacgcagactccgtagaacgggccatcaccatctaccgacacaatccaagaacacattcgttactactgctagaacncgctagagaagtgaacgacgacggtctagtaatatcacgtgtcggcggacacggacaacgtacttaaccgtaccggaagtaccgtacggtcgggacctaacggg

SEQ ID NO: 49855 - DNA, 622 bp, Homo sapiens
  misc_feature: GYAE6OF02GE1I3.49.5.A05.1.454.CMB.1.raw
  modified_base (190)..(190): a, c, t, g, unknown or other
  misc_feature (190)..(190): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtncagctggtggaggtcggggggagcgtggtccagccgtgggacgtccctgacgactctcctgtgcagcctctggatttacattcagttagttatgctatgcacgttggtttcgccgtagggtccaggcgaaggggctggaggtgggtggcgtagttatatcgtatgaagtaggaaaacgaaaatcgacgacagactccgtaggaacggccattcacactcctacccgacactaattaccaaagaacactatttgtttactacttgtctagaactacgtccttagaaggtaacgtagaaccgtaacgaccggtacttaggttaactaagtcctaacgttgtacggccgggtaacgacgggaacctaaaccggtagtttaaacccgtaacccggtaaacggtaccgtacgggtacggggtacccgtaaaccgggg

SEQ ID NO: 49856 - DNA, 518 bp, Homo sapiens
  misc_feature: GYAE6OF02HDO87.49.5.A05.1.454.CMB.1.raw
  modified_base (326)..(326): a, c, t, g, unknown or other
  misc_feature (326)..(326): n is a, c, g, or t
  modified_base (387)..(387): a, c, t, g, unknown or other
  misc_feature (387)..(387): n is a, c, g, or t
  modified_base (405)..(405): a, c, t, g, unknown or other
  misc_feature (405)..(405): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
  modified_base (437)..(437): a, c, t, g, unknown or other
  misc_feature (437)..(437): n is a, c, g, or t
  modified_base (471)..(471): a, c, t, g, unknown or other
  misc_feature (471)..(471): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggaggcgtggtccagcctgggactccctgagactctcctgtgcagcctctggatttacattcagtagttatgctatgcactggtttcgccagggtccaggcaaggggctggagtgggnggcagttatatcgtatgataggaaacaaaatacacgcagactccgagaggccatcacatcnccgacacaacttccaaanacacattgttactactnctanaacagctaganagtgacgacacggctgtaatatcactgtcgcggnacggcaacgattaccaacccggagaccgtacgtcgggacctaacggg

SEQ ID NO: 49857 - DNA, 728 bp, Homo sapiens
  misc_feature: GYAE6OF02J03XA.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgggggagcgtggtccagcctggggacgtccctgagactctcctgtgcagcctctggatttacattcagtagttatgctatgcactggttcgccagggtccaggcaaggggctgggagtgggtggctagttatatcgtatgagtaggaaaacgaaaatactacgcaagactccgtaggaacgggccgtaattccgaacctacgtccctaccccgaacaaccgtaaacttacccgaaagtaaacctaactaacgtttacgtttaccttaaccttacggtaccttacgaaacctacggtacccttaagggaacggtaaaggttacgaaccggtaaccgtaaccgggtccttaacggttaaacgttaacgttacccgtaacgtttcgggttaccgggaacccggggtaccgtaaacggggtaacccgtaaaacccggttaaaccgttttaaaccccggttaaacccccgggtaaacgggttaacccgtaacccgggtttaccggggggacccccttaaaacccgggggg

SEQ ID NO: 49858 - DNA, 557 bp, Homo sapiens
  misc_feature: GYAE6OF02IO3W4.49.5.A05.1.454.CMB.1.raw
tcagagtcgagagacacgaccggtgctcgatttagatagatagacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagcctgggacgtccctgagactctcctgtgcagcctctggatttacattcagtagttatgctatgctactggttcgccagggtccaggcgaaggggctgggagtggggtgcagttatatcgtatgataggaaacaaaaatctaacgcaagactccgtagaacgggccgaattccaacctatcctccccgaacaactaacttaccaaacgaacctactattacgttactacgtgctagaacagacctagaagaagtagaacgacgacgctagtatatcactggtgacggcaggctaacgtattaccgaaccggaaggacctacgtcgggactaacggg

SEQ ID NO: 49859 - DNA, 558 bp, Homo sapiens
  misc_feature: GYAE6OF02GI5MB.49.5.A05.1.454.CMB.1.raw
  modified_base (445)..(445): a, c, t, g, unknown or other
  misc_feature (445)..(445): n is a, c, g, or t
  modified_base (497)..(497): a, c, t, g, unknown or other
  misc_feature (497)..(497): n is a, c, g, or t
tcagagtcgagagacacgaccggtgctcgatttagatagatagacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggaggcgtggtccagcctgggacgtccctgagactctcctgtgcagcctctggatttacattcagtagttatgctatgcactggttcgccagggtccaggcaaggggctgggagtggggtggcagttatatcgtatgataggaaacgaaaatactacgcagactccgtagaacgggccattcaccatcctcccgacacaattaccaagaaccactattgtttctactgctagaacngcctggagtaagtgacgacgacggtctagtaactatctacgtgtggccgganacggaccaacgtacttaaccgtacccggaaggtacctacggtacggggaccctaaccgggg

SEQ ID NO: 49860 - DNA, 515 bp, Homo sapiens
  misc_feature: GYAE6OF02J1FCR.49.5.A05.1.454.CMB.1.raw
  modified_base (166)..(166): a, c, t, g, unknown or other
  misc_feature (166)..(166): n is a, c, g, or t
  modified_base (171)..(171): a, c, t, g, unknown or other
  misc_feature (171)..(171): n is a, c, g, or t
  modified_base (179)..(179): a, c, t, g, unknown or other
  misc_feature (179)..(179): n is a, c, g, or t
  modified_base (182)..(182): a, c, t, g, unknown or other
  misc_feature (182)..(182): n is a, c, g, or t
  modified_base (201)..(201): a, c, t, g, unknown or other
  misc_feature (201)..(201): n is a, c, g, or t
  modified_base (215)..(215): a, c, t, g, unknown or other
  misc_feature (215)..(215): n is a, c, g, or t
  modified_base (236)..(236): a, c, t, g, unknown or other
  misc_feature (236)..(236): n is a, c, g, or t
  modified_base (254)..(254): a, c, t, g, unknown or other
  misc_feature (254)..(254): n is a, c, g, or t
  modified_base (257)..(257): a, c, t, g, unknown or other
  misc_feature (257)..(257): n is a, c, g, or t
  modified_base (262)..(262): a, c, t, g, unknown or other
  misc_feature (262)..(262): n is a, c, g, or t
  modified_base (270)..(270): a, c, t, g, unknown or other
  misc_feature (270)..(270): n is a, c, g, or t
  modified_base (275)..(275): a, c, t, g, unknown or other
  misc_feature (275)..(275): n is a, c, g, or t
  modified_base (313)..(313): a, c, t, g, unknown or other
  misc_feature (313)..(313): n is a, c, g, or t
  modified_base (322)..(322): a, c, t, g, unknown or other
  misc_feature (322)..(322): n is a, c, g, or t
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
  modified_base (366)..(366): a, c, t, g, unknown or other
  misc_feature (366)..(366): n is a, c, g, or t
  modified_base (412)..(412): a, c, t, g, unknown or other
  misc_feature (412)..(412): n is a, c, g, or t
  modified_base (444)..(444): a, c, t, g, unknown or other
  misc_feature (444)..(444): n is a, c, g, or t
tcagagtcgagagacacgaccggtgctcgatttagatagatagacaggggtcaagctcacctgcactctgaacggtcagcccaaggctgcccctggtcactctgttcccgcctctctctctcgacctctcgacgccggctggcctaaacggccgtctacgtacgcncgtcncgtctacncgngctacgcacgcgcgctacngacgctacgcgtcncgccgtgacgctcgacgcgcncgtactcgcacgtgcacncgngtccngcctgacncgtcncgcgtcacgcgctcgtagctacggtcacgtcgacgtcnaccgtcagntcgcgcctgacgcctaagctggtacccngtaccntcggcgtacncgtcgcgtcacgacgtcgaacgtcgcgtacgcgtacgcgacgttcncgtcgcttacgctcgtaacgcgcgttaacgcncgtcgcttcgtcgtcgcgtcgtcgcgtcgtcgtcgtcgtcgtcgtcgcgtcgtcgcgcgtcgtcgtcgtcg

SEQ ID NO: 49861 - DNA, 515 bp, Homo sapiens
  misc_feature: GYAE6OF02FGEXW.49.5.A05.1.454.CMB.1.raw
  modified_base (436)..(436): a, c, t, g, unknown or other
  misc_feature (436)..(436): n is a, c, g, or t
tcagagtcgagagacacgaccggtgctcgatttagatagatagacaggggtctgggatacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggaggcgtggtccagcctgggacgtccctgagactctcctgtgcagcctctggatttacattcagttagttatgctatgcactggtttcgccagggtccaggcaaggggctgggagtgggtggcagttatatcgtatgatggaaacgaaaaatactaacgcagactcgtgaacggccgattcaccatctccgacacaattccaagaacacattgttctactgctgaacngctgagagtgacgacacgctgtatatcatgtgcggcgaggcaacgacttactaccgaagactacgtcgggcctaacggg

SEQ ID NO: 49862 - DNA, 536 bp, Homo sapiens
  misc_feature: GYAE6OF02F4LX7.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagcctgggacgtccctgagactctcctgtgcagcctctggatttacattcagtagttatgctatgcactggtttcgccagggtccaggcaaggggctgggagtgggtggcagttatatcgtatgataggaaacaaaaatctacgcagactccgtagaacgggccattcaccatcctccgaacacaattccaagaacacatttgtttactactgctagaacagcctgagagtgacgacacggctagtatatcactgtgcggacagggacaacgtattaccgtaccggaacgacctacggtacgggaccctaaccgggg

SEQ ID NO: 49863 - DNA, 157 bp, Homo sapiens; identical to SEQ ID NO: 49675
  misc_feature: GYAE6OF02IYKUU.49.5.A05.1.454.CMB.1.raw
  modified_base (157)..(157): a, c, t, g, unknown or other
  misc_feature (157)..(157): n is a, c, g, or t

SEQ ID NO: 49864 - DNA, 682 bp, Homo sapiens
  misc_feature: GYAE6OF02IUPAR.49.5.A05.1.454.CMB.1.raw
  modified_base (245)..(245): a, c, t, g, unknown or other
  misc_feature (245)..(245): n is a, c, g, or t
  modified_base (291)..(291): a, c, t, g, unknown or other
  misc_feature (291)..(291): n is a, c, g, or t
  modified_base (331)..(331): a, c, t, g, unknown or other
  misc_feature (331)..(331): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttggctgagctgggttttcctcgttgctcttttaagaggtgtccagtgtcaggtgcagctggtggagtcgggggagcgtggtccagcctgggactccctgagactctcctgngcagcctgtggatttacattcagtagttatgctatgcactggttcncagggtccaggcaaggggctgggagtgggtgacaggttanagtcgtatgaatagggaaaacgtaaaaattcgacgacaagtacgtaccgtaggaaagggcccgaatttcccgaacctaacttcccgtaccccggaactaacctaaatttacccgaaaagtaaacctaacgtaacttttcggtttaacctaaccgttcggtaccttaacggaaaccgaggtacccttaggtaacgtaaaggttcgaaccggtaaccgaccggggtaccttagtaacttaatccctacgttaggtacggccgggtaccaacgggtaaccgaaaccgttaacgttaacccgttaacccggaaagggttaccctaacgggttaccggggacccgtaaacccgggg

SEQ ID NO: 49865 - DNA, 573 bp, Homo sapiens
  misc_feature: GYAE6OF02HPB4Z.49.5.A05.1.454.CMB.1.raw
  modified_base (442)..(442): a, c, t, g, unknown or other
  misc_feature (442)..(442): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggaggcgtggtccagcctgggacgtccctgagactctcctgtgcagcctctggatttacattcagttagttatgctatgctacttggtttccgccgtagggtccagggcaagggggctgggtaggtggggtggctagttatatcatatgagtggaagcaagataatactatgtagactccggtaggaacgggtccattacatcactctacagacgacaactacgaagacacgctntactcgtagacaacgtagaacgaggtcgtgaggacgtcgtagacgtaacgtaccggttaatttacgttaattacgttggtacgtaacgtaacgttaacgtaccggaacgggtacgtaacccgtaacccggg

SEQ ID NO: 49866 - DNA, 560 bp, Homo sapiens
  misc_feature: GYAE6OF02GWQ96.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggaggcgtggtccagcctgggacgtcctgagactctcctgtgcagcctctggatttacattcagtagttatgctatgctactggtttcgccgagggtccaggcgaaggggctgggagtgggtggcagttatatcgtatgataggaaacgaaaatactacgacagacctccgtaggaagggccgaattcaccatcctcccgaacacaacttccaaagaacactattgtttacctactgactgaacagcctagagagtgaacgacgacggctagtatactacactggtggcggacacggactaacgacttaaccgacccggtaaggtacctacggtacggggacctaaccgggg

SEQ ID NO: 49867 - DNA, 616 bp, Homo sapiens
  misc_feature: GYAE6OF02HOBF7.49.5.A05.1.454.CMB.1.raw
tcagagtcgagagacacgaccggtgctcgatttagatagatagacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggaggcgtggtccagcctgggactccctgagactctcctgtgcagcctctggatttacattcagtagtatgctatgcactggtttcgccagggtccaggcaaggggctggagtgggtgcagttatatcgtatgataggaaacgtaaaaatactaacgcaagacctccggtaggaacgggccgaattccaaccatccctaccccgacaactaacttccaaagaaccaactatttcgtttacctacgtcgtacctgtaaccacggtccctagggaaacgtaacggtacgtaaccgaaccgtacggggaccttaggtaactatcctacgttgtacggcggaccgaggaccgaaacgtacgttaaccgaacccggaacggaccgttaacggtcgggggaccctaaccgggg

SEQ ID NO: 49868 - DNA, 645 bp, Homo sapiens
  misc_feature: GYAE6OF02GXOHB.49.5.A05.1.454.CMB.1.raw
  modified_base (547)..(547): a, c, t, g, unknown or other
  misc_feature (547)..(547): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcgtggtttcgtcgtagcgtctttaagaggtgtcagtgtcaggtgcagctggtggaggtcggggggagcgtggtccagccgtgggacctcctgagactctcctgtgcagcctctggactttacattcagttagttactgctatgctacgttggttcgcctagggtccagggcgaaggggtctgggaggttggggtgacgtagttaatgtcggtaatgaatagggaaaaacctaaaatcgtaacgccaagtaccgtaccggtaggaacggggtccctattaccgacctagttccctaccgaacctaactaaacgttccaaacggaactacctagtttcggtttacctacgttcgtacgtaacgaacacggtccgtagaacggaagtcgaaaccggtacgaaccgtnttcggttaatcctacgtacgtgtacggcggacgtaacggccgtaaacgtattacccgttaaccggaagttaaccgtacggtccggggactaaccgggg

SEQ ID NO: 49869 - DNA, 579 bp, Homo sapiens
  misc_feature: GYAE6OF02G09KP.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagccgtgggacgtccctgagactctcctgtgcagcctctggatttacattcagtagttatgctatgcacgtggttccgccagggtccaggcaaggggctgggagtgggtgcgagttatatcgtatgagtaggaaaacgaaaatactacgacagtactcgtagaacgggcctagttcaccatcctcccgaacactaacttccaaacgtaacactatttgttactacgtgacctagaacagtccctagaacgtaagtacgaccgtaacacggtcgttagtaatactccgacgttggtcggcggccaagggaccaacgtactttaccggaccgaaggtacctacgggacgggacctaacgggg

SEQ ID NO: 49870 - DNA, 529 bp, Homo sapiens
  misc_feature: GYAE6OF02HD6CX.49.5.A05.1.454.CMB.1.raw
  modified_base (335)..(335): a, c, t, g, unknown or other
  misc_feature (335)..(335): n is a, c, g, or t
  modified_base (447)..(447): a, c, t, g, unknown or other
  misc_feature (447)..(447): n is a, c, g, or t
  modified_base (457)..(457): a, c, t, g, unknown or other
  misc_feature (457)..(457): n is a, c, g, or t
  modified_base (467)..(467): a, c, t, g, unknown or other
  misc_feature (467)..(467): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgggggaggcgtggtccagcctgggacgtccctgagactctcctgtgcagcctctggatttacattcagtagttatgctatgcacttggttcgcctagggtccaggcaaggggctggagtgggtggcagttanatcgtatgataggaaacgaaaaatactaacgcagactccggtagaacgggccgattacgaccatctcccgacacaattccaagaacaactattgtttactactgctagaacngcctgagagngacgacacgntagtatatcactggtgcggcgagcaacgattacaccggaagtactacgtgggacctaacggg

SEQ ID NO: 49871 - DNA, 530 bp, Homo sapiens
  misc_feature: GYAE6OF02GH7EB.49.5.A05.1.454.CMB.1.raw
  modified_base (391)..(391): a, c, t, g, unknown or other
  misc_feature (391)..(391): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggaggcgtggtccagcctgggacgtccctgagactctcctgtgcagcctctggatttacattcagtagttatgctatgcactggtttcgccagggtccaggcaaggggctgggagtgggtggcagttatatcgtatgataggaaacgaaaatctacgcagactcgtgaacgggccatcacatcnccgacacaatccaagaaccactattgttactactgctgaacagcctgagaagtgacgacacggctgtatatcatgcgcggacaggaccaacgtacttaacgtacccggaaggtaccgtacggtacggggacctaacggg

SEQ ID NO: 49872 - DNA, 557 bp, Homo sapiens
  misc_feature: GYAE6OF02HP95S.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggaggcgtggtccagcctggggacgtccctgagactctcctgtgcagcctctggatttacattcagtagttatgctatgcacgttggtttcgccgagggtccagggcaaggggctgggagtggggtggcaggtttatatcgtatgatagggaaacgaaaatactacgcagactcggtaggaagggcctatcaccatcctccgacactaacttccaagaacactagttcgtttactactcgtctagaactacggcctaggagaagtgacgacacggctgtatatcatgtgcggacaggacaacgtattaaccgacccggtaaggaccgtacggtacggggaccctaacggg

SEQ ID NO: 49873 - DNA, 577 bp, Homo sapiens
  misc_feature: GYAE6OF02IR5T4.49.5.A05.1.454.CMB.1.raw
  modified_base (336)..(336): a, c, t, g, unknown or other
  misc_feature (336)..(336): n is a, c, g, or t
  modified_base (343)..(343): a, c, t, g, unknown or other
  misc_feature (343)..(343): n is a, c, g, or t
  modified_base (364)..(364): a, c, t, g, unknown or other
  misc_feature (364)..(364): n is a, c, g, or t
  modified_base (389)..(389): a, c, t, g, unknown or other
  misc_feature (389)..(389): n is a, c, g, or t
  modified_base (432)..(432): a, c, t, g, unknown or other
  misc_feature (432)..(432): n is a, c, g, or t
tcagagtcgagagacacgaccggtgctcgatttagatagatagacaggggtcgtgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgggggaggcgtggtccagcctgggactccctgagactctcctgtgcagcctctggatttacattcagtagttatgctatgctactggtttcgcctagggtccaggcaaggggctgggagtgggtgcagttanatcgtangatggaaactaaaatctacgnagactcgtagacgggcattcactanctaccgacacaacttcaactaacacattgttacctatgtactnaaacacgtctagaacgaagtacgaaccgaacgtaacgcctagtaacgtattaccgaactggtaccgcgggtaccacgggtaccaaacggtacttaacccgtaacccggaaaggtaacctaccggttacggggaccctaaccgggg

SEQ ID NO: 49874 - DNA, 523 bp, Homo sapiens
  misc_feature: GYAE6OF02HCJ2J.49.5.A05.1.454.CMB.1.raw
  modified_base (362)..(362): a, c, t, g, unknown or other
  misc_feature (362)..(362): n is a, c, g, or t
  modified_base (371)..(371): a, c, t, g, unknown or other
  misc_feature (371)..(371): n is a, c, g, or t
  modified_base (393)..(393): a, c, t, g, unknown or other
  misc_feature (393)..(393): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagcctgggacgtccctgagactctcctgtgcagcctctggatttacattcagtagttatgctatgcactggtttcgccagggtccaggcaaggggctgggagtgggtgcagttatatcgtatgatggaaacgaaaatctacgnagactccgngaacgggcatcacatctccganacaattccaagaacacattgttctactgacctagaaccagcctagagaagtgaacgacacgctagtatatcactgtcgcggacaggcaacgtattaacaccggaaggacctacgtacggggcctaacggg

SEQ ID NO: 49875 - DNA, 808 bp, Homo sapiens
  misc_feature: GYAE6OF02HBHNN.49.5.A05.1.454.CMB.1.raw
  modified_base (251)..(251): a, c, t, g, unknown or other
  misc_feature (251)..(251): n is a, c, g, or t
  modified_base (268)..(268): a, c, t, g, unknown or other
  misc_feature (268)..(268): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggtttcctcgttgctcttttaagaggtgtccagtgtcaggtgcagctggtggaggtcggggggaggcgtggtccaggcctgggacgtccctgagactctcctgtncagcctctggatttacnttcagttagttatgctatgctactggtttcgccgagggtcccaggcaaggggctagggagtggggtgctaggttatagtcgtagtgagtaggaaaacgaaaatacgtacgacagacctccgtaaggaacggggtccctaagtttaccgaaccctacgtcccgtaacccccggaactaacccgtaaactttaccccgaaaacggtaaaccctaaccgttaacgtttttacgggtttaccctttaacccgttacggtacccgtttaacggaaaacccgtacgggtacccctttaagggaaaccgggttaaaaggttaccggaaaacccggttaaccgaaacccggggttacctttaaacgggttaaactttaaccgttacccgttaacgtttcgggttaccgggcccggggtaacctaacggggtaaccccgtaaaacccggttaaaccgttttaaaccccgggtaaacccccgggtaaaagggttaaaccccggtttaacccgggttacccgggggggaacccccgttaaaccccgggggg

SEQ ID NO: 49876 - DNA, 736 bp, Homo sapiens
  misc_feature: GYAE6OF02HOD79.49.5.A05.1.454.CMB.1.raw
  modified_base (189)..(189): a, c, t, g, unknown or other
  misc_feature (189)..(189): n is a, c, g, or t
  modified_base (304)..(304): a, c, t, g, unknown or other
  misc_feature (304)..(304): n is a, c, g, or t
  modified_base (349)..(349): a, c, t, g, unknown or other
  misc_feature (349)..(349): n is a, c, g, or t
  modified_base (370)..(370): a, c, t, g, unknown or other
  misc_feature (370)..(370): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtncagctgggtggaggtcggggggaggcgtggtccagcctggggactcctgagactctcctgtgcagcctcgtggatttacattcagtagttatgtactagtgctacttggtttccnccgtagggtccagggcaagggctgggacgtgggtcggcaggttanagtcgtaatgaataggaaaanaaaattcaagacaggactccggtaggaaacggcgtaacttccaacgtacttccgacccgaacaaacctaacgttaaccgaaagtaaacctaacgtaacgttttcggtttaaccttaacccgttagaccgttaaacgaaaccgtaacggtaccgttaacggaaacggtaacggttaacgggaacccggtaaaccgtacccgggttacttaacggttaacgttaaccgttaaccgtacccgtaaggttccgggaaccgggtaccggtaaacgggaacccgtaaaacggttaccgtttaaacccggaaacccccggaaaggttaaccccggttaaccgggttacgggggaacccccgttaaaaccgggg

SEQ ID NO: 49877 - DNA, 577 bp, Homo sapiens
  misc_feature: GYAE6OF02GZI7P.49.5.A05.1.454.CMB.1.raw
  modified_base (331)..(331): a, c, t, g, unknown or other
  misc_feature (331)..(331): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgggggagcgtggtccagcctgggacgtccctgagactctcctgtgcagcctctggatttacattcagtagttatgctatgcactggtttccgccaggtccaggcaaggggctggagtgggtgcagttnacgtcgtagtgagtaggaaacgtaaatacgtacgctagtacctccgtagaacggtcctagttcaccgtatccgtacccgactacctaacttaccgaacgtaaccacgtacttcgttactacgtcgtactacgtaacacgtcctaggacgtacgtcgacgacgacggtctagtactactcgtacgtcgtcgcgactacggactaacgtacgttaccgaccgtaagacgtacgtcgggacctaaccgg

SEQ ID NO: 49878 - DNA, 553 bp, Homo sapiens
  misc_feature: GYAE6OF02GPTFJ.49.5.A05.1.454.CMB.1.raw
  modified_base (364)..(364): a, c, t, g, unknown or other
  misc_feature (364)..(364): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagcctgggacgtccctgagactctcctgtgcagcctctggatttacattcagtagttatgctatgcactggtttcgccagggtccaggcaaggggctgggagtgggtggctagttatatcgtatgataggaaacaaaatctacgnagactcgtagaaggccgattcacatctacccgacacaacttccaaagaaccactattgttactactcgctagacagcctgaagtaagtgacgacacggctagtactatacactgtacggcggacacgggaccaacggtacttaacccgaccggtaaaggaccgtaccgtacggggcccgtaaaccgggg

SEQ ID NO: 49879 - DNA, 640 bp, Homo sapiens
  misc_feature: GYAE6OF02HCWE3.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgggggaggcgtggtccagcctgggacgtccctgagactctcctgtgcagcctctggatttacattcagtagttatgctatgcactggtttcgccagggtccaggcaaggggctgggagtggggtggcagttatatcgtatgataggaaacgaaaaatactacgacgagactcccggtaggaacggggaccgtattccaacccgtatcccgtacccgaaccaacctaaacttacccaaagtaaaccaactagtttacgtttacctaacttcgccgttacgaaacacgtacccgtaggaacgtaaggttcgaaccgacgaccgggtctacggttaattactaccacgttggcgccgggtacgaacgggcctaaacggtaacttaaccggtaaccccggaaagggtaaccgtacggtacgggggaccctaaacccggggg

SEQ ID NO: 49880 - DNA, 678 bp, Homo sapiens
  misc_feature: GYAE6OF02IDEOP.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctctttaagaggtgtccagtgtcaggtgcaggcgtgggtgggagggtcggggggaggcggtggtccaggccgtggggaccgtcccgtggagacctctcctggtgcacgcctcgtggtatttacattcagttagttagtgctatgctacgttggttccgcgtacgggtccaggcgaaggggcgtgggaggtggggtggacgtaaggttagtaagtcggtatgtaacgtaaggaaaaacgtaaaaactacgtaacgacgtaacgtaccgtaccggtaggaacgggaccgtacttacgaacctacgtcccgtaccccgaactaacctaaagttacccaaaagtaaacctagttactttactttaccgtactcgtactacgaaacctacgaccgtaggaagtaacgtacgaaccgacgtaacgtcgtagtaactacgtacacgttggtcggaccggacgaacggacgtaaccgtacgttaaccgacccggaagtacccgtacggacggggtaccgtaacggg

SEQ ID NO: 49881 - DNA, 591 bp, Homo sapiens
  misc_feature: GYAE6OF02IBDY7.49.5.A05.1.454.CMB.1.raw
  modified_base (401)..(401): a, c, t, g, unknown or other
  misc_feature (401)..(401): n is a, c, g, or t
  modified_base (443)..(443): a, c, t, g, unknown or other
  misc_feature (443)..(443): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctctttaagaggtgtccagtgtcaggtgcagctggtggaggtcgggggaggcgtggtccagcctgggactcctgagactctcctgtgcagcctctggatttacattcgagtagttatgctatgctacgtggtttcgcctagggtccaggcgaaggggctgggaggtgggtgctagttatagtcgatggataggaaaacgaaaatactacgacagactccggaggaaggccgtatccacctntccgtacccgacaacaattccaaagacactattcgttactancgctagaacgacgtccgtagaagtaagtcgaaccgaacgacgtctagtaatcgtacgacgtgtacggcgacgtagggacctaaacggtactttacccggaaacccggtaaggaacccgtttacggaccggggtacccgtaaaccgggg

SEQ ID NO: 49882 - DNA, 622 bp, Homo sapiens
  misc_feature: GYAE6OF02GZBK4.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtggagtcggggggagcgtggtccagcctgggacgtccctgagactctcctgtgcagcctctggatttacattcagtagttatgctatgcactggttcgccagggtccaggcgaaggggctgggagtggggtgcgagttatatcgtatgataggaaacgtaaaaatacgtacgacaagacctaccgtagaacggggccgtattccaacctactccctaccccggaacctaacctaaacttaccaaacgaaacctaactacttttaggtttacctaccttacgcctacgtaaaccacgacctaggaagaaggtcgaacgaccgacggtctagtaatacgtactacgttggtcggccgggtacgagggacctaacgtactttaacccgaacccggaacggtacctacggtcggggacccgtaaccggg

SEQ ID NO: 49883 - DNA, 574 bp, Homo sapiens
  misc_feature: GYAE6OF02G7OP0.49.5.A05.1.454.CMB.1.raw
  modified_base (435)..(435): a, c, t, g, unknown or other
  misc_feature (435)..(435): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagcctgggactccctgagactctcctgtgcagcctctggtatttacattcagtagttatgctatgcacgttggttcgcctagggtccagggtcaagggggctgggagtgggtgcgtagttatatcgtatgataggaaaacgtaaaatcgtacgcagactcggtagaacgggcctattccaccatcctaccgacactaacttaccaaagaacaactnttcgttctacgtcgctagaacacgtctagacgaagtcgacgaacgacgtactagtaatactacactagtcggcggacgaacggtacaacgtaacttaccgtaaccggaaggtacctaacgggtcgggaccgtaaccggg

SEQ ID NO: 49884 - DNA, 577 bp, Homo sapiens
  misc_feature: GYAE6OF02GTYQM.49.5.A05.1.454.CMB.1.raw
  modified_base (513)..(513): a, c, t, g, unknown or other
  misc_feature (513)..(513): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctgggtggaggtcggggggagcgtggtccaggcctggggacctccctgagactctcctgtgcagcctctggattttacattcagtagttatgctatgctactggtttcgccgagggtccaggcaaggggctgggagtggggtggcagttatatcgtatggatagggaaaacgaaaaatctacgacagactcgtaggacgggccaattcaacctatcctacccgacaactaattccaaagaacactactttgttactactcgctagaactagcctagacgtaagtcgacgacacggctagtatatcacgttggtgccggganacgggactaacgtacgttaaccgtaacccggaaggtaccgtacgtcgggggaccctaaccgggg

SEQ ID NO: 49885 - DNA, 587 bp, Homo sapiens
  misc_feature: GYAE6OF02IV1O4.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggaggcgtggtccagcctgggacgtccctgagactctcctgtgcagcctctggatttacattcagtagttatgctatgcactggtttcgccagggtccaggcaaggggctgggagtgggtgcagttatatcgtatgataggaaaacgaaaatactacgcagactccgtagaacgggccgattcaccatcctacccgacactaacttaccaaagaaccactatttacgtttactacgttgaccttagaaaccacgtccctaggaacgaagtacgacgtaaccgacggtctagtactatccacgttggtcgcggcaagggaccaaacgtacttaaccgtaacccggaaaggtaccgtaacggtacggggaccctaaacgggg

SEQ ID NO: 49886 - DNA, 526 bp, Homo sapiens
  misc_feature: GYAE6OF02HEVBW.49.5.A05.1.454.CMB.1.raw
  modified_base (335)..(335): a, c, t, g, unknown or other
  misc_feature (335)..(335): n is a, c, g, or t
  modified_base (435)..(435): a, c, t, g, unknown or other
  misc_feature (435)..(435): n is a, c, g, or t
tcagagtcgagagacacgaccggtgctcgatttagatagatagacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgggggagcgtggtccagcctgggacgtccctgagactctcctgtgcagcctctggatttacattcagtagttatgctatgcactggtttcgccagggtccaggcaaggggctgggagtgggtggcagttanatcgtatgataggaaacgaaaatctacgcagactccgtgaagggccattcacatctcccgacacaattccaagaacacattgtttactactgctagaacngcctgaagagtgacgacacggctagtatactcactggtcgcggcaggcaacgtattaccgaccggaagacctacgtcgggacctaacgggg

SEQ ID NO: 49887 - DNA, 527 bp, Homo sapiens
  misc_feature: GYAE6OF02HD0ED.49.5.A05.1.454.CMB.1.raw
  modified_base (389)..(389): a, c, t, g, unknown or other
  misc_feature (389)..(389): n is a, c, g, or t
  modified_base (424)..(424): a, c, t, g, unknown or other
  misc_feature (424)..(424): n is a, c, g, or t
  modified_base (438)..(438): a, c, t, g, unknown or other
  misc_feature (438)..(438): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagcctggggacgtccctgagactctcctgtgcagcctctggatttacattcagtagttatgctatgcactggtttcgccagggtccaggcaagggggctgggagtgggtctacgaactattagcggtattcgggtactaccacatactacgcagactccgtgaagggccncttcaccatctcagagacaattccaagacatggtnttctgacaaatgancagcctgagagccgaggacacggccgtatactactgtcgacgtaacgttcgacggtgactaggtactagtttgacttacgtggggaccg

SEQ ID NO: 49888 - DNA, 521 bp, Homo sapiens
  misc_feature: GYAE6OF02GBN63.49.5.A05.1.454.CMB.1.raw
  modified_base (393)..(393): a, c, t, g, unknown or other
  misc_feature (393)..(393): n is a, c, g, or t
  modified_base (398)..(398): a, c, t, g, unknown or other
  misc_feature (398)..(398): n is a, c, g, or t
  modified_base (408)..(408): a, c, t, g, unknown or other
  misc_feature (408)..(408): n is a, c, g, or t
  modified_base (432)..(432): a, c, t, g, unknown or other
  misc_feature (432)..(432): n is a, c, g, or t
  modified_base (453)..(453): a, c, t, g, unknown or other
  misc_feature (453)..(453): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggaggcgtggtccagcctgggacgtccctgagactctcctgtgcagcctctggatttacattcagttagttatgctatgctactggtttcgccgagggtccaggcaaggggctgggagtgggtgctagttatatcgtatgataggaaaacgaaaatctacgcagactcgagaaggccatcacatcnccganacaatccaanaacacattgttcactgctagaacngcctgagagtgacacgacgtntagtatatcatgtgcggcaggaccaacgtattaccgaccggaagacctacgtcggggacctaaccggg

SEQ ID NO: 49889 - DNA, 756 bp, Homo sapiens
  misc_feature: GYAE6OF02G2PAL.49.5.A05.1.454.CMB.1.raw
  modified_base (358)..(358): a, c, t, g, unknown or other
  misc_feature (358)..(358): n is a, c, g, or t
tcagagtcgagagacacgaccggtgctcgatttagatagatagacagggtcgtgggagacgagcccagcactggaagtcgccggtgtttccattcggtgatcatcactgaacacagaggactcaccatggagtttgggctgagctgggtttcctcgttgctcttttaagaggttgtccagtgtcaggtgcagctggtggaggtcgggggaggcgtggtccagccgtggggaccgtccctgaggtacctctccgtgtcgccagcctcgtggatttacattcagttagttatgtacttagtgctacgttcggtttcgccgtacgggtccgagggcgtaaggggcgtgggtaggttggggnggtacgtaagttagtatcggtatggaatagggaaaaactaaaaataccgtaacgacgtaagaaccgttcgtaagggaacgggtaccctaagtttccgaaacctacgttacccgtacccgaactaaaccgtaacttaccgaaacgaaacctacgtattttacggtttactaaccgttgaccgttacaacgtaacgtaccgttaggaacgaaaggtttaccgaaccgtaaccgtacggaccttaaggttaaacctcgtttaacccgacgttggaccggttcgggaaccccgtaagggtaaaccccgttaaacggttaaccgtttaaccccgggtaaaccccggtaaagggtacccggtttaaaccccgggttacgggggaaccccgttaaaaccccgggg

SEQ ID NO: 49890 - DNA, 559 bp, Homo sapiens
  misc_feature: GYAE6OF02GBVW2.49.5.A05.1.454.CMB.1.raw
  modified_base (466)..(466): a, c, t, g, unknown or other
  misc_feature (466)..(466): n is a, c, g, or t
  modified_base (506)..(506): a, c, t, g, unknown or other
  misc_feature (506)..(506): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggagcgtggtccagcctgggacgtccctgagactctcctgtgcagcctctggatttcattcagtagttatgctatgcacgtggtttcgccgagggtccaggcaaggggctgggaggtgggtggcaggttatagtcgtatgagtaggaaaacgaaaatacgtacgacagactcggtaggaacgggccgtattaccacctactcctaccccgacaactaactccaaagaaaccactatttagtttcctactgctagaacncgtcctagacgagtacgacacgacgctagatactcacgtntcggcgacgacggacacgtataccaccggaagacgtacggtcgggactaacgg

SEQ ID NO: 49891 - DNA, 539 bp, Homo sapiens
  misc_feature: GYAE6OF02IEVRK.49.5.A05.1.454.CMB.1.raw
  modified_base (374)..(374): a, c, t, g, unknown or other
  misc_feature (374)..(374): n is a, c, g, or t
tcagagtcgagagacacgaccggtgctcgatttagatagatagacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagcctgggacgtccctgagactctcctgtgcagcctctggatttacattcagttagttatgctatgctactggtttcgccagggtccaggcaaggggctggagtgggtgctagttatatcgtatgataggaaacgaaaatctacgcagactcgngacggcatcacatcaccgacacattccaagaacactattgtttactactgctagaactacgcctagaagtagtacgacgacacggtctgtatatcactgtcggcggacaggacaacgtaacttaccgtaacccggaaggtacctacggtacgggacctaaccggg

SEQ ID NO: 49892 - DNA, 575 bp, Homo sapiens
  misc_feature: GYAE6OF02JDAQN.49.5.A05.1.454.CMB.1.raw
  modified_base (447)..(447): a, c, t, g, unknown or other
  misc_feature (447)..(447): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgggggagcgtggtccaggcctgggacgtccctgagactctcctgtgcagcctctggatttacattcagttagttatgcttatgactacgtggtttcgcctagggtcccaggcaaggggctgggagtgggtgcagttatatcgtatgataggaaacaaaatctaacgcagctcgagaacgggccgaattcaccactctacccgacaacacttaccaagaacaacatttcgttactacttgcgtanaacacgcctagaacgtaagtcgaacgacgacggacttagtaactacgtactagtggtcgacggcacggacgaacgtacgttacccgtaaccggaacggtacctaacggtacggggacccgtaaccggg

SEQ ID NO: 49893 - DNA, 533 bp, Homo sapiens
  misc_feature: GYAE6OF02GEATM.49.5.A05.1.454.CMB.1.raw
  modified_base (434)..(434): a, c, t, g, unknown or other
  misc_feature (434)..(434): n is a, c, g, or t
  modified_base (494)..(494): a, c, t, g, unknown or other
  misc_feature (494)..(494): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagcctgggacgtccctgagactctcctgtgcagcctctggatttacattcagtagttatgctatgcactggtttcgccagggtccaggcaaggggctggagtgggtgcagttatatcgtatgatggaaaacaaaaatactacgcagactccgtgaaggccgattcacgatctccgacacaattccaaagaacacattgttctacttgctgaaacngaccttgaatagtacgacgtacaacggctagtatatctactgacgcggcaaggcaaacgnttaacctaccggaaacggactacgtcgggactaaccggg

SEQ ID NO: 49894 - DNA, 555 bp, Homo sapiens
  misc_feature: GYAE6OF02JI5Z7.49.5.A05.1.454.CMB.1.raw
  modified_base (437)..(437): a, c, t, g, unknown or other
  misc_feature (437)..(437): n is a, c, g, or t
  modified_base (453)..(453): a, c, t, g, unknown or other
  misc_feature (453)..(453): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagcctgggacgtccctgagactctcctgtgcagtccctctggatttacattcagtagttatgctatgctacttggtttcgccgtagggtcccagggcaaggggctggagtgggtgcgtagttactatcggtatgataggaaacgaaaatactacgacagtactcgtgaacgggtcattaccacctatacctccgaacactaataccaagacactattnttctactcgctagacncgcctagaagtagtagacgacgacggtctagtaatactctacgtgtacggcggtcaggcaacgtacgtactaacccggagacctacggtcgggctaaccggg

SEQ ID NO: 49895 - DNA, 714 bp, Homo sapiens
  misc_feature: GYAE6OF02HXDLW.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctgggtgggaggtcggggggaggtcgtggtccagccgtggggacgtccctgagacctctcctgtgcagcctctggtatttacattcgagtagttatgactatgctacgttggtttccgccgtagggtccgagggacgaagggggtctgggagggtggggtggacgtaagttagtagtcgttatgaagtaggaaaaacgtaaaaattaccgtaacgacaaggtaccgttaccggtagggaacgggccgtaacttaccaaccgtaactcccgtaaccccgaactaaaccgtaaccttacccgaaaagaaaccctaacgtaagtttttaccgtttaccgtacttacggaacttacggaaaccgtaacggtacccgttaggaaggtaaacgtaccggaacggtaacccgaccgttaccgttagtaacttagtccgtaacgttggtcggacgggaccgagggaacctaacggtacttaacccgtaacccggaaggtaccgtaaccggtcgggggaccctaaccgggg

SEQ ID NO: 49896 - DNA, 695 bp, Homo sapiens
  misc_feature: GYAE6OF02IFQ7N.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggaggagtggtccagcctgggacgtccctgagactctcctgtgcagcctctggactttacattcagttagttatgctatgctacgtggtttcgccgaggggtccaggtcgaaggggctaggggagtggggtgacgtagttatatcggtataggattagggaaaacgtaaaaatacgtaacggcaaggaccttaccggtagggaacgggtcccgtaacgtttaccaacccgtacttacccgtacccccggtaacaaacccgtaaatttaccccgaaaagtaaaccctaaacgtacttttacggtttacccttaacgttacgtaccgttagaaaccgtacgtaccgtacggaagtaaggtaggtaaccgacgtacggtctacggtaatacgtactacgtaggtcgcgggtaccgagggacctaacgtaacgtttacccgtaacccggtaagggttaaccctacgggtaccggggaccggtaaacccggg

SEQ ID NO: 49897 - DNA, 743 bp, Homo sapiens
  misc_feature: GYAE6OF02GYGRK.49.5.A05.1.454.CMB.1.raw
tcagagtcgagagacacgaccggtgctcgatttagatagatagacgagggtctgggagacgagcccagcactggaagtcgccggtgtttccattcggtgatcatcactgaacacagaggactcacatggagtttgggctgagcgttgggttttcctcgttgcttacttttaagaggtgtccagtgtcaggtgcagctggtggaggtcggggggagcgtggtccagcctgggacctcctggacgactctcctgtcgcacgcctcgtggtaactttacattcagttagttactcggactagtggtacctacttcgggtttccgaccgtaggggttcccaagggtaccggaaaggggggtccttaggggtacggttacgggggtaggtaccgtaacggtttaagtaacggttaccggttaatagggtaagtaaacgggaaaaaacgtaaaaacttccgtaacggacgtaacggtaacccgttccggtaaggaaccggggtaccctattacccgaacctacgtcccgtaaccccggtaactaactaaacgttacccaaaggtaaccttacttacgtttagttacctacgtcgtacctagaaacctgtacctaagaacgtacgtacgacgtaacgaccggtattacggaattaccgagtaccgttgacggaccggtacggagtacccgtaagtacgtaaacccgtaccggtaaggtaccgttacgggtccgggtaaccctaacccggg

SEQ ID NO: 49898 - DNA, 518 bp, Homo sapiens
  misc_feature: GYAE6OF02GH8G1.49.5.A05.1.454.CMB.1.raw
  modified_base (391)..(391): a, c, t, g, unknown or other
  misc_feature (391)..(391): n is a, c, g, or t
  modified_base (396)..(396): a, c, t, g, unknown or other
  misc_feature (396)..(396): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagcctgggactcctgagactctcctgtgcagcctctggatttacattcagtagttatgctatgcacttggtttcgccgagggtccagggccaaggggctgggaggtgggtggcagttatatcgtatgataggaaacgaaaatactacgcagactcgagaggccatcacatcnccganacatccaagaacacattgtttctatgctagaacagctagagagtcgacgacgacgctgtatatcactgtgcggacaggacgaacgtataccgtaaccgagacctacggtcgggaccaacggg

SEQ ID NO: 49899 - DNA, 581 bp, Homo sapiens
  misc_feature: GYAE6OF02JEYC1.49.5.A05.1.454.CMB.1.raw
  modified_base (296)..(296): a, c, t, g, unknown or other
  misc_feature (296)..(296): n is a, c, g, or t
  modified_base (512)..(512): a, c, t, g, unknown or other
  misc_feature (512)..(512): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgggggaggcgtggtccaggcctgggacgtccctgagactctcctgtgcagcctgtggatttacattcagtagtatgctatgctacgtggttcnccgagggtccaggcgaaggggtctgggagtggggtgctagttatagtcgtatggataggaaaacaaaatacgtacgacagtacctcggtaggaacgggcctaattccgaccatcctacccgaacactaacttccaaagaccactattcgttactactgtactgaacctgtaccctaggaagtaacgtcgaacgtacgacggactcgtaatctaccngtgtcgcggacaggaccaacgtactaccgtaacccggaagtacccgtacggtaccggggactaaccggg

SEQ ID NO: 49900 - DNA, 158 bp, Homo sapiens
  misc_feature: GYAE6OF02GX9NZ.49.5.A05.1.454.CMB.1.raw
  modified_base (157)..(158): a, c, t, g, unknown or other
  misc_feature (157)..(158): n is a, c, g, or t
tcagagtcgagagacacgaccggtgctcgatttagatagatagacagggggtcaagctcacctgcactctgaacggtcagcccaaggctgccccctcggtcactctgttcccgccctcctctctctcgactctgagcgggctggcaaggcgcatagnn

SEQ ID NO: 49901 - DNA, 776 bp, Homo sapiens
  misc_feature: GYAE6OF02IQJD4.49.5.A05.1.454.CMB.1.raw
  modified_base (268)..(268): a, c, t, g, unknown or other
  misc_feature (268)..(268): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggaggcgtggtccagcctgggacgtccctgagactctcctgtgcagcctctggatttacnttcagtattatgctatgctacttgggtttcgccgtaggggtccagggcgaagggggctagggaggtggggtggctaggttatagtcgtagtagagtaaggaaaacgtaaaaatacgtaacggacaacggtacctaccgggtaggaaacggggacccgtaatttacccaacccgtacttacccgtacccccggaaacctaaaccctaaactttacccgaaaacggaaaccctaaccttaacgttttcggttttacctaaccttcgtaccttacggaaacctaccggtaccgtaaggtaacggtaaacggtacggaaccggtaaccggtaaccgggtacgttacgttaaacgttaacttacccgtaacggtcgggttaccgggccggggtaacccgtaaaggggaaccctaaaaccggttaaccgttttaaaccccggtaaaccccggggaaacgggtaaacccgttaacccggggttacccggggggaaccccgttaaaccccgggggg

SEQ ID NO: 49902 - DNA, 626 bp, Homo sapiens
  misc_feature: GYAE6OF02HQONG.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtggaggtcggggggaggcgtggtccagccgtgggaccgtccctgagactctccgtgtcgcagcctctggatttacattcagtagttatgctatgcactggtttccgcgagggtccaggcaaggggctgggaggtgggtgcgagttatatcgtatgagaggaaacgaaaaatacgtaacgacagaccgtcggtagagggccgtagttaccaccatccacccgtaccacaacttaccaaagaacctacgtaatttcgtttaactactgtaccttaagacctaacgcctagaacgtaagtcgaacgaccgacggtacgtagtaatatacaccttggtacgcggtacacgggtaccaaaccggtaactttaacccggaacccggtaaaacgggtaccgtttaacgggaccggggtacccgtaaaccccggggg

SEQ ID NO: 49903 - DNA, 713 bp, Homo sapiens
  misc_feature: GYAE6OF02I78EO.49.5.A05.1.454.CMB.1.raw
  modified_base (172)..(172): a, c, t, g, unknown or other
  misc_feature (172)..(172): n is a, c, g, or t
  modified_base (432)..(432): a, c, t, g, unknown or other
  misc_feature (432)..(432): n is a, c, g, or t
tcagagtcgagagacacgaccggtgctcgatttagatagatagacagggtcgtgggagacgagcccagcactggaagtcgccggtgtttccattcggtgatcatcactgaacacagaggactcaccatggagtttgggctgagctgggttttcctcgttgcttcttttaagnggttgtccagtgtcaggtgcagctgggtggaggtcggggggaggcggtggtccaggccgtggggaccgtcccgtgacgaccttcctccgtgtggcacgcccttcgtggtaactttacgattctaggttacgtttatgcttatcggtacctacgtttgggtttccgccgtaagggggtcccaggggccgaaaggggtctggggagggttcgggtggctaaggttatcgtcgtaagtgaagtaaggaaaactaaatcggacnaacgtacgtaccggtagggaaacgggccctaatttacccgaccgacttccgtaacccgtaaccaactaaccttaacgaaaactaccgaactttatttgtttaccctatacgtacctcggaaaccaggtcccttaagaagtaaccggtcgaaccggtaaccacgggcttaggtaaacttgtaccctagtcggttacggcggtaaccgcgggtaacctaacggttaccggttaaccgaacccggaaaggttaccgtaccggacgggggtaccctaaccggggg

SEQ ID NO: 49904 - DNA, 648 bp, Homo sapiens
  misc_feature: GYAE6OF02H867Z.49.5.A05.1.454.CMB.1.raw
  modified_base (259)..(259): a, c, t, g, unknown or other
  misc_feature (259)..(259): n is a, c, g, or t
  modified_base (285)..(285): a, c, t, g, unknown or other
  misc_feature (285)..(285): n is a, c, g, or t
  modified_base (310)..(310): a, c, t, g, unknown or other
  misc_feature (310)..(310): n is a, c, g, or t
  modified_base (538)..(538): a, c, t, g, unknown or other
  misc_feature (538)..(538): n is a, c, g, or t
  modified_base (577)..(577): a, c, t, g, unknown or other
  misc_feature (577)..(577): n is a, c, g, or t
  modified_base (583)..(583): a, c, t, g, unknown or other
  misc_feature (583)..(583): n is a, c, g, or t
tcagagtcgagagacacgaccggtgctcgatttagatagatagacagggtcgtgggaggacgagcccagcactggaagtcgccggtgttccattcggtgatcatcactgaacacagaggactcaccatggagtttgggctgagcgtggtttctcgttgctcttttaagaggtgtccagtgtcaggtgcagcgtggtggaggtcgggggagggcgtggtccgagcgtgggactcctgaacgctctctggtagcacgcctntaggtatttacattcgagtagtttgngtcctatggctacgtttggtttccncgtacggggtccaggcgaaggggtgttaggaggtggggtcgacgtaggtttacatcggtatgtaagagggaaaacttaaaagcctagaccgtagccttaccggagggtaaacggcccgtaatttcccaaaccgtcgtacccgtaccccgtaacgtaactaaaccgttaccaaacggaaactactaagtttagttaccttactcgtacttacgaactccggtaccgtanaacggtagtcgaacgacgtaacggctaagtacgattacncttagngtcgtacgagaaccgtaacgacgttaaccgacggtaaccgtaacggtaccgtacgggactacggg

SEQ ID NO: 49905 - DNA, 651 bp, Homo sapiens
  misc_feature: GYAE6OF02IJNY5.49.5.A05.1.454.CMB.1.raw
  modified_base (406)..(406): a, c, t, g, unknown or other
  misc_feature (406)..(406): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcgtgggtttcctcgttaggctcttttaagaggtgtccagtgtcaggtgcagctggtggaggtcgggggaggcgtggtccgagccgtgggacgtcccgtgagactctcctgtgcagcctctggatttacattcagtagtatgctatgctacgtggtttcgccgtagggtccaggcgaaggggcgtggagtgggtgcgtagttatatcgtatggtagtaggaaacgtaaaatactagacagacgtcgtagacggctactacgacnctcctaccgacaacgtaattaccgaaacgtaactacgtatttacgtttaacctcgttacgtacgtagtaaccgtacgtaccgttagaacggtaacgtaccggaacgaccgtaccgggtactaggtaacttacttaccgtacttacggcggtacggacccgtagggacccgttaaaccggtaacttaaccccggtaaccggaaccggttaaccggtacccggttacgggtaaccccggtaaccggg

SEQ ID NO: 49906 - DNA, 581 bp, Homo sapiens
  misc_feature: GYAE6OF02JGBS6.49.5.A05.1.454.CMB.1.raw
  modified_base (295)..(295): a, c, t, g, unknown or other
  misc_feature (295)..(295): n is a, c, g, or t
  modified_base (338)..(338): a, c, t, g, unknown or other
  misc_feature (338)..(338): n is a, c, g, or t
  modified_base (451)..(451): a, c, t, g, unknown or other
  misc_feature (451)..(451): n is a, c, g, or t
  modified_base (493)..(493): a, c, t, g, unknown or other
  misc_feature (493)..(493): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagcctgggacgtccctgagactctcctgtgcagcctctggatttacattcagtagttatgctatgcactggtttcnccgagggtccaggcgaaggggctgggagtgggtggctagttantcgtatgagtaggaaacgaaaatctacgcagacgtcgtggaacggccattccaccatcctccgacacaacttaccaagaacactatttcgtttactactgtactagtaaaccncgtactagacgtaaggtcgaacgacgaccggtactacgttanactactacgtggtggccggacacggacctaacgtacgttaacccgtaacccggaacggtaacgtaccggtacgggacccgtaacgggg

SEQ ID NO: 49907 - DNA, 821 bp, Homo sapiens
  misc_feature: GYAE6OF02HJ6LY.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggaggcgtggtccagcctgggacgtcctgagactctcctgtgcagcctctggatttacattcagtagttatgctatgcactggttccgcagggtccagggcaaggggctggaggtgggtggctagttatagtcgtatgaagtacgggaaaacgtaaaatactacgactaacgtaccgtccggtaagggaaacggggtcccgtaagtttaccgaaccctacgttacccgtacccccggaacctaaaccttaaaccggtttaacccaaaaagggtaaacccttaaccgtaaatttttaccggttttacccgttaaccgttacggtacccgttaagaaacccgtacggtaaccccgttaagggtaaacggttaaacgggttacggaacccgggtaaccggtaacccgggggtaccgtttaaaggtttaaaccgttaaacccgttccggttaacccggtttacgggtttacggggaccccgggtaaccggtaacggggtaaccccgttaaaacccggttaaccgttttaacccccgggtaaaacccccgggaaaggggttaaccccggtttaaacccgggggttaccggggggaacccccggttaaaccccggggggg

SEQ ID NO: 49908 - DNA, 630 bp, Homo sapiens
  misc_feature: GYAE6OF02HJFGQ.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagcctgggactcccgtgagactctcctgtgcagcctctggatttacattcagtagttatgctatgcacgttgttcgcctagggtccaggcgaaggggctgggagtggggtgctaggttatagtacgtatgataaggaaaacgaaaatactaagcctaagactaccgtaggaacgggtacctatccgaacctactacctacccgtaacaaccgtaaacttaccaaaaggtaacctaactacgtttacgtttaccttaacgtcgtactacggaaacacgtacccgtaagaacgtaagtacgaaccgacgaaccggtactacgtaagtactacgtacgtaggtcggtacgacgaggaacctaacgtacttaaccggtaaccgaaggtacgtaccggtggggaccctaaaccggg

SEQ ID NO: 49909 - DNA, 637 bp, Homo sapiens
  misc_feature: GYAE6OF02HKVN0.49.5.A05.1.454.CMB.1.raw
  modified_base (430)..(430): a, c, t, g, unknown or other
  misc_feature (430)..(430): n is a, c, g, or t
  modified_base (492)..(492): a, c, t, g, unknown or other
  misc_feature (492)..(492): n is a, c, g, or t
tcagagtcgagagacacgaccggtgctcgatttagatagatagacagggggtctgggagacgagcccagcactggaagtcgccggtgtttccattcggtgatcatcactgaacacagaggactcaccatggagtttgggctgagctgggttttcctcgttgctctttaagaggtgtccagtgtcaggtgcagctggtggaggtcggggggaggcggtggtccaggccgtggggaccgtcccgtggacgacctctccgtgtgcgaggcctcgtggtatttacattcagttagttatgcttatgctacttcggttcgccgtagggtccaggtcgaaggggctgggtagtcgggtggctagttatagtcgtatgaataggaaaactaaaactacgaacgcagtacgtaccggtagaacgggtctattccaacncgtacctacccgacaacctaaactccaaagaaccagtatttcgttactagtcgactagaacnctacgtaggaagtacgtcgaacgaccgacgtactagtactactactagttacggtcggcggtacgacggtaacgtaaaccgttaccgttaacccggttaaccgggaacggttacccgtaccgggtcgggaccccgttaaccgggg

SEQ ID NO: 49910 - DNA, 786 bp, Homo sapiens
  misc_feature: GYAE6OF02ILHM4.49.5.A05.1.454.CMB.1.raw
  modified_base (209)..(209): a, c, t, g, unknown or other
  misc_feature (209)..(209): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgggggnggcgtggtccagcctgggaccgtccctgagacctcgtcctggtcgcagcctctggtatttacagttcagttagttatgtctatgctacgttggtttccgccgtacgggtccctaaggcgtaaacggggctaggggtaggttggggtaggtccgtaaggtttaagtacgttcggttagtcgtaagtacgggaaaaacgtaaaagtacctaacggactagaacccgttaccggtaggaacgggaccgtaattaccgacccgtaagtcctaccccggaactaacgtaaacttacccgaaacgtaaacccacgttaactttacgtttaccttagttacaacgttacgaaacctacgttcccgttaagaacggtaacggttacgaaacccggtaacgtaacccgggtcttaaggttaacttaaaccgttaccggaccctttagggtaccgggtacccgggtaacgtaaccgggtaacccgtaaaaccgtttaacgtttaacccccgtaaaccccggggtaaacgggtacccccggtttaaaccggttacccggggggggtaaccccttaaaaccccgggggg

SEQ ID NO: 49911 - DNA, 683 bp, Homo sapiens
  misc_feature: GYAE6OF02FYQOO.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcgggggagcgtggtccagccgtgggacgtccctgagactctcctgtgcagcctctggatttacattcagttagttatgtctatcgctacgttggtttcgccgagggtccgaggcgaaggggctgggagtgggtgcgtagttatagtcgtatgaagtacggaaaacgtaaaatactaacgacgaagtaacgtccggtagggaacgggtaccgacttcgacctactcctaccccgaactaactaacgttaccgaaacgtaacctacgtacgttttacgtttaccttacgttacgtaccttacgaaaccgtacggtccctaggtaaccggtaagtacggaaaccggtaccgacgggtactacggtaacttaccgtacgtacgttggtcggaccggcgtaacgggtaccgtaaacgtaccgtttaacccgaacccgggtaacgggtaacccgttacgggttacgggggacccctaaacccggggg

SEQ ID NO: 49912 - DNA, 744 bp, Homo sapiens
  misc_feature: GYAE6OF02JXX87.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctggtggaggtcggggggagcgtggtccaggcctgggaccgtccgtgagactctcctgtgcagcctcgtggtactttacgattcagtagttatgcttatgcacttgggttccgccgtacggtccgaggtcgaaggggtcctagggagtggggtcggctaggtttatacgttcggtaatgtagtaggaaaacgtaaaattacgacgagtacgactcgggtaggaaacgggcgtaacttccgaaccgtacgtaccctaccgactaaactaaccttaccgaaacgtaaccaacgttactttacggtttaacccttaacgtacgaccgttaacgaaacctacggtccgttaacgggaacgtaacggtaaccggaacgtaccggaaccgggttacttaaccgttaacttaccgttactaccggttggtacgggtacccggtaccgtaagggtaacccttaaaccggttaaccggtttaaacccggaaccccgggtaaaaccgggttacccggttaaacccggttacccgggggggtaaccccttaaaccccggggg

SEQ ID NO: 49913 - DNA, 610 bp, Homo sapiens
  misc_feature: GYAE6OF02G11B0.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagcctgggacgtccctgagactctcctgtgcagcctctggatttacattcagtagttatgctatgcacttggtttccgccgagggtccaggcgaagggggctgggagtggggtggctagttatagtcgtatgataggaaacaaaatctaacgcagtacgtccgtaggaacgggccgattaccacctactcctaccccgaacaaccaacttccaaacgaactacatttacgtttacctacgttcgctagaacctacgtacctaggaacgaacggtagaaccgacgaaccggtctagtaactacttacgacgttggtacggcggacgacggacctaacggtacttacccgtaaccggtaacggacctaccgggtcggggaccgtaacccgggg

SEQ ID NO: 49914 - DNA, 654 bp, Homo sapiens
  misc_feature: GYAE6OF02JDFHJ.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcacatggagtttgggctgagctgggtttcctcgttgcttcttttaagaggtgtccagtgtcaggtgcagctggtggacggtcggggggaggcgtggtccaggccgtggggaccgtccctgagactctcctgtcgcagcctgtggactttacattcgagtagttatgacttatcgactacttgggtttccgccgagggtccagggacgaaggggctgggaggtgggtagctaggttaatactaggtagtgaacttaagggaaaaacgtaaaagtactaacggacgtaagaccttacggaggaaccgggcgtaatcccgaactctaccacccgtaaacactaaacgttaccaaagtaacaactatttacgtttccgtactgtactacggtaacacgacttaggaacaagtacgacgtaaccgcgggtaacttacgttaataccgtacgtagtgtacgggccgtaacgacggacctaacgtaacgttaaccaacccggttaaggaaccggtacgtaccgggggacccttaacggg

SEQ ID NO: 49915 - DNA, 575 bp, Homo sapiens
  misc_feature: GYAE6OF02IGYXM.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagcctgggacgtccctgagactctcctgtgcagcctctggatttacattcagtagttatgcttatcgctacttggttttccgccgtaggggtccaggcgaaggggctgggagtggggtgctagttatagtcgtatgatagggaaaactaaaatctacgcaagactccggtaggaacgggcctaattccacctatacctccccgaacaacctaattaccaaacgaacactatttgtttacctactgtactacgacacgcctagaagtaagtgacgacgacgctagtatactcactggtacgcggcaggcctaacgagttaaccgaccggaagtacctacggtcgggaccgtaccggg

SEQ ID NO: 49916 - DNA, 599 bp, Homo sapiens
  misc_feature: GYAE6OF02ISTY0.49.5.A05.1.454.CMB.1.raw
  modified_base (471)..(471): a, c, t, g, unknown or other
  misc_feature (471)..(471): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcgtgggttttcctcgttgctcttttaagaggtgtccagtgtcaggtgcagctggtggaggtcggggggagcgtggtccagccgtgggacctccctgacgacctctccctgtgcagccctcgtggtatttacattcagttagttatgctatcgctattcgggtttccgccgaggggtccagggccgaaggggctgggagtggggtgctagttatagtcgtatgagtaaggaaaacgaaaattcgtacgcagactacgtaggaacgggccattccgaccacgtacctcccgaacactaactcaaacgaacactacgtttcttactacgtntacgtacgaacacgtcgtagagagtacgacgaccgtaacggtcgtagtaactacttccagttcggacgcggtacgagaccgaacgtaagtaccgtaccgaaggtacctacggacgggtactaaccggg

SEQ ID NO: 49917 - DNA, 771 bp, Homo sapiens
  misc_feature: GYAE6OF02IAJUO.49.5.A05.1.454.CMB.1.raw
  modified_base (171)..(171): a, c, t, g, unknown or other
  misc_feature (171)..(171): n is a, c, g, or t
  modified_base (189)..(189): a, c, t, g, unknown or other
  misc_feature (189)..(189): n is a, c, g, or t
tcagagtcgagagacacgaccggtgctcgatttagatagatagacaggggtctgggagaccgagcccagcactggaagtcgccggtgtttccattcggtgatcatcactgaacacagaggactcaccatggtagtttgggctgagctgggtttcctcgttgctctttaagngtgtccagtgtcaggtcncagctggtggaggtcggggggagcgtggtccaggccgtgggaccgtccctagacgacctcctctgtgcacgccttgtggtacttttacattccgaagttagttatggtcttatgtactacgttcgggtttccgccggtacggggttcccaagggccgtaagggggtccttggggtacgggttggggtcggtacgtaggttagtaacgttcggtaagtcggtaacgtaaacgggtaaaaaccgtaaaaacttaccgtaacgacgtacggtaaccttcccgggtagggaaccgggtcctaacttccgaaccctacgttccccgtacccgaactaaaccttaaacgttaccgaaaaggtaaaccctcgttaaagtttccgtttaacctacgttcgtaccgtacgaaccgtacggtccgttaaggaaggtaccgttaggaacccgtacggaacccggttacttaggtaaaccttacgtccgagttcgggtcgcccgggtaacgacggaacccgttaaaccgtaacgtttacccggaaacccggtaagggtacccttacggggtacccggggaccttaaaccccggg

SEQ ID NO: 49918 - DNA, 765 bp, Homo sapiens
  misc_feature: GYAE6OF02IQI4R.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagagactcaccatggagtttgggctgagctgggtttcctcgttgctctttaagaggtgtccagtgtcaggtgcagctggtggaggtcggggggagcgtggtccagccgtgggcgtccctgagacctctcctgtgcagcctcgtggatttacattcagttagttatgctatcgctacgttcgggtttaccgccgtacggggtccaggggtcgaagggggctagggaggttagggtgggtacgtaggtttattacgtacggtattacggaagtaaacgggtaaaaacgtaaaaagttacgttaaccggactaacgggtaccgttaacccggttagggaaaccggggtacccgtaagttacccgaaccgtaccgttaccccgtacccccggtaactaaacgttaaacccgttacccgaaaagtaaaaccctaaccgtttaagttttaacgtttaccgtaaaccgttcgtaccgtttaacggaaacctaaccggtccggttaggtaaacgggttaaagtcggaaaaccgtaccgaaccggtacgtacgttaaatcgttacccacggttggtacggcggtaaccgacgggtacaaaccgtaacgttaacccggaacccgtaagggtaccctacggggtacgggacccgtaaccggg

SEQ ID NO: 49919 - DNA, 793 bp, Homo sapiens
  misc_feature: GYAE6OF02G7GFC.49.5.A05.1.454.CMB.1.raw
  modified_base (173)..(173): a, c, t, g, unknown or other
  misc_feature (173)..(173): n is a, c, g, or t
tcagagtcgagagacacgaccggtgctcgatttagatagatagacaggggtcgtgggagacgagcccagcactggaagtcgccggtgtttccattcggtgatcatcactgaacacagaggactcaccatggagtttgggctgagctgggttttcctcgttgcttcttttaagnggtgtccagtgtcaggtgcagctggtggaggtcgggggagcgtggtccagcctgggactcctgacgtctctcctgtgcacgcctcgtggtaatttacatttcgaagttacggttatcgtaccttagtcggtctacgtttgggtttccgaccggtaacggggttaccagggtaccgaacggggtcctaggggtagggtcgggggtacggtactaggtttaatacggttcggtaaagtgtaacggtaaggaaaaaccgttaaaagttccgtaacgtacgtaacgggtaaccgttacccggtaagggtaaacccggggtcctaactttacccgaacccttacgtttaccccgtaaccccggaaactaacgttaaacccgttaccgaaaaacggtacctacgtttagtttaccggttttaaccacgttacgtccgtaaacgtaaccgtacgttaccgaagggtaacctaagggtacccaacggtaaccgtacgtaccgttataaaccgttgtaccctgggttacgtaccgggaagtaccggaaacggtacctaaacggttaccttaacccggtaaccggtaagggttaaccccgttcgggtacccggggaacttaaccccgggg

SEQ ID NO: 49920 - DNA, 709 bp, Homo sapiens
  misc_feature: GYAE6OF02HXUWO.49.5.A05.1.454.CMB.1.raw
  modified_base (235)..(235): a, c, t, g, unknown or other
  misc_feature (235)..(235): n is a, c, g, or t
  modified_base (248)..(248): a, c, t, g, unknown or other
  misc_feature (248)..(248): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagttggctgagctgggtttcctcgttgcttcgttttaagaggtgtccagtgtcaggtgcagctggtggaggtcggggggagcgtggtccagcctgggaccgtccngagactctcctgngcaggtcctctggatttacattcagtagttatgctatgctactggtttccgccagggtccaggcgaaggggtctagggacgtggggtggactagttaagtagtcgtatagagtaacgggaaaaactaaaagtacacgtcaagtaccgtccgtaaggacggtaccgtattaccaccgtaactcctaccccggaactaacctaaacgttaccgaaaacgtaaacctaacttaaacgtttacgtttaccgttaactaggtccctaagaaaccgtaaacggtcccgtaagggaacgtaaaaggttcgaaaccggtaccgtaacgggtactaagttaacttaactaaccgtacgtaggttacggaccgggaccgtaacgggtaaccgtaaaaccgtacgttaaaccggtaaccccggaaacggttaaacccggtaccggttaccgggggacccgttaaacccgggg

SEQ ID NO: 49921 - DNA, 577 bp, Homo sapiens
  misc_feature: GYAE6OF02GSEMV.49.5.A05.1.454.CMB.1.raw
  modified_base (392)..(392): a, c, t, g, unknown or other
  misc_feature (392)..(392): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtcgagtgtcaggtgcagctggtggagtcggggggagcgtggtccagcctgggacgtccctgagactctcctgtgcagcctctggatttacattcagtagttatgctatgcactggtttcgccagggtccaggcaaggggctgggagtggggtggcagttatatcgtatgataggaaaacaaaatctacgcagacctcgtagaggcctatcacatccnccgacacattaccaagaacactattcgtttactactgactagaacctagtcctaagacgaagtcgaacggacgtacggtacttgtaactagtcacgttggtcggcggtacgtaacgggcctaaacgtacgttaacccgtacccggaacggtaaccgtaacgggtccggggaacccgtaaccgggg

SEQ ID NO: 49922 - DNA, 579 bp, Homo sapiens
  misc_feature: GYAE6OF02I30RK.49.5.A05.1.454.CMB.1.raw
  modified_base (299)..(299): a, c, t, g, unknown or other
  misc_feature (299)..(299): n is a, c, g, or t
  modified_base (338)..(338): a, c, t, g, unknown or other
  misc_feature (338)..(338): n is a, c, g, or t
tcagagtcgagagacacgaccggtgctcgatttagatagatagacagggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggaggcgtggtccagcctgggacgtccctgacgactctcctgtgcacgcctctggatttacattcagtagttatgctatgcatggtttcgccngggtccaggcaaggggctgggagtcggggttgcagttanatcggtatgataggaaacaaaatacgacgcaaggactcggaggaaggccattccacactacctccacacaattccgaaagaactacatttcgttactactgcctagactacgcgtagacgtaagtcgaacgcgaacgtcgtacgtaatactactacttggtacgcgggacctagggaccaaccgtagtttaacccgacccggtaaaacggccttaaccggtacggggacccgtaaaccggg

SEQ ID NO: 49923 - DNA, 646 bp, Homo sapiens
  misc_feature: GYAE6OF02IQ098.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggaggcgtggtccaggccgtgggacgtccctgagactctcctgtgcacgcctctggtatttacattcagtagttatgactatcgctacgttcggtttccgccgtacgggtccaggcgaacggggtcgtgggaggtggggtcgcgtagttagtagtcgtagtcgtaagtaaggaaaaactaaaagtacgtaacggactaacgaccgtacggagggacgggccgtacttacgacctagtcccctaccggaacaaccgtacttaccgaaagtaacctacgttactttcgttactacgttgactaacgacacgtcgtagtaacgaggtagaaccgtacgacggtctagtaacttatacgcgtacggtcggacgttccgaagtaccgtaacgtaccgttaaccgaccgggtaacctaccgtacggtaccgggaccgtaaccgg

SEQ ID NO: 49924 - DNA, 593 bp, Homo sapiens
  misc_feature: GYAE6OF02F98SO.49.5.A05.1.454.CMB.1.raw
tcagagtcgagagacacgaccggtgctcgatttagatagatagacagggggtctgggagacgagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggagtccctgagactctcctgtgaacgcctctggattcaccttcaagaactttggcatgcactgggtccgccgaggctccaggcacggggctgggagtggggtggctagttatctcagatgatggaaagtaaaagtctattcggactccgttagaacgggtcctattacacctatcctaccagagacaattaccgaaagtaaccaccttgacatacctaacaaatcgacaacagtctagacgtaaccgtgacggacacggctagttacgtattacgtaggttcgggaacggggtaaaggggggtagggttagtttttaggacttaggttaccgggtaccctacggttacggtaccgttaaccggg

SEQ ID NO: 49925 - DNA, 926 bp, Homo sapiens
  misc_feature: GYAE6OF02IVKUC.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcgtgggtttcctcgtgctctttaagaggtgtccagtgtcaggtgcagctggtggagtcgggggagcgtggtccagccgtgggactccctaggacgactccgtccgtggtacgcgaggtcctcgttagggacttttacgacgttaccgtaagttaggttaactcggtacttaacgtcggaccttaacgttacgggttttccgacccggtaaggggttacccaaggggacgtaaacgggggtcctagggggtaacgtcggggtacggaccttaaggtttaactacggttccggtaagtagggtaacgttaacggggaaaaactaaaaacgtttaccgtaacggacgtaacggtaacccgtacccgggtaaggtaacccgggtaccgttaacgtttaacccgacccggtttaactttaccccgggaaacccgggttaaacctaaacggttaaacccgttaccggtaaaaaaccggtaaccgtaaccggttaaacggtttttaccggtttaaacccttaccggttaacgggttaacccgttaaaccgggtaaaccgttaaccggggttacctttaaccggggaaaaccggttaccgggtttaaaccgggaaccgtaacccggttaaacccggtaccgtttacgtaaaccgttacgtaccccgttagtttacccgggtaggttaccccgggaacggttaccgtaaccgtaacccgggttaattaacccccgggttaacggacggttaacccgtaaccgggtttcccgggaaccgtttaaaccccgggg

SEQ ID NO: 49926 - DNA, 793 bp, Homo sapiens
  misc_feature: GYAE6OF02JZLIZ.49.5.A05.1.454.CMB.1.raw
  modified_base (324)..(324): a, c, t, g, unknown or other
  misc_feature (324)..(324): n is a, c, g, or t
  modified_base (694)..(694): a, c, t, g, unknown or other
  misc_feature (694)..(694): n is a, c, g, or t
  modified_base (714)..(714): a, c, t, g, unknown or other
  misc_feature (714)..(714): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcttgggttttccctgttgctcttttaagaggtgtcctagtgtcaggtgcgagcgtggtggaggtccgggggggaggtccggttggtcccgaggtccgttggggtacccgtcccgtggacgtaccgttctccgttgtcggcctacgtcctcgttagtagtttacctagttcgtagttagttntcgtacgttatcgtacttacgttcgggtttaccgaccgtaaggggttccaaggggtaccgtaagggggtccgttagggtagggttaggggttggaaccgttaaggtttactaacggttaccggttaagttacggtaaacgtaaggtaaaaaaccgtaaaacgtacccgttaacgaccggtaacgtaacccgtttacggacgggtaaaccggtccgtagttacccgaacccgtacgtaccccggtaccccgtaaactaacccgtaacttaaccgaaacggtaaacccttaactacggtttactttacctacgttagcccgtaacgaacgtaccgaccgttagtaacggtaacgacggtaacgacgtaccgnttacgttagtaccttaccgngttcgtacggccggtacgaaggaaccgttaaccgtactaaccggtaaccgacgtacgtacgggtaccggacgtaaccgg

SEQ ID NO: 49927 - DNA, 658 bp, Homo sapiens
  misc_feature: GYAE6OF02F52ZY.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagcgtggtggagtcggggggagcgtggtccagcctgggacgtcctgagactctctgtcgcagcctctggatttacattcagttagttatgctatgcagttggttcgcctaggggtcccagggcgaaggggctaggggagtggggtggctagttatagtcgtatgagtaggaaaactaaaatcgtacgacaggtacctcggtaaggaacggtcctaattccaacctactcctcccgaacaactaacttaccgaaacgtaacacctagtttacgttactacgttggcctaagaactacggtccctaaggaacggtaacgtcggaaccgaccgtacgggtacgtacggttaataacgttcacggttccgggtacggccgggtaccaacggggaaccctaacgttaaaccgttaaccggaacccgggtaacgggttaacctaaccggggccggggtacccgtaaacccgggg

SEQ ID NO: 49928 - DNA, 834 bp, Homo sapiens
  misc_feature: GYAE6OF02GAMSN.49.5.A05.1.454.CMB.1.raw
tcagagtcgagagacacgaccggtgctcgatttagatagatagacagggggtctgggagacgagcccagcactggaagtcgccggtgtttccattcggtgatcatcactgaacacagaggactcaccatggagtttgggctgagctgggttttcctcgttgcttcttttaagaggttgtccagtgtcaggtgcagctgggtggaggtcggggggaggcgtggtccagccgtgggacgtccctgagactctcctgtgcagcctctggatttacattcagttacgttatgctatgctacgttggtttcgccgtagggtccagggtccgaaggggggtcctggggtaggttgggggtacggacgtacgtttagtacgttcggttagtaggaagttaacgggaaaaacgtaaaaatttacggaacgtacgaacgtacgtaccgggtaggaaacggggtcccgttaagttaccgaaccctaccgtttacccgtaacccccggtaaacctaaacccttaaaccttaacccgtaaaacggtaaaccctaaaccttaaaccgttttttaccggtttaacccttaccggtttacggaccgtttaacggtaaaccctaaccgggttccgttaaagggaaaccggttaaacgggtaccggtaacccggtaacccgtaacccggggttctaaaggtttaaccttaacgttccgttaaccgttcgggtacgggtaacccgggtaccggaacggtaacccgtaaacggttaccgtttaaaccccgggtaaacccggtaacgggtaaaccccttacggggttaaccggggaccccggttaaacccgggg

SEQ ID NO: 49929 - DNA, 892 bp, Homo sapiens
  misc_feature: GYAE6OF02IJQIG.49.5.A05.1.454.CMB.1.raw
  modified_base (271)..(271): a, c, t, g, unknown or other
  misc_feature (271)..(271): n is a, c, g, or t
  modified_base (274)..(274): a, c, t, g, unknown or other
  misc_feature (274)..(274): n is a, c, g, or t
  modified_base (283)..(283): a, c, t, g, unknown or other
  misc_feature (283)..(283): n is a, c, g, or t
  modified_base (295)..(295): a, c, t, g, unknown or other
  misc_feature (295)..(295): n is a, c, g, or t
tcagagtcgagagacacgaccggtgctcgatttagatagatagacagggtctgggagacgagcccagcactggaagtcgccggtgtttccattcggtgatcatcactgaacacagaggactcaccatgggtagtttgggctggagcttggggtttttcctcggtttgcttacgtttttaaggaggttcgttccgagtgtaccgtaggtgacagtctgggtacggaggtcggggggagtcgtggtccagcgtggaccgtcctgagctctcgngtncgagtcctntggtactttacnttcaggttacgttatcggtctatcgacgtacgttcggtttacgcccgtagggtccgaggtccgtaaggggcctacggggtgttagggggtacgtcgtaaggtttactaaggttccgtaagttggaaacgttacgggaaaaaaccttaaaagttaccgttaacggccgtaaagttaacccgttcccggtaaagggaacccggggttacctaacgttttacccggaaacctcccggttaaacccgttacccccggaaaccgtaaccgttaaaaccttacccggtaaaaccctaaacgttaacccgttacgttttaaccggtttaaccgtttaaccggtttacgggaaacccttttacggggaaaaccctacggggtttaaacccccgtaagggtaaccgtaaaccgttcgggtaaaacccggaaccggtaaacccgggttacggttaaccggttaactttaacccgtacgttaccggtccggttaacggcccgggtaactaaccggggtaaccttaaaacccggttacgttaaacccgtaaaccccgggttaaacgggttaacccgttacgggtacccggggtaacccttaaccggggg

SEQ ID NO: 49930 - DNA, 686 bp, Homo sapiens
  misc_feature: GYAE6OF02GQCZC.49.5.A05.1.454.CMB.1.raw
  modified_base (269)..(269): a, c, t, g, unknown or other
  misc_feature (269)..(269): n is a, c, g, or t
tcagagtcgagagacacgaccggtgctcgatttagatagatagacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggagcgtggtccagcctgggacctccctgagacctctcctgtgcagcctctggatttacnttcagttagttatgctatgctacgtggtttccgccgtaggggtcccagggcgtaagggggctgggacggtgggtggctagttatagtcgtaagtcgtaatagggaaaaacaaaatacgtaacgcaaggtacctcgtaggacggcctaattccactactcctacccgacaactaacttaccaaacgtaaccactagtttacgtttacctaacgttcgtacgttaacgaacgtacgtcccgtagaacggtaaggtaccggaacgaacgtaccgggtacttcggtaacttacgtaccgtacgttcgtacggggacggaccggtaacgggacccgtaaaccggttaacgtttaaccccgtaaacccgggtaaacgggtacccgttaacggggtaccggggtacccggttaaaaccccgggg

SEQ ID NO: 49931 - DNA, 821 bp, Homo sapiens
  misc_feature: GYAE6OF02GAJ2A.49.5.A05.1.454.CMB.1.raw
  modified_base (284)..(284): a, c, t, g, unknown or other
  misc_feature (284)..(284): n is a, c, g, or t
  modified_base (301)..(301): a, c, t, g, unknown or other
  misc_feature (301)..(301): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcttggggttttccctcgttgcttcttttaaagaggtgtccagttgtcaggtgcagcgtggtgggaggtcgggggggagcggtggtccaggccgtgggaccgtccctgacgactcctccgtgtgcagcctgtggtatttacntttacgagttagttacngtctatcgccgtacgtttgggtttacccgccgtacggggtccgagggtacggaacgggggtcttggggtaacgggttgggggtcggtaccgttaaggtttaacgtagttaccggttaagtacgggaaagtttaaagggaaaaaccgtaaaaacttacgtaaccgactaaggtacccttaaccgggtaaggaaacgggggtaccctaacgttaccctaacccgtacttaccccggtaaccccgtaactaaacccttaaaccggttacccaaaaacgtaaaccttaacccgttaagttttacgtttaaccctacggtttacgacctacgtaaaccgtccggttacctaaggtaaaccggtaagggttaccgaaccggtaacccgtacgggtaccttaacggttaaatacccgtccgttacgtacgggtacggccggaccgtaaggggacccctaaaggtaaccctttaacccggaaccggtaaccggtaaccgttacgggtcccgggaaccggttaaccggg

SEQ ID NO: 49932 - DNA, 609 bp, Homo sapiens
  misc_feature: GYAE6OF02IK5I9.49.5.A05.1.454.CMB.1.raw
  modified_base (429)..(429): a, c, t, g, unknown or other
  misc_feature (429)..(429): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggaggcgtggtccagccgtgggacgtccctgagacctctcctgtgcagcctctggatttacattcagtagttatgctatgctcttggtttcgccgtagggtccaggcgaaggggctgggagtggggtgcgagttatatcgtatgatagggaaaacaaaatacgtaacgcaagactcgtaggacggcgattcaccatccaccgaacacaattaccaagaacnctatttacgttcttacgtcgtcctagaaccacggtcctaggaagtaacgtacgaaccgacgaccggtcttacgtaactacttacgacgttaggtcggaccggcggtaacggcctaaacggtaacttaaccgtaacccgggaacggtacccgtaacgggtcggggtaccccgtaaccgggg

SEQ ID NO: 49933 - DNA, 743 bp, Homo sapiens
  misc_feature: GYAE6OF02JKA9H.49.5.A05.1.454.CMB.1.raw
  modified_base (173)..(173): a, c, t, g, unknown or other
  misc_feature (173)..(173): n is a, c, g, or t
  modified_base (191)..(191): a, c, t, g, unknown or other
  misc_feature (191)..(191): n is a, c, g, or t
  modified_base (265)..(265): a, c, t, g, unknown or other
  misc_feature (265)..(265): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgcttcttttaaggnggtgtccagtgtcaggtncagcttggtggaggtcggggggagcggtggtccaggcctggggactccctgagacctctcctgtcgcagtcctntggatttacatttcagtagttatgctatgctactcggtttcgcctaggggtccagggtcaacgggggcttggggacggttgggggtcggccgtaggtttatacgttcgtactgggaattagggaaaacgtaaaaaagttcgttaaccggacgtaacgtaccgttaccggtagggaaacggggtaccgtaacttaccgaaccctaacttcccgtaccccgtaaacctaaccgtaaacttaccgaaagtaaacccaaccgtagttttacgttaccttacgttcgacgtacgaaactcggaccttaggtacgaaagtccgaaagtaccgtaccgtacgttacgttaacttaacgtacctacggttcgtcgggtaccggaccgtaaggaaccgttaaacccggtactttaaaccccggtaaccccgggtaaaacggtaacccggttaaccgggttaccgggggtaaccccgttaaccggggg

SEQ ID NO: 49934 - DNA, 680 bp, Homo sapiens
  misc_feature: GYAE6OF02FY3JZ.49.5.A05.1.454.CMB.1.raw
  modified_base (237)..(237): a, c, t, g, unknown or other
  misc_feature (237)..(237): n is a, c, g, or t
  modified_base (261)..(261): a, c, t, g, unknown or other
  misc_feature (261)..(261): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcgtggtttcgcgtaggctctttaagaggtgtcagtgtcaggtgcagctggtggaggtcgggggaggcgtggtccagccgtgggacgtccctganacttctcctgtgcagcctcgtggntttacattcagttagttatgcttatgactacttggtttacgccggtagggtccgaaggccaagggggtcctgggaggtggggtggcgtaaggtttatagttacgtagtgttaagacgggaaacgaaaaattacgaacgtcgaaggtaacctacccggtagggaaacgggccgtaagtttacaacctactaccgtacccgtaaccgaactaccttaccgaaaacgaacaaccgtagtttacgtttatacctcgtaactcgaaactacgtacgtacgtaagtaacgtacgaccggtacgtaccggtcgtataacgtactacgtactgttcggacggtacgaacggtaaccgaacgtaaccgtttaacccgtaaaccccggtaaggtaaccggttacggtaccggggtaccgtaaacccggg

SEQ ID NO: 49935 - DNA, 665 bp, Homo sapiens
  misc_feature: GYAE6OF02GOSJV.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggagcgtggtccagcctgggacgtccctgacgactctcctgtgcagtcctcgtggatttacgattcgagttagttatgtctagtggtcacgttggtttcgccgtagggtcccgaaggtccgaaaggggtcctgggaggtcggggtggctaggttatagtaccgtagtgagtagggaaaacgaaaatactacgacaacgtacgtcgtaggaacgggaccgtattaccgaaccgtactcccttacccgaacaacctaaacgttaccaaaggaaacctaccgatttcgtttaactacttacgcctaagaaccacgacccgttagaacgttaaggtacgaaccgacgtaaccggtctgtaactacgtacacgttgtaccggaggtccgaggtaccgtaacgtaccgtttaaccaacccggaaaggttacccgtaacggtacggggacccgttaaaccgggg

SEQ ID NO: 49936 - DNA, 770 bp, Homo sapiens
  misc_feature: GYAE6OF02H5XN1.49.5.A05.1.454.CMB.1.raw
  modified_base (240)..(240): a, c, t, g, unknown or other
  misc_feature (240)..(240): n is a, c, g, or t
  modified_base (319)..(319): a, c, t, g, unknown or other
  misc_feature (319)..(319): n is a, c, g, or t
tcagagtcgagagacacgaccggtgctcgatttagatagatagacagggggtctgggagacgagcccagcactggaagtcgccggtgtttccattcggtgatcatcactgaacacagaggactcaccatggagtttgggctgagctgggttttcctcgttgctctttaagaggtgtccagtgtcaggtgcagcgtggtggagggtcggggggaggcgtggtccagccgtgggacctcccnggagactctcctgtgcacgccttcgtggtactttacattcgtaacgtagttactgtctatcgactacgttgggtttccnccggtacgggtccgaacgggcgaaagggggtcgtgggagggttggggtcggactaggtttagtacgtacgttacgtgaacggttaaggaaaaccgtaaaattaccgtacgaactacgggtaccttacggaaggaacgggtaccgtattacccaccgtacttacccgtaccccgaccgtaaactaaccgttaccaaaacgtaaacctaacttaacgttttaccgtttacctacggtacctacgttaaccgaaacgtcggtacccgtaaggtaaccggtaaggtaccgaaaccggtacgtaacccgggttacttagtaaacctttacgtacgacgtttagggaccgggacggtaccgggaaccgtacggttaaaccggtttaaaccttaccgggaaaccccggttacgggtaacccgttacggggtacccggggtaccccggttaaaccgggg

SEQ ID NO: 49937 - DNA, 722 bp, Homo sapiens
  misc_feature: GYAE6OF02GBJ1M.49.5.A05.1.454.CMB.1.raw
  modified_base (193)..(193): a, c, t, g, unknown or other
  misc_feature (193)..(193): n is a, c, g, or t
tcagagtcgagagacacgaccggtgctcgatttagatagatagacagggggtctgggagacgagcccagcactggaagtcgccggtgtttccattcggtgatcatcactgaacacagaggactcaccatggagtttgggctgagctgggtttttacctcgttgcttcttttaagaggtgtccagtgtcaggtncagctggtggagtcggggggagcgtggtccaggcctgggactccctgagacctctccgtgtgcacgcctctggatttacattcagttagttatgctatgctacgttcgggttccgaccgtaggggtcccagggtcggaacgggggtcgtgggtacggttggggtggtacgtaggttttaatacgttacgttatagtaacgtaagggaaaaacgaaaatacgtaacggacaacggtaaccgttacgtacgggaaacgggacctacttacccaaccgtactacccgtaccccgaactaaccgtaaacttaccgaaacgtaacctaccgttattttccgttactacccgtgtacctacgaaacgcgtccgtaggtaactaaggtcaaaccggtaccgaccgggtaatttcggtaacttaacgtccgtacggttggtaccgggccggaaccgtaagggaacccttaaacgtactttaaaccccggacccgggtaaagtaccccgtacggggtaccgggacccgttaacccggg

SEQ ID NO: 49938 - DNA, 708 bp, Homo sapiens
  misc_feature: GYAE6OF02ITB5I.49.5.A05.1.454.CMB.1.raw
  modified_base (263)..(263): a, c, t, g, unknown or other
  misc_feature (263)..(263): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcttgggttttcctcgttgcttcttttaagaggtgtccagtgtcgaggtgcagcgtggtggaggtcggggggagcgtggtccagccgtgggaccgtccctgacgtacctctccgtgtcgcncgccttcgtggtactttacacttacgtagttagttatcgtcttagtcgccttacgttcgggtttaccgccggtacgggtccgacgggtacggtacgggggcgtagggtaggttcggggtgtacgttagttattacgtgtagtggaacgtaaagggtaaaacgtaaaacttcgtaacggactaacgtaccgtacggagggaaccgggtccgttaactaccgaccgtacgtccccgtaacccgaacctaaacgtaaccttaacgaaactaaccttacgttatttacgttacctacgtacgtacgaacgtacgacgtacgtaggaacgtagccggaaccgcgaccgttatagtactacgtacgtcgtcgggacgtcggtaacgacggtaaccaaccgttacctaacccgggaacgtacgtaccggtacggtaccggaccgttaaccgg

SEQ ID NO: 49939 - DNA, 848 bp, Homo sapiens
  misc_feature: GYAE6OF02HJSV9.49.5.A05.1.454.CMB.1.raw
tcagagtcgagagacacgaccggtgctcgatttagatagatagacagggggtctgggagacgagcccagcactggaagtcgccggtgtttccattcggtgatcatcactgaacacagaggactcaccatggagtttgggctgagcgtggtttctcgtgcgtctttaagtaggtgtccagtgtcgaggtgcagctggtggaggtcgggggagtcgtggtccagtccgtgggacctccgtgagtactctccgtgtgcacgtcctcgtcggtactttaaccgtactttacgaacgttagtttacgtaggtaccttagtacggtccgtaaccgttccgggttttaccggcccggtaacgggggtaccccgaaggggtaccggaacgggggtacggtacggggtagggttggggtaggttacgtacggttttattaccggtaagttaagtcgtaaacgttttccggtaaagtttaggttaacggttaacttaacgttaaccggtaacgtaacgggtaacggttaaacccgggtttaacggtacccggtagttaccccgtaaaccgtacggtacctaacccgtagggtaaaccaactaaacttaacccgaacggtaaacccgaaccgttacgtttaccgttacgtaacgtaaccgttaagttacgtaacgaaccgttacgttaacggaaccgttaagggaccgttaagaaccggttacgacccgggttacgtttaacgtagtttaacggtttagtttgggtaaccgttaacggttaaaccggtacgttttacggaaggttaaccggtaaggttttttaaccggttagggtttttaccggaggttttaaaccggg

SEQ ID NO: 49940 - DNA, 688 bp, Homo sapiens
  misc_feature: GYAE6OF02G7V5N.49.5.A05.1.454.CMB.1.raw
  modified_base (363)..(363): a, c, t, g, unknown or other
  misc_feature (363)..(363): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggtttcctcgttgctcttttaagaggtgtccagtgtcaggtgcagctggtggaggtcggggggagcgtggtccagccgtgggaccgtccctgacgacctctcctgtgcagccttcgtggtactttacattcagttagttatgctatgctacgtggttcgccgtagggtcccgaggacgaagggggctgggaggtggggtgcgtagttatagtcgtangtataggaaacgaaaactctaacgcaagtaccgtaccggtaggaaacgggtccgtaacgtaccaaccgtactacccgtaccccgaactaactaaacgttaaccgaaagtaaacctaactacgtttacgtttactacgttgtacctaacgtaacgtacgtaccgtaggaacggtacgtacggaaccgtacgaccgtcgttaagttactaacgtcctacgttggacggcccgggtaagaacgggtaccgtaaaccgttaaccgttaacccgtaaacccggtaaggtaacccggttaaccggttacgggggacccgttaaacccgggg

SEQ ID NO: 49941 - DNA, 563 bp, Homo sapiens
  misc_feature: GYAE6OF02GQZOQ.49.5.A05.1.454.CMB.1.raw
  modified_base (189)..(189): a, c, t, g, unknown or other
  misc_feature (189)..(189): n is a, c, g, or t
  modified_base (265)..(265): a, c, t, g, unknown or other
  misc_feature (265)..(265): n is a, c, g, or t
  modified_base (446)..(446): a, c, t, g, unknown or other
  misc_feature (446)..(446): n is a, c, g, or t
  modified_base (455)..(455): a, c, t, g, unknown or other
  misc_feature (455)..(455): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtncagctggtggagtcgggggagcgtggtccagcctgggactcctgagactctcctgtcgcagcctcgtggatttacnttcagtagttatgctatgctacgttggtttccgctagggtccaggcgaaggggctgggaggtgggtggctagttatagtcgtatgataggaaacaaaagtcacgcagactcgaggaacggccattacacctatccgtcccgaagactaacttccaaagaaccactactttgttactacgtnactagaacngtcctagaagtacgtacgacgacgtacggcttagtaatactcagtggcggcggactacggacgtaacgtacttaaccgaccggaggtactacggcgggacctaacggg

SEQ ID NO: 49942 - DNA, 612 bp, Homo sapiens
  misc_feature: GYAE6OF02GWMIX.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctgggtggaggtcggggggagcgtggtccagcctgggacgtccctgagctctcctgtgcagcctctggtatttacattcagtagttatgctatgctacttgggtttccgccgtaggggtccaggggcaagggggctggggagtggggtggactaggttatagtcgtatgacgtaggaaaactaaaatctacgcagactcgtagaagggcctatcaccatcctacccgactaactaacttccaaagaaccactatttcgttactacttgcttagaacagtcctaggaaggtacgtaggaacctacgaccggtacttagtaatacttacgacgttggtacggccggtacgacggtaaccgtaacgttacgttaacccgtaccggaaaggtaccgtacggtaccggggaccctaaacccgggg

SEQ ID NO: 49943 - DNA, 765 bp, Homo sapiens
  misc_feature: GYAE6OF02IPMF1.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttggctgagctggtttcctcgtgctctttaagagtgtccagtgtcaggtgcagcgtggtggaggtcgggggggaggtcgtaggtccgaggtcctggggacctccctagaagtcctctcctgtcgccagcctcgtggtatttacattcagttagttatgcttacgtgaccgtacgttcggtttccgaccgtaacggggtcccaagggtaccgaaagggggccgtaggggacggtggggttacggacgtaggtttaacgtacgttaccgtaagtgtaaacgtaacggaaaaaaccgtaaaaacgtaccgtaaacggaccgtaaacggtacccttacccgggtaggaaacccggggtaccctaacgtttacccgaaacccgttaccgtacccgttaaccccgaacaaaccctaaacgtttacccgaaaacgtaacctacgttaacgtttacggtttaccctacgttaacgtaccgtagaaacccgagtcccgtaggaaacggtaagtaccggaacgtaaccggtacggacgttaacgtaagtacttacgacgtggtacgccggacgacggaacctaacgtaacgtttaacccgaaccggaaacgttaccgtaaccggcgggtaaccgtaaccggg

SEQ ID NO: 49944 - DNA, 745 bp, Homo sapiens
  misc_feature: GYAE6OF02FUO2F.49.5.A05.1.454.CMB.1.raw
  modified_base (198)..(198): a, c, t, g, unknown or other
  misc_feature (198)..(198): n is a, c, g, or t
  modified_base (609)..(609): a, c, t, g, unknown or other
  misc_feature (609)..(609): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagcgtggnggaggtcggggggagcggtggtccaggccgtgggacgtccctgagctctccgtgtcgcacgcctcgtggtactttacacttcgaagttacgtttatgacttatggctacgtttcgggttccgaccgtaggggttccgaagggtaccggaagggggtcgttggggacgggttggggtcggacgtaggttaagtacgtacgggttaatacgggaagtaaacgggtaaaaaaccggtaaaaaactttaccgtaacggtacctaaacgggtaacccgttaccgggtacggggaaacggggtacccgtaacttaccgaacccgtacgtaccccgttaccccgaaacttaaccgtaaacgttacccgaaaacaacctaataaccgtttgtttaaccacgttcgtaccgagtaaaccncggtacctaggaaggacgtacggaaccgtacgacggtcttaagtactactcgtacgtgtacggcgtacgaggtaccgtaacgttaccgtaaccaaccggggtaactaacggtacggtccggtaacggtaacccggg

SEQ ID NO: 49945 - DNA, 741 bp, Homo sapiens
  misc_feature: GYAE6OF02FMWNA.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggaggtcggggggaggcggtggtccaggccgtggggaccgtccccgtggacgacgtctcctgtcgcacggtcctcgtggtactttactattacgacgttagttatcgtacttatcgtactacgttgggtttccggaccgtacggggtaccgaggtaccggaagggggtcgtgggacgggttggggtcggacgtagttagtagtcggtatacggaagtaacggaaaacgtaaaactacgtaacgacgacgtaccgtaccggtagggaacggtaccgtactaccaaccctaacgttcccgtaacccgacctaacctaaccgttaaccgaaacgtaacctactaagttttccgttaccgtaacgttcgaccgttagaacctacgaccgttaaggtaacggtaacggtacggaaacccgtaccggacgtacttaggtaaaccttagtacctacgttcggtcggaccggtacgacggtaacctaacggtaacttacccggaaaccggtacggttaaccgtaccgggtaccgggtaacccggtaaccggg

SEQ ID NO: 49946 - DNA, 720 bp, Homo sapiens
  misc_feature: GYAE6OF02H4O0N.49.5.A05.1.454.CMB.1.raw
  modified_base (255)..(255): a, c, t, g, unknown or other
  misc_feature (255)..(255): n is a, c, g, or t
  modified_base (262)..(262): a, c, t, g, unknown or other
  misc_feature (262)..(262): n is a, c, g, or t
  modified_base (274)..(274): a, c, t, g, unknown or other
  misc_feature (274)..(274): n is a, c, g, or t
  modified_base (295)..(295): a, c, t, g, unknown or other
  misc_feature (295)..(295): n is a, c, g, or t
  modified_base (427)..(427): a, c, t, g, unknown or other
  misc_feature (427)..(427): n is a, c, g, or t
  modified_base (478)..(478): a, c, t, g, unknown or other
  misc_feature (478)..(478): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcgtggttcgtcgttagcgtctttaagaggtgtccagtgcaggtgcagtctggtggaggtcggggggagcgtggtccaagccgtgggaccgtccgtgagactctcgtcgtgcngaccctntaggtatttacngtacagttagtatacgcttancgtacacgttcggtttcgaccggtacgggtaccaagggacgtaaacggggcgtaggggagggttgggacgtacgtaaggttactagtacggtagtagtaagtaacggaaactaaaaactgtaaccgacgtanaccgtacgtaggaacgggtccctaagttccgacctacgtccgaccccgtanaaccttaaactacctaaacgaactacgttacgtttaccgttcaacgtacgtactaacgggactaaccggtacgttaacggaaacgtaacggtacgaaaccggaccgtaacgggtacttacgtaaaccgtcgttacgaccggttcggttaaggccgggaacgttaccggaacgtaaccgtaacgtttaacccgaacggaaacggtttcccggtaacggttaccggggccgtttaaacccgggg

SEQ ID NO: 49947 - DNA, 734 bp, Homo sapiens
  misc_feature: GYAE6OF02JCMLK.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtgcagctgggtggaggtcggggggagcgtggtccagccgtgggacccgtcctgacgctcgtcctgtgcacgcctcgtaggtatttacatttcgagttagttatgctagtcgctacgttgggtttccgacctacggggtacccgagggtcggaaacgggggccttggggacggttgggggtcggacgtaaggttagtagttcggtatggtaataagggaaaaacaaaatcgtacgacaacggtactaccggtaggaacggggtcctagttccaaccgtacgtccctacccgaactaactaaccgttaccgaaaacgtaacctactaacgtttacgtttacctaccgttcggtaccttaacgaaacctacggtacccgtaggtaaacgtaaggtaccggaaaccgtaccggtaacggtgttagttaacgtacgtaaccgtacgttcggcggtacccggacgtaacgggtaacccgaaacgtttaaccgtaaccctaacccgggaaacggttaccgttaccggggtaccggggaccccgtaaaccgggg

SEQ ID NO: 49948 - DNA, 692 bp, Homo sapiens
  misc_feature: GYAE6OF02IO1M6.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggtttcctcgtgctcttttaagaggtgtccagtgtcaggtgcagcgtggtggaggtcggggggaggcgtggtccagcccgtgggaccgtcccgtagacgacctctcctggtcgcagccttcgtggtaattttaccatttcaagttacgttatcgtactatgcctacgtttcgggtttccgaccggtacgggtcccgagggacgaacgggggtctagggaggttcggggtgacgtaggtttaatagtcgttaacgtagagttaagggaaaactaaaaactacgtaacggacgtaagaccgttacggtaacggaacgggtaccgtaactccgaacctacgtccgacccgacaactaacttaccaaagaacctaacttagtttacgttacctacgtacgactaccgtaactacgacctaggaagtaggtacgaacgacgtacgtacgtagttaatacgtactacgtggcggtacgacgtaaggaccgtaacgtacttaacccggtaccggtaaacggtaccggtaacggtaccgggtaccctaaccggg

SEQ ID NO: 49949 - DNA, 859 bp, Homo sapiens
  misc_feature: GYAE6OF02FSKYO.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctggtttcctcgttgctcttttaagaggtgtccagtgtcaggtgcagctggtggagtcgggggaggcgtggtccagccgtgggacgtccctgagactctcctgtcgacaggcccttcgtgggtacttttaacgtatttccgaaggttaagtttatcggtaccttaattcggcctaaccgttgggggtttttacccgacccgtaacggggggtttcccctaaagggggcccggtaaaacgggggggggtcctttaaggggggtaacggggttgggggggtttaacggggaccttaaacggggttttaactaacggttccggtttaaacgtggtaaacgttaacggggaaaaaaaccgtaaaaaagtttacccgtaaaccggtacgaaacggtaccccgttaacccgggtaaggggaaaccgggtaccgtaactttcccgaaaccgtaactcccggttaccccgaacgtaacctaaacgttaccaaacggtaaaactacgtaacgtttacggttttactaccgttacgtaccgttcgtaaacctacggtaccgttacggaaacggtaaacggtacgtaaacccggaccgtaaaccgggtcttaacgtaagttaacctaccgtacgttacggtacggtccgggactaaccggaccgtaaccgtattaacccgtacccggaaaccggttaaccgtacggtacgggtaccggtaacccggg

SEQ ID NO: 49950 - DNA, 669 bp, Homo sapiens
  misc_feature: GYAE6OF02IONJ8.49.5.A05.1.454.CMB.1.raw
  modified_base (189)..(189): a, c, t, g, unknown or other
  misc_feature (189)..(189): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtncagctggtcggaggtcgggggaggcgtggtccagcctgggactccgtgacgacctctaccgtgtcgcaggtcctctggactttacattccgtagttagtagtgactatgctacgttggtttccggctacgggtcctaaggcgaacggggtcgtacgggagttcggggtagaccgttaggtttaataccgtagtcgtaggtaacgtaacggaaaacgtaaaactcgtacggtactacgacgtcccggtaggaaacggccggtacttacaccgtaattcccgtacccgaactaactaacgttacaaaacggactacgtacttacgttacacgttacggccttagaacctcgaccgtagagtaacgtcgaacgtaccgtaagtcctagtaacctgtctacgtcgtcggacggtacctaacggacgttaaccgtaagtttacccgaacggtacgtaaggttacccggagggtccctaaaccggg

SEQ ID NO: 49951 - DNA, 789 bp, Homo sapiens
  misc_feature: GYAE6OF02FUTWY.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggagcgtggtccagcctgggactccctgagactctctgtgcagcctctggattacattccagttagttatgcttaatgcacgttcggtttccgccgacggggtccaggcgaacgggggtcgtagggaggttcgggggtggacgtaggtttatagttccggtagtggtacgtaagggaaaacgtaaaaagtacgtaacgacgtaacgaccgttcccggtagggaacggggtccctaagttacccgaacctacgttacccgtaaccccgtaaccgaaccttaaacgttacccaaacgtaaaacctaccgttaacttttcggtttaaccttaccgttacggtaccttacgtaaaccgtaccggtaaccgtcggtaaacgggtaacggttacgggtaaacccggaaccggtaaccggggtaccttacggtttaacttaacgttacccgttacggttacggtacgggtccggggtaccgtaacggggtacccgtaaacggtttaacccgttaacccggtaaccccggtaaaccggggttaaccttaacccgggggtacccgggggtaacccgggtaaaccccggggg

SEQ ID NO: 49952 - DNA, 868 bp, Homo sapiens
  misc_feature: GYAE6OF02ICUSM.49.5.A05.1.454.CMB.1.raw
  modified_base (265)..(265): a, c, t, g, unknown or other
  misc_feature (265)..(265): n is a, c, g, or t
  modified_base (278)..(278): a, c, t, g, unknown or other
  misc_feature (278)..(278): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcttgggttttcctcgttgtcttcttttaagaggtgtccagtgttcaggtgcagctggtggaggtgggggaggcgtggtccgagccgtgggaccgtccctgacgactctcctgtgcagtcctntaggtatttaacngttcagtagttactgctatgctagttcggtttccgaccgtacggggtccgacggacggaaacgggggtccgtagggtacgggttggggtacggtacgtaaggtttaattacgttaacggttaagtagggtaaacgtttaaagggaaaaaaccgttaaaaaacgttaaccgttaacggaaccgtaacgaaccgtttaccggtacgggtaaacggggtaccccgtttaacgttacccgtaaaccgtacctttccccggtaacccccgaaaacgaacccgttaaaacgttaaccccggaaaagtaaaaaccctacgtttacgtttaccgtttttacccgtaacgttacgtaaccgttaccgggttaaacccaaccgttaccgggtaacggtaaaacgggttaaccggtaaccgggaaccgtaaacccgtacggggttaccttagtaaaccggttaccttacgaacgtttcgggtaccgggccggtaaccggaggggtaacccttaaacggtaaccggtttaaacccggtaaacccgggttaaagggacccgttttaacccggggaccgggggtaaccccgttaaacccggggg

SEQ ID NO: 49953 - DNA, 161 bp, Homo sapiens
  misc_feature: GYAE6OF02FLEYK.49.5.A05.1.454.CMB.1.raw
  modified_base (156)..(158): a, c, t, g, unknown or other
  misc_feature (156)..(158): n is a, c, g, or t
  modified_base (160)..(161): a, c, t, g, unknown or other
  misc_feature (160)..(161): n is a, c, g, or t
tcagagtcgagagacacgaccggtgctcgatttagatagatagacagggggtcaagctcacctgcactctgaacggtcagcccaaggctgccccctggtcactctgttcccaccctcctctctctcgactctgagcgggctggcaaggcgcatagnnntnn

SEQ ID NO: 49954 - DNA, 693 bp, Homo sapiens
  misc_feature: GYAE6OF02HRDKR.49.5.A05.1.454.CMB.1.raw
  modified_base (156)..(156): a, c, t, g, unknown or other
  misc_feature (156)..(156): n is a, c, g, or t
  modified_base (192)..(192): a, c, t, g, unknown or other
  misc_feature (192)..(192): n is a, c, g, or t
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
  modified_base (300)..(300): a, c, t, g, unknown or other
  misc_feature (300)..(300): n is a, c, g, or t
  modified_base (337)..(337): a, c, t, g, unknown or other
  misc_feature (337)..(337): n is a, c, g, or t
  modified_base (344)..(344): a, c, t, g, unknown or other
  misc_feature (344)..(344): n is a, c, g, or t
tcagagtcgagagacacgaccggtgctcgatttagatagatagacgagggggtctgggagacgagcccagcactggaagtcgccggtgtttccattcggtgatcatcactgaacacagaggactcaccatggaggtttgggctgagctggtttccncgttgctctttagaggtgtccagtgtcaggtgcagntggtggaggtcgggggagcgtggtccagccgtgggaccgtcctgagactctctgtgacgngcctctggtatttacnttcagtattagtgctatgctacgttcggttcncgtaggtccaggcgtaagggcgtaggcgtggggtcgntagttangttcgtagtgtaagtaacggaaaactaaataccgtacgacgtagtaacccgtcggtaagggaaccggtaccgtacttacccgaaccgtacgtcccgtaaccccgactaaactaaccgttaacgaaacctaaacgtaccgtttattccggttaacctagttaccggtctaaacggactaaccggaccttagggaaacgttaggtccgtaaaccggtacgaccggtgttaagttaaactcgttacccggtacgtcggtggaaacccggtcggttaacgaaccggtaacgttaacggttaaccccgaccggggtaagttaccccgtaacgggccccgggtaccgtaacccgg

SEQ ID NO: 49955 - DNA, 748 bp, Homo sapiens
  misc_feature: GYAE6OF02GB4QK.49.5.A05.1.454.CMB.1.raw
  modified_base (255)..(255): a, c, t, g, unknown or other
  misc_feature (255)..(255): n is a, c, g, or t
  modified_base (257)..(257): a, c, t, g, unknown or other
  misc_feature (257)..(257): n is a, c, g, or t
  modified_base (308)..(308): a, c, t, g, unknown or other
  misc_feature (308)..(308): n is a, c, g, or t
  modified_base (357)..(357): a, c, t, g, unknown or other
  misc_feature (357)..(357): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggttgtccagtgtcaggtgcagcgtgggtggaggtcggggggaggcgtggtccagcctgggaccgtccctgagactctcctgtncngcctcgtgattacattcagttagttatgctatgtcctaagttcgggtttcnccggtacgggtaccgacgggccgaaagggggccgtgggtacggtggggngtacgtaggttacttacggtcgtagtacgtaaggtaacgggaaaaactaaaaagttacctaacggactaacggaccgttaccgggaggaaccgggtacctacgttaccaccgttaactcccgtaacccggtaaccaacctaaaccttaccgaaaaacgtaacctaaccgtttagttttaccgtttaacctaacgttacggtaacccgtaaggtaaaccgacgttaccggtagtaaacggaacggttacgaaaccggtaccggaacggtccttaaggtacttactacgtacgtcggtacggccggtaacgaccggtaaccgtaacggttaacccgttaacggaaccggttaaccggtacttaccggggtaccgggtacccggttaacccggg

SEQ ID NO: 49956 - DNA, 650 bp, Homo sapiens
  misc_feature: GYAE6OF02H8M7Z.49.5.A05.1.454.CMB.1.raw
  modified_base (191)..(191): a, c, t, g, unknown or other
  misc_feature (191)..(191): n is a, c, g, or t
  modified_base (303)..(303): a, c, t, g, unknown or other
  misc_feature (303)..(303): n is a, c, g, or t
tcagagtcgagagacacgaccggtgctcgatttagatagatagacagggggtctgggagacgagcccagcactggaagtcgccggtgtttccattcggtgatcatcactgaacacagaggactcaccatggagtttgggctgagctgggttttcctcgttgcttcttttaagaggtgtccagtgtcaggtncagctggtggaggtcggggggagcgtggtccagccgtgggaccgtcctgagactctcctgtgcagcctctggatttacattcagtagttatgactatcgctactggtttccncgtagggtccagggcgaaggggctggagtgggtgctagttatatcgtatgagtaggaaaacgtaaaatacgtaacgactagaacctcggtaggaacgggtccattaccgaccgtactaccctacccgacctaactaaactaccaaacgaaacaactactttacgtttacctacttcgtacgtagtaacctacgacgtacgaacggtaacggtacgaacggacgaccggtaccgttaggtaacttatacctacgtcgttacggcggtacggaccggaacgtaacgtaaccgtttaaccgaacccgggtaacgtaaccggtaaccggtaccggggacccgtaaaccggg

SEQ ID NO: 49957 - DNA, 874 bp, Homo sapiens
  misc_feature: GYAE6OF02JY9EX.49.5.A05.1.454.CMB.1.raw
  modified_base (297)..(297): a, c, t, g, unknown or other
  misc_feature (297)..(297): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcttggggttttcctcgttgctctttaagaggtgtccagtgtcaggtgcagctggtggaggtcgggggagcggtggtccagccgtgggaccgtccctgagacctcgtcctgtcgcagcctcgtaggtactttacacttcagttagttatgcttancgctacgttcggttccgaccgtagggtccgagggtcgtaacgggggctaggggtacgggttcgggggtcggacgttaaggtttaacgtacgtacgggttagtacggtaaacggttaacgggaaaaaccgtaaaagttccgtaacggaccgtaacggtacccgttaccgggttaacggaaaccggggtaccgtaacgttaccgaacccgtacgttaccccgttaccccggaaactaacccgtaacgttaacccgaaacggtaaaccaccgtttaactttacggtttaacctacgttacgggtacccttaaacgggaaacctaccggtaccgtagggtaacccggttaaggtaccgggtaaacccgaaccggttaaccgggttaccttaaacggttaaccgttaacgttacccgttaacggttcggggtttacccggaaccggggttaacccgtaacgggtaacccggttaaaacccggtttaaccgttaaacccccgggtttaacccggggaaaacccggtttaacccgggtttaaacccggggttaccccggggggtaaccccgttaaacccggggg

SEQ ID NO: 49958 - DNA, 780 bp, Homo sapiens
  misc_feature: GYAE6OF02G5A78.49.5.A05.1.454.CMB.1.raw
  modified_base (702)..(702): a, c, t, g, unknown or other
  misc_feature (702)..(702): n is a, c, g, or t
tcagagtcgagagacacgaccggtgctcgatttagatagatagacagggggtctgggagacgagcccagcactggaagtcgccggtgtttccattcggtgatcatcactgaacacaggaggactcaccagtggagtttgggctgagcgttggtttcctcgttggcttctttaagaggtgtcctagtgtcaggtgcagtcgtggtgggaggtcggggggagcgtggtccaggtccgtgggacgtccctggatacctcctccgtagtcgctacgtcctagttaggtactttacacgttacgagttacgttactgtaccttaagtcggtccgtacgttacgggttaccgaccggtaacggggtcccgagggtccgaaacggggtcgtgggagggttggggtacggactaacggttatacgtacgtataacggtacgtaacggaaaacggttaaaacgtacgaacgtaacgacgtaaacgttcccggtagggtaaacggtaccgtaaacgtttcccgaaccgtaacgtttccccgaaaccggttaacctaacctaaccttaaaccgaaactaaaccgtaacgttaactttaacgttcctaacggttacgaaccgtttacgaacgtccgtaacgtcggtaaacgtacggtagaaccgtacgaccggttacgaagttacctaacgttcacggttgacggtaaccggtntaaacgtccggtaaaacgttccgtaaaccggttaccggaaaccggttacggtccggtacggggttaccctaacccggg

SEQ ID NO: 49959 - DNA, 750 bp, Homo sapiens
  misc_feature: GYAE6OF02IIKQY.49.5.A05.1.454.CMB.1.raw
  modified_base (235)..(235): a, c, t, g, unknown or other
  misc_feature (235)..(235): n is a, c, g, or t
tcagagtcgagagacacgaccggtgctcgatttagatagatagacagggggtctgggagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtgaggtcgggggagcgtgtccagccgtgggacctcccngacgacctctcctgtgcagtcctgtggtatttacattcgagttagttactgacttaatcgctacttgggtttcgaccgtagggtcccagggtacaagggggctgggaggtgggtcggtactaagttatatcgttaagtgaagttacggaaaaccgtaaaaattaccgtaaggactaaaggtaacctccggtaaggaaaccggggtacctaacgtttaccgacctaacgtaccctaaccccgaactaaccgtaaactttaacccaaaggaaacctaaccgttaagtttaccgttttaccgtaaccgttcgtaccgttacggaaaacaccggtaccgtacggtaacggttaaagtacggtaacgaaccgtaaccggggtcttaacgggttaaattaccgttacgtacgttggtaccgggtacggaccgtaacggggaaccttaaacggtaaccgtttaacccgtaacccgggtaaacggtacccgtaacgggttaccggggacccttaaacccgggg

SEQ ID NO: 49960 - DNA, 745 bp, Homo sapiens
  misc_feature: GYAE6OF02ISLYS.49.5.A05.1.454.CMB.1.raw
  modified_base (623)..(623): a, c, t, g, unknown or other
  misc_feature (623)..(623): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagcgttgggttttcctcggttgcttcgttttaagaggtgttccagtgtcaggtgcagctggtggaggtcgggggaggcgtggtccagccgtgggacctcccctgagacctctcctgtgcacgtcctcgtaggtatttaccatttcgagttagttatcggtcttatggcctaacgtttcgggttttccgaccggtacggggttccacgggtacggaaacgggggcgtttaggggaggtttgggggcggacgtaaggtttaataccgttgtaagtgaacggtttaaaggaaaaacgtaaaaataccgacggtaacacgtaccttcccggagggaacggtccgttaattcccaaccgaccgttacccgtacccccggaaactaacccgttaaaccgttaacccaaaacggtaaacctacgttacgttttacgtttaccttactccggtacctaagaaccaccggtcgttaaggaaggaaccgtanaccggtaccgtaacggtccttaaggaactttacgcgacgtttgccggaacgtacaggaaccgttaacgtactttaaccccggaaccggagttaacccggcgggtacgggtaccccgaacggg

SEQ ID NO: 49961 - DNA, 681 bp, Homo sapiens
  misc_feature: GYAE6OF02GN9RN.49.5.A05.1.454.CMB.1.raw
  modified_base (594)..(594): a, c, t, g, unknown or other
  misc_feature (594)..(594): n is a, c, g, or t
tcagagtcgagagacacgaccggtgctcgatttagatagatagacaggggtctcgggagacgagcccagcactggaagtcgccggtgtttccattcggtgatcatcactgaacacagaggactcaccatggagttgggctgagctgggttttcctcggttgctcttttaagaggtgtccagtgtcgaggtgcagcgtggtggaggtcggggggagcgtggtccagcctgggcgtccctgagtactctctgtgctacgcctgtggatttacattcgagttattagtgactagtgtcacgttcggttccgccgtagggtaccagggaccaaggggtcctagggagtggggtcggtactaggttaactacgtaccgttagtcggaagttaacgggaaaaactaaaacttccgaacgacgaacgtaccgtttccggaagggtaacggggtccctaagtcccaacgtaacttccccgacccgaactaaccgtaacttacccgaaacgacctaaccgtatttcggtttacctacggcgtacgtagaacacggtcgtaagacgtaacgtacgaaccgtacgaacgtctaattacgtacctnaacgttcggtaccgcggtaccaggtaacccgtaattaccgtaacccgtaccggaaaggtaccgtaccgggtcggtacccgtaaacgg

SEQ ID NO: 49962 - DNA, 872 bp, Homo sapiens
  misc_feature: GYAE6OF02IK46C.49.5.A05.1.454.CMB.1.raw
  modified_base (228)..(228): a, c, t, g, unknown or other
  misc_feature (228)..(228): n is a, c, g, or t
  modified_base (426)..(426): a, c, t, g, unknown or other
  misc_feature (426)..(426): n is a, c, g, or t
tcagagtcgagagacacgaccggtgctcgatttagatagatagacaggggtctgggagacgagcccagcactggaagtcgccggtgtttccattcggtgatcatcactgaacacaggaggactcaccatggagtttgggctgagcgttgggttttcctcgttgcgttacttttaaggcggttgtccagttgtcaggtgacaggtcgtggtacggacgggtcggggggnggtccggttacgggtcccgaaggtccgttacgggggacccgttcccggtagaacggtaccttccgttccgtggtgacccgtacggtcccttaggtaccggtaattttaccaagttccgaagttacgttaatcggtacttagtcgccttacgttcggtttaccgaccggtaagggttcccgaaggtaacgaccggggtntaagggtcgggttcgggtacgtaggtaacgtttagtaaccggttagtacggtacggaaagttaacgggaaaaaaccgtaaaattcccgtaaacggctaaccggtaacgtcccggttaaaaggaccgggtacctacctaaccgaacgtaccggtacctacccgggaaacctaagttaaacccacggtaaaacaacgtaccgtttaaacgttcgtttacccgtacgttacgtacgtaccggaaacgtaaccgtacgtaaacgggtaagttaaccggataacccgggtaaccgacgttaacccggttagtaacccgttaaactaccggtaccgttaacgggtacccggaacccggtacgtaaccggttaaccgtaaacgtaacccggttaaacccgaaccggggttactaacgggttaccccgggaccgggggtaaccctaaacccggg

SEQ ID NO: 49963 - DNA, 728 bp, Homo sapiens
  misc_feature: GYAE6OF02FO1N3.49.5.A05.1.454.CMB.1.raw
  modified_base (176)..(176): a, c, t, g, unknown or other
  misc_feature (176)..(176): n is a, c, g, or t
  modified_base (291)..(291): a, c, t, g, unknown or other
  misc_feature (291)..(291): n is a, c, g, or t
  modified_base (444)..(444): a, c, t, g, unknown or other
  misc_feature (444)..(444): n is a, c, g, or t
  modified_base (635)..(635): a, c, t, g, unknown or other
  misc_feature (635)..(635): n is a, c, g, or t
tcagagtcgagagacacgaccggtgctcgatttagatagatagacgagggggtctgggagacgagcccagcactggaagtcgccggtgtttccattcggtgatcatcactgaacacagaggactcaccatggagtttgggctgagtcttgggttttcctcgttgcttcttttaagnggtgtcagttgtcaggtgcagtcgtgggtgggaggtcggggggaggtcggtggtccgacggccgtgggaccgtcccgtgacgctctccgtgtcggcacgcctctaggtatttacnttcgagtttaggttactggtacttatcgacgtacgtttcggttaccgcggtacgggtccgagggaccggaagggggtctaggggaggtgggggttcgtagtaggttactacgttaggtatacggtagttaacgaaaacgtaaatcgtaacganaacggttacgtcggtacgggaacggtcctagttccaccgtacgtaccctaccgacctaacgtaccttaaccgaacgtaaccttacgtagtttaccggtttacacgttacgtcgtaaccgtaaacgtgccggttaagacggtaagtacccggaaggaccgtcgtaacggtgtttaacgtactaccgggttancggttaccgggcggtaccggtagaaccgttaacgtaacccggttacggtaaccggtaaggtcccggtaacgggtaccggggtacctaacgggg

SEQ ID NO: 49964 - DNA, 803 bp, Homo sapiens
  misc_feature: GYAE6OF02JK4UL.49.5.A05.1.454.CMB.1.raw
  modified_base (286)..(286): a, c, t, g, unknown or other
  misc_feature (286)..(286): n is a, c, g, or t
  modified_base (299)..(299): a, c, t, g, unknown or other
  misc_feature (299)..(299): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgcttcgttttaagaggtgtcctagtgtcaggtgcagcgtggtggacggtcggggggaggtcgtggtccaggccgtgggaccgtcccgtaggacgacctcctcctggtcgcacgcctgtggtattacnttacgattagttntagtctatgctacgttcggtttcgccgtacgggtccgaggtacggaacgggtcgtacggggtaggtcgggttggacgttagttaatagttacggtagtaggtaacgtaaacgggtaaaacgtaaaaacgttaccgtaaacggtacgtaacggtacccgttaccggtaagggtaacggggtaccctacgtaccgtaacccgtacgtacccgtacccggtaaaccgtaaccttaaccgtaacccgtaaacgtaaaccgtaacctttaacgtttacccgtttaccgttaaccgttacgtaaccggtttacgaaaccgtacggtacccgtaaggtaaaggttaacccggtaacggtaacccggtacgtaaaccggtacggtaaagtaccgttaacgtacgtacggtgtaaccggcggtaaccggtaggaacctttaacggtaaccgtaacccggttaaacggtaccggttaaacccggtaacgggttacggtaaaccccggtaaccgg

SEQ ID NO: 49965 - DNA, 751 bp, Homo sapiens
  misc_feature: GYAE6OF02FXUQ0.49.5.A05.1.454.CMB.1.raw
  modified_base (163)..(163): a, c, t, g, unknown or other
  misc_feature (163)..(163): n is a, c, g, or t
  modified_base (171)..(171): a, c, t, g, unknown or other
  misc_feature (171)..(171): n is a, c, g, or t
  modified_base (189)..(189): a, c, t, g, unknown or other
  misc_feature (189)..(189): n is a, c, g, or t
  modified_base (191)..(191): a, c, t, g, unknown or other
  misc_feature (191)..(191): n is a, c, g, or t
  modified_base (200)..(200): a, c, t, g, unknown or other
  misc_feature (200)..(200): n is a, c, g, or t
  modified_base (584)..(584): a, c, t, g, unknown or other
  misc_feature (584)..(584): n is a, c, g, or t
  modified_base (643)..(643): a, c, t, g, unknown or other
  misc_feature (643)..(643): n is a, c, g, or t
tcagagtcgagagacacgaccggtgctcgatttagatagatagacaggggttctgggagacgagcccagcactggaagtcgccggtgtttccattcggtgatcatcactgaacacagaggactcaccatggacgtttgggctgagctgggtttcctgttgctnttttaagnggttgtcagtgtcaggtncngcgttgggnggaggtccgggggggagcggtggtccaggtccgtggggaccgttcccgtgaagtccttcctcgttgtcggcaccgtccttacgtaggtactttaacctagtttcgaacggtttaagttactcggtcttactcggtactaacgtttcgggtttacccgcccggttaagggttcccgaaggggtcgaagggggtcctaggggtacgttgggggtcgacgttaaggttactagtcgttagtggtaacgtaaggaaaactaaactcgtaacgacgtacgtacccgtacggtaacggacgggtaccgtactaccgaactaccggtacctaccccggaataacttacgtaaccgaaaacgtaccctaagttacgtttttacgttaccctntacgggttacctaaggaacctcggacgtacggaagtaacgacgacctcgaaaccggttntaccgtatacgtcgtagtcggtcgtaacggactaaccggtaacgtaaccgtaagtaccccggtaaacggttaccggtacccggtacgggtacccggtaggtaaccccg

SEQ ID NO: 49966 - DNA, 800 bp, Homo sapiens
  misc_feature: GYAE6OF02IOWYJ.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgctcttttaagaggtgtccagtgtcgaggtgcagcgtgggtggagggtcggggggaggtcggtggtccgaggtccgtcggggaccgtccccgtggacgtacctccgtccgtggtgaccgcgtccgttcgtggtaactttacgacttacgtaagttacgtttatcggtcttaagtcgactacggtttcggtttccgacccgtagggtacccgtaagggacggaacggggtcgtagggtaggtggggtacggacgttaagttacgtacttcggtaacgtaggtaaagtaaagggtaaaaaccgtaaaaagtttaccggaaccggtactaaacggtaccgtttaaccgggtaacgggtaaaccggggtaccgtacgtttaccctaaaccgcgtttaccccggtaacccgaaaccgtaaacctaacgttaaacccaaagtaaaccctaagttactttacggtttaccaacttacggtactaacgaacgtacgtaccgtaacggtaaacggtaacgtacggaaccggtaacgacgtacgtagtaacttacgaccgttacgtaggtcggaaccggtcacggtaacctaacgttaacttaaccggaaccgtaaccggtaacgtcccgggtaccgggacgtaacccggg

SEQ ID NO: 49967 - DNA, 723 bp, Homo sapiens
  misc_feature: GYAE6OF02HUNNU.49.5.A05.1.454.CMB.1.raw
  modified_base (174)..(174): a, c, t, g, unknown or other
  misc_feature (174)..(174): n is a, c, g, or t
  modified_base (192)..(192): a, c, t, g, unknown or other
  misc_feature (192)..(192): n is a, c, g, or t
  modified_base (343)..(343): a, c, t, g, unknown or other
  misc_feature (343)..(343): n is a, c, g, or t
  modified_base (493)..(493): a, c, t, g, unknown or other
  misc_feature (493)..(493): n is a, c, g, or t
  modified_base (523)..(523): a, c, t, g, unknown or other
  misc_feature (523)..(523): n is a, c, g, or t
tcagagtcgagagacacgaccggtgctcgatttagatagatagacaggggtctgggagacgagcccagcactggaagtcgccggtgtttccattcggtgatcatcactgaacacagaggactcaaccatggagtttgggctgagctgggttttcctcgttgcttcttttaaagnggtgtccagtgtcaggtncagctggtcggacggttcgggggggagcgtggtccagccgtggggacctccctgacgacctctcctgtacgcacgcccttatggtatttacgattcgtagtgtatgctatgctattcggttcgcgtacggtcagggcaaggggtcacgggnggtgggtacggcttaagttacgtatccggtatgtagtaaggtaaaaaccaaaagttccgtaagtccgaagtacccggttacggtaacgggaaccgggtccgtaatacccgaacctctacccggacccgtactaaccgtattacccgaaanaacctacgtattttcgtacttacgacgttnaacgacgtacttacccgagtaacgtacggtcgaaacggtacccgtccgtacgggtttaacttaaccgtcgttactacgggtttcggtacccgggacgggttaaccgaacggggtaaccctaaacccgtttaagttaccccccggaaaccggttacgggaaccctttaccgggggttacgggccccggtttaaaaccgggg

SEQ ID NO: 49968 - DNA, 998 bp, Homo sapiens
  misc_feature: GYAE6OF02JVFMY.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccagtggtagtttgggctgagcgttgggttttcctcgttgtcttacgttttaagacggtgtccgaggtcgtacgtagggtcgcaggtcgttgggtgggacggggtcggggggggaggtccggtcgggtcccgtaggtcccggtacggggtaccgttcccgtagaacggtacccgttccgtacccgttggtcgacctaccggtaccttcggtaggttatttacctattacgtaacggttagttacgtcgtaccttagtcgtaccttacgggttccggttccggacccggtcgggtccgtaaggggccggtaagggggtcgtagggtcgggtcggggtagtaccgttaagttaagtacgttaacggttaagtacggtaaaggtaacggtaaaaaccgaacgttacgacggtacgtaaccgtagttacccggggtaggtaaccgggtaccgtaactaccggaacctaccgtcccccggtaacgtaaaccaaccgttaaaccgttaaacccgaaagttaaccccgttaactttaaccgggtttaacgttttccccgtaaaggttaccggggtaactttaaaacccccgggtaaacgtttaaccgggttaaccggttaaccgggggtaaaacggtttacccgggaaccggttaaccccggtaaccggtaaccgggttccttaaaccgggttttaaccgtaccgttaccggtaccgggttttaccggaaccccggggtacggtaaccggggtaaacccgtaaccccgggtttaaaccgttaaacccccgggttaaacggtttaaccccgggtaaaccggttaaacccgggggttttacccggggaaccccgggggtttaaccccggttaaaccccggggg

SEQ ID NO: 49969 - DNA, 691 bp, Homo sapiens
  misc_feature: GYAE6OF02F8IJI.49.5.A05.1.454.CMB.1.raw
  modified_base (155)..(155): a, c, t, g, unknown or other
  misc_feature (155)..(155): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttccncgttgctcttttaagaggtgtccagtgtcaggtgcagctggtggaggtcggggggagcgtggtccagcctgggactccctgagctctcctgtgcagcctctggatttacattcagttagttatgctagtgctacgttgggtttccgaccgaggggtccaagggcgaagggggcctggggtaggtggggtcggctaggtttataagttcgtaatggaagtaaggaaaacgtaaaatacgtaacgactaacggtaacctcgggtaaggaacggggtcctaattccaaccgtacttccgtaaccccgaactaacctaaacttacccgaaagtaaccctaacgttagttttcggtttaacctaaccggtgtaccgttaacgaaacgtcgtaccgttaggaacgtacggtacgaaccgtacgacgggtcttaggtaactactcctagtggtcgccgggataacgggacctaaacgttaccgttaaacccggtacccggtaaaggtaccgttaaccggggtacggggaccctaacccggggg

SEQ ID NO: 49970 - DNA, 777 bp, Homo sapiens
  misc_feature: GYAE6OF02JMDUK.49.5.A05.1.454.CMB.1.raw
  modified_base (171)..(171): a, c, t, g, unknown or other
  misc_feature (171)..(171): n is a, c, g, or t
  modified_base (175)..(175): a, c, t, g, unknown or other
  misc_feature (175)..(175): n is a, c, g, or t
  modified_base (178)..(178): a, c, t, g, unknown or other
  misc_feature (178)..(178): n is a, c, g, or t
  modified_base (187)..(188): a, c, t, g, unknown or other
  misc_feature (187)..(188): n is a, c, g, or t
  modified_base (211)..(211): a, c, t, g, unknown or other
  misc_feature (211)..(211): n is a, c, g, or t
  modified_base (712)..(712): a, c, t, g, unknown or other
  misc_feature (712)..(712): n is a, c, g, or t
tcagagtcgagagacacgaccggtgctcgatttagatagatagacagggggtctgggagacgagcccagcactggaagtcgccggtgtttccattcggtgatcatcactgaacacagaggactcaccatggagtttgggctgagcttgggtttcctgttgcttctttaagnggtntcngtgcgagtnnagtcgtggtggagggtcgggggngcggtggtccagccgtgggaccgtccgtgagacctctccgtgtcgacacgtcctcgtgtacttttacgacgttcaaaggtttagttaatgtccgttaattgtaccgtacggttacggtttaccggaccggttaccggggtacccaggggtacgacgggggtaccgggtaggggaggttcgggggtacgtacctaaggtttaacttgtaccggttaagtacgggtaaggttaaacggggaaaaaacttaaaaacgttaccgttaacgggaccgtaacgtaccgggttaacccgggtaaggggtaaacgggtccgaaaccgtttacccgtaaccgttacccttacccggtaaccccgtaactaaacccggttaaaccttaacgaaaccgtaaccgtacttagtttcggttaaccttaagtccgtacgtaactacgaccgtcgtaacgacgtaactacgaccgtacgacgtgttaatactacgtacgtatcggtacggtaccgnggtaacgacgaacgttacccgtaacgaaccccgtaggtaacggttccggaccggaaccgtaccgg

SEQ ID NO: 49971 - DNA, 712 bp, Homo sapiens
  misc_feature: GYAE6OF02GG3WC.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggagtttgggctgagctgggttttcctcgttgcttcttttaagaggtgtccagttgtcaggtgcagcgtggcggaggtcggggggaggcggtgggtccagccgtgggacgtccctgagtactctcctggtcgcacgcctctggtactttacatttcaagttagttatgtctatgctacgttggtttccgaccgtacgggtccagggacgaacgggggtctgggaggttggggtcggcgtaggtttagtacgttcgtatggtaagtaaaggaaaaacgtaaaactacgtacggacacgtacgtccggtaggaaacgggtcctagttaccacctaacgtccctaacccgaactaaccgtaacgttaacccgaaacgaaacctacttacgtttaacgtttaccgttacgttacgtacttacgaaacctcgggtaccttaggaacgtaggtacgacgtaaccgcggtaactacgttaactatccgtacgttcgttaccggcggtaaccgacgggtaaccctaacgttaaccgttaacccgtaaccggtaacggtaacccttaccggggacggggtcccgtaaaccggg

SEQ ID NO: 49972 - DNA, 662 bp, Homo sapiens
  misc_feature: GYAE6OF02GTU6B.49.5.A05.1.454.CMB.1.raw
  modified_base (172)..(172): a, c, t, g, unknown or other
  misc_feature (172)..(172): n is a, c, g, or t
  modified_base (192)..(192): a, c, t, g, unknown or other
  misc_feature (192)..(192): n is a, c, g, or t
  modified_base (394)..(394): a, c, t, g, unknown or other
  misc_feature (394)..(394): n is a, c, g, or t
  modified_base (412)..(412): a, c, t, g, unknown or other
  misc_feature (412)..(412): n is a, c, g, or t
  modified_base (485)..(485): a, c, t, g, unknown or other
  misc_feature (485)..(485): n is a, c, g, or t
  modified_base (492)..(492): a, c, t, g, unknown or other
  misc_feature (492)..(492): n is a, c, g, or t
  modified_base (518)..(518): a, c, t, g, unknown or other
  misc_feature (518)..(518): n is a, c, g, or t
  modified_base (544)..(544): a, c, t, g, unknown or other
  misc_feature (544)..(544): n is a, c, g, or t
tcagagtcgagagacacgaccggtgctcgatttagatagatagacgaggggtctgggagacgagcccagcactggaagtcgccggtgtttccattcggtgatcatcactgaacacagaggactcaccatgggagtttgggctgagcgtggtttccgtcgtagctctttaagnggtgtcagtgtcaggtgacngcgtgggtcggagggtcggggagtcgtgtccgaggtcctgggaccttcaggatcctcgtccgtgtgcacggtctcgttagtacttacaagttgtataggttactgtcctagtcgactaggttccggttgaccgttaacgggccgaaggtcggaaaggcggttaggacgttggggctaagagtttacagtcggtataccgtanaaaggaaaaccaaagttnaacggtcaagcgtaccggtggaacggtctaatcgaactccgtacgaccgaactactaacgagaacaaccttanaggtttntaccgtaactgacgtaagactaccgngtaaagcgaaagcccgaacggtaacngtaagtacctaggtactcggcttacggacccgaggaccgttaaagtaacccgtaaacgttccggttaaaaccgacccgggttaaagacccttaccggggtaccgacccggtaaaccgg

SEQ ID NO: 49973 - DNA, 854 bp, Homo sapiens
  misc_feature: GYAE6OF02G1APC.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccagtggtagtttgggctgacgcttcgggttttccctcggttgaccttacgttttaaggaggtgtcctaggtgtcgaggtgaccagcgtgggtgggagggtcgggggggacggcggttggtccaggtccgtggggaccgtcccgtaggacggtacctcttccgtgtgaccacgcctcgtaggtaactttacctattacgtagttaagttactggactatacgtcgtacgttcggttcgacccgacgggtacgacgggtacggaacgggtcggtcgggtaggttgggggtaggtaccggttaaggttaacgttacgttaccgttaaggttagtaaacggtaaacgggtaaaaaacgtaaaaacttaacgaaccggtaccggtaacgtaccgttacggaacgggtaacgggtaccgtactaacctacgtacctacccttaccgaactaaacgtaaccttaaccgaaacgtaaaccaacgttattaccgtttactaacgtacgtccgaagtaccgactacccgtaagggaacgtaacgggttacccgaaccggtaaccgaacccgggttattaacgttaaaccgttcggtaaccttacgtagggtaccggacccgggaacggtaacccgggaaacaaacccgggtttaacccttaacccgggaaaacccccgggttacggtaaacccgggtttaacccggtacccgggggtaaccccgggttaaaaccccggg

SEQ ID NO: 49974 - DNA, 781 bp, Homo sapiens
  misc_feature: GYAE6OF02JUE2C.49.5.A05.1.454.CMB.1.raw
  modified_base (182)..(182): a, c, t, g, unknown or other
  misc_feature (182)..(182): n is a, c, g, or t
tcagagtcgagagacacgaccggtgctcgatttagatagatagacaggggtctgggagacgagcccagcactggaagtcgccggtgttccttttttatcggtgatcatcactgaacacagaggacctcaccatgggagtttgggctgagtcgttgggttttcctgttgacgttcgtttaagnggtgtccaggttgaccgagggtgtccagcggttggtagggacgggtcgggggggacggtccggtacggtcccagtcccggtagggaccgtcccgtggacgtaccttcgtcccgttaggcgccggtaacctccgttaggtcggtttaacgtttactaacgttctaaggtttacgtttaagtccgtctaactcgtacgtaccgtttcgggtcccgaccgggtacggtaccgtagggtacgggtaacgggtcggtaggggtggtcggggtacgtacgttaggtactcgtacgtaggtagtaagtaaacgaaacgtaagtacgacgtaagtaccgacggtacggaggaacccggtactacgtacccacgtaccgtaccgaaccaaccgtaacctaacctacgaacctaacgtacgttattacgttacacgtcgtactaccgggtacaccgttgtaccgaagtacggacctaacggacccgttaaccgttctaacgttacgtaaccgttcgtacgttcgggaccggtcggtaccggacgtaacgttaaacgtaccggttaccgaacggtacggtaccggtacgggacccggtaccgttaaccgg

SEQ ID NO: 49975 - DNA, 868 bp, Homo sapiens
  misc_feature: GYAE6OF02HUJ8U.49.5.A05.1.454.CMB.1.raw
  modified_base (196)..(196): a, c, t, g, unknown or other
  misc_feature (196)..(196): n is a, c, g, or t
tcagagtcgagagacacgaccggtgctcgatttagatagatagacaggggtctgggagacgagcccagcactggaagtcgccggtgttccattcggtgatcatcactgaacacagaggactcaccatggagtttgggctgagcttgggttttcctcgttgcttactttaaggaggttgtaccgagtgtcgtaggtncgtagtcgtgggtgggtacgggtcgggggggaggcgggttcggtacccgaggtcccggtaggggtaacccgttcccgtggaacgtaccgttccttcccgtgtcgacgtacgtcctacgtggtactttacctattacgtaagttaacgttgtagtacttagtcgtacttaccggtcggttttccggaccggtaaccgggtccgaacggggacggtaacggggtccggtaggggtacgggttacggggtacggtacgtttaaggttaacttaggtaccggttaagttaccggtaaagtaaaccgggtaaaaactaaaacgtacccgaaaccggtacgtaacgaaccgggttaccggtaacgggaaccggtaccgtaccgttaccgaaccgttaccctacccgtaaccccgactaaacctaaccttaaccgaaactaacgtacttacgtttaccgtttcctacttaccgaaccgttaacgaaacgttccgaacccgttagaacggtaacgtacccgtcggaaaccgtacccggttaactaacgtaacgttaaccgcgttacggttagtccggaacccggtacgggaaccggtaacgttaacccgttaacccgtacccgggttaaccccaaagggtaccctaaacccggggtacccgggtaacgggtaaccccggg

SEQ ID NO: 49976 - DNA, 800 bp, Homo sapiens
  misc_feature: GYAE6OF02IKS1A.49.5.A05.1.454.CMB.1.raw
tcagagtcgagagacacgaccggtgctcgatttagatagatagacaggggtctgggagacgagcccagcactggaagtcgccggtgtttccattcgtgatcatcactgaacacagagactcaccatggagtttgggctgagtcttgggttttccctcgtttgcttacgttttaagaggtgtccagtgtcaggtgcgagcgtggtggaggtcgggggagcgttggtccaggccgtgggaccgttcccgtagacgtacctcgtcctggtcgccgacgtcccgtcttggtactttacgtagttcgtagtagttactgtcttagtcgacttacgttcggtttccgaccggtacggggtccgaacgggtaccggaacgggggtcgtaggggtacgggttggggtacggtaccgtaagttttaagtacgtttaggttaacgttaggaacgttaaagggaaaaaccgtaaaacgtttaacccggacgtacgtaacggtacccgttaccggtaaggggaaccggtaccgttacgtaaccgaacctctaccccgtaacccgaactaaacccgtaacttaaccgaaacgtaacctaattacgtttacgttacttacgtcgtaacgtaagaaccgtacgtaccgtaggtaaggtaacgtacggaaccgtaccggtaacggtcgttaacgttaacgttactaagttacggttaggtccggtaccggaccggtaacgtaacccgtaaacgttaacccgtaaccggtaaaccggtacggtaaccgtaccgggacccgggtaaccgtaacccggg

SEQ ID NO: 49977 - DNA, 182 bp, Homo sapiens
  misc_feature: GYAE6OF02IFYXI.49.5.A05.1.454.CMB.1.raw
  modified_base (158)..(182): a, c, t, g, unknown or other
  misc_feature (158)..(182): n is a, c, g, or t
tcagagtcgagagacacgaccggtgctcgatttagatagatagacagggggtcaagctcacctgcactctggaacggtcagcccaaggctcgcccctggtcactctcgttcccaccctcctctctctcgactctgagtcggctggcaaggctacatgnnnnnnnnnnnnnnnnnnnnnnnnn

SEQ ID NO: 49978 - DNA, 815 bp, Homo sapiens
  misc_feature: GYAE6OF02FJX71.49.5.A05.1.454.CMB.1.raw
  modified_base (180)..(180): a, c, t, g, unknown or other
  misc_feature (180)..(180): n is a, c, g, or t
  modified_base (659)..(659): a, c, t, g, unknown or other
  misc_feature (659)..(659): n is a, c, g, or t
tcagagtcgagagacacgaccggtgctcgatttagatagatagacaggggtctgggagacgagcccagcactggaagtcgccggtgtttccattcggtgatcatcactgaacacagaggactcaccgatgggacgtttgggctgagcttgggttttcctcgttgctacttttaagaggtntaccagtgtacggtagtccgagtcgtcgggtggaggtcgggggtacgggcgtggtccgtacgaccggtgggtaccgccgttcgaggtacctcgtccgttcgtggtacgacgaccgttcgtgttacttacctatttcggtagttaaggttacctgggatacgttacgaccgacggttcggtttaccggtccggaacgggtacccggaggtacgggaaccgggtaggtacgggtacggtagggttacggaggtactttaacggttacgttaggttaacggtagtaaccggttaaaggggtaaaaaccgtaaaaacggtttaaaccttaaggtaccggaaacgggttaccgtaaccccgtagggtaaccgggtaccggtaactacccggtacgtaacctaccgtacccggaactaaccgtacttaacccgaacgaacctagtaaccttacttacgttaacccgttgtacgtaccgtaaaccncgtccgaaggaacgttaggaacgaccgtaacacgggtaacttacgtaattacccgtagtcgtacggttaccgacggtcggaaccggttaccggaaccgtttaatacccggttaacccgaggtaacccgtaggcccgggttaaccgacggttacccg

SEQ ID NO: 49979 - DNA, 861 bp, Homo sapiens
  misc_feature: GYAE6OF02GW6M1.49.5.A05.1.454.CMB.1.raw
tcagagtcgagagacacgaccggtgctcgatttagatagatagacaggggtctgggagacgagcccagcactggaagtcgccggtgtttccattcggtgatcatcactgaacacagaggactcaccatggtagtttgggctggagccgttgggtttttcctcggttgccttcgttttaagaggttcgtccagtgtcgaggtgcagtcgtggtgggacgggtcgggggaggcgttcggtccgagccggtcgggaccgtcccgtaggacgtacgtcctccgtgtcgaccgtacgtccttacgtaggttactttacgacgtttacgtaacgttagttaactgtacttacgtgtacgtaacggtttcggttaccggtacccggtacgggtaccgtaacgggaccgggtaacggggtcggttaggggtgggttacggggcggtacgttaacgggttaattacggttaccggttaagtaggtaaaggtaaacgggtaaaacgtaaaaaacttacgtaaccggaactaacggtacccgtaccggtaacgggaaccggggtacctacgttaccgaactaacccgttcctaaccccggtaacctaaacctaaccttaaaccggaaacgtaacctaaaccgtacgttttaccggtttaaccttaaccgtgtacccgttagtaaaccgtcggtaaccttaagggtaacgtaaccgggtactaaccgggacgttaaccggttcttaaggttaaacttaccggtattacggtcggtcgaaccgggacgtaaacggaaccgttaaccgttaaccgttaaccgttaacccggaacggttaccgtaaccgggtcccgggtaacccggttaaccccgg

SEQ ID NO: 49980 - DNA, 423 bp, Homo sapiens
  misc_feature: GYAE6OF01C7FRN.24.20.B09.1.454.CMB.1.raw
  modified_base (418)..(423): a, c, t, g, unknown or other
  misc_feature (418)..(423): n is a, c, g, or t
tcagactactatgtcacgaccggtgctcgatttagtgtagtgtgaagggactggagtggataggggctgtctatcatatcgggaacacctttacaatccgtccctcgagagtcgactctccatatccattgacacgtccaagaatcagttctcgttgaggctgcactctgtcacggccgcggacacggccgttttattctgcgcgagatggggtggatggggcagctcgtggggacaacgtggttcgacccctggggccagggaacctggtctccgtctcctcagcctccaccaagggcccatcggtcttccccctggcgccctgcctccaggagcacctccgagagcacagcgccctgggctgcctggtcaaggctactccacatagtagtctgagcgggctggcaaggcgcatagnnnnnn

SEQ ID NO: 49981 - DNA, 422 bp, Homo sapiens
  misc_feature: GYAE6OF01BVTPO.24.20.B09.1.454.CMB.1.raw
  modified_base (330)..(330): a, c, t, g, unknown or other
  misc_feature (330)..(330): n is a, c, g, or t
  modified_base (413)..(413): a, c, t, g, unknown or other
  misc_feature (413)..(413): n is a, c, g, or t
  modified_base (419)..(422): a, c, t, g, unknown or other
  misc_feature (419)..(422): n is a, c, g, or t
tcagactactatgtcacgaccggtgctcgatttagtgtagtgtgaagggactggagtggataggggctgtctatcatatcgggaacaccttttacaatccgtccctcgagagtcgactctccatatccattgacacgtccaagaatcagttctcgttgaggctgcactctgtcacggccgcggacacggccgtttatttctgcgcgagatggggtgatgggcagctcgtggggacaactggttcgacccctggggccagggaccctggtctccgtctcctcagcctccaccaagggcccatcggtctccccctggcgccctgctccaggngcacctccgagagcacagccggccctgggctgcctggtcaaggactacttccacatagtagtctgagcgggctggcaagggcncatagnnnn

SEQ ID NO: 49982 - DNA, 422 bp, Homo sapiens
  misc_feature: GYAE6OF01DRPSO.24.20.B09.1.454.CMB.1.raw
  modified_base (416)..(422): a, c, t, g, unknown or other
  misc_feature (416)..(422): n is a, c, g, or t
tcagactactatgtcacgaccggtgctcgatttagtgtagtgtgaagggactggagtggataggggctgtctatcatatcgggaacaccttttacaatccgtccctcgagagtcgactctccatatccattgacacgtccaagaatcagttctcgttgaggctgcactctgtcacggccgcggacacggccgtttattctgcgcgagatggggtggatgggcagctcgtggggacaactggttcgacccctggggccagggaaccctggtctccgtctcctcagcctccaccaagggccatcggtcttccccctggcgccctgctccaggagcacctccgagagcacagcggccctgggctgcctggtcaaggctactccacatagtagtctgagcgggctggcaaggcgcatagnnnnnnn

SEQ ID NO: 49983 - DNA, 442 bp, Homo sapiens
  misc_feature: GYAE6OF01CGISX.24.20.B09.1.454.CMB.1.raw
  modified_base (436)..(442): a, c, t, g, unknown or other
  misc_feature (436)..(442): n is a, c, g, or t
tcagactactatgtcacgaccggtgctcgatttagtgtagtgtgaagggactggagtggataggggctgtctatcatatcgggaacaccttttacaatccgtccctcgagagtcgactctccatatccattgacacgtccaagaatcagttctcgttgaggctgcactctgtcacggccgcggacacggccgtttatttctgcgcgagagtggggtggatggggcagctcggtggggacaacgtggttccgaccccgtggggccagggaccctggtctccgtctcctcagcctccaccaagggcccatcggtcttcccccgtggccgccctgctccaggacgcacctccgagacgcacagccggccctgggctgcctggtcaaggctacgttccactatagtagtctggacgcgggctgggcaagggcgcagtagnnnnnnn

SEQ ID NO: 49984 - DNA, 428 bp, Homo sapiens
  misc_feature: GYAE6OF01CJ9JD.24.20.B09.1.454.CMB.1.raw
  modified_base (417)..(417): a, c, t, g, unknown or other
  misc_feature (417)..(417): n is a, c, g, or t
  modified_base (423)..(428): a, c, t, g, unknown or other
  misc_feature (423)..(428): n is a, c, g, or t
tcagactactatgtcacgaccggtgctcgatttagtgtagtgtgaagggactggagtggataggggctgtctatcatatcgggaacaccttttacaatccgtccctcgagagtcgactctccatatccattgacacgtccaagaatcagttctcgttgaggctgcactctgtcacggccgcggacacggccgtttatttctgcgcgagatggggtggatgggcagctcgtggggacaactggttcgacccctggggccagggaaccctggtctccgtctcctcagcctccaccaagggcccatccggtcttcccccctggccgccctgctccaggagcacctccgagagcacagcggccctgggctgcctggtcaaggactacttccacatagtagtctgagcgggctggcaaggcncatagnnnnnn

SEQ ID NO: 49985 - DNA, 481 bp, Homo sapiens
  misc_feature: GYAE6OF01D1ES0.24.20.B09.1.454.CMB.1.raw
  modified_base (344)..(344): a, c, t, g, unknown or other
  misc_feature (344)..(344): n is a, c, g, or t
  modified_base (441)..(441): a, c, t, g, unknown or other
  misc_feature (441)..(441): n is a, c, g, or t
  modified_base (468)..(468): a, c, t, g, unknown or other
  misc_feature (468)..(468): n is a, c, g, or t
  modified_base (472)..(481): a, c, t, g, unknown or other
  misc_feature (472)..(481): n is a, c, g, or t
tcagactactatgtcacgaccggtgctcgatttagtgtagtgtgaagggactggagtggataggggctgtctatcatatcgggaacaccttttacaatccgtccctcgagagtcgactctccatatccattgacacgtccaagaatcagttctcgttgaggctgcactctgtcacggccgcggacacggtccgtttattctgcgcgagagtggggtggagtgggcagcgtcggtaggggacaacgtcggtccgaccccggtggggaccacgggaccctggtcctccgtctcctcacgccctaccgaaccgaacgggcccctacgttccggttccccttccccgnggcccgccctcgcctccgaggacgccaccgtccggagacgccacgcggccggccgtggctcgccgtgtacaacggtctactacactatagtcgtcgngacggcgggcgtaggacgaaggcgtanagtnnnnnnnnnn

SEQ ID NO: 49986 - DNA, 446 bp, Homo sapiens
  misc_feature: GYAE6OF01C6OET.24.20.B09.1.454.CMB.1.raw
  modified_base (323)..(323): a, c, t, g, unknown or other
  misc_feature (323)..(323): n is a, c, g, or t
  modified_base (439)..(446): a, c, t, g, unknown or other
  misc_feature (439)..(446): n is a, c, g, or t
tcagactactatgtcacgaccggtgctcgatttagtgtagtgtgaagggactggagtggataggggctgtctatcatatcgggaacaccttttacaatccgtccctcgagagtcgactctccatatccattgacacgtccaagaatcagttctcgttgaggctgcactctgtcacggccgcggacacggccgtttatttctgcgcgagatggggtggatgggcagctcgtggggacactggttccgaccccgtggggccagggaaccctggtctccgtctcctcagcctccaccaagggcccatcggtcctcccccgtggccnccctgcctccaggacgcacctccgagacgcacagccggccctgggctgaccctggtcaaggacctacgttccactatacgtaagtctggagcgggctgggacaagggcgacatagnnnnnnnn

SEQ ID NO: 49987 - DNA, 436 bp, Homo sapiens
  misc_feature: GYAE6OF01CRF2K.24.20.B09.1.454.CMB.1.raw
  modified_base (395)..(395): a, c, t, g, unknown or other
  misc_feature (395)..(395): n is a, c, g, or t
  modified_base (430)..(436): a, c, t, g, unknown or other
  misc_feature (430)..(436): n is a, c, g, or t
tcagactactatgtcacgaccggtgctcgatttagtgtagtgtgaagggactggagtggataggggctgtctatcatatcgggaacaccttttacaatccgtccctcgagagtcgactctccatatccattgacacgtccaagaatcagttctcgttgaggctgcactctgtcacggccgcggacacggccgttttatttctgcgcgagagtggggtggatgggcagctcggtggggacaacgtggttccgaccccgtggggccagggaacctggtctccgtctcctcagcctccaccaagggcccatcggtcttccccctggcgccctgcctccaggcgccaccctccgagagccacacgccggccctgggctgcctggtcaaggctactccanatagtatctgagcgggctgggacaaggcgcatagnnnnnnn

SEQ ID NO: 49988 - DNA, 724 bp, Homo sapiens
  misc_feature: GYAE6OF01EOJDC.24.20.B09.1.454.CMB.1.raw
  modified_base (232)..(232): a, c, t, g, unknown or other
  misc_feature (232)..(232): n is a, c, g, or t
  modified_base (611)..(611): a, c, t, g, unknown or other
  misc_feature (611)..(611): n is a, c, g, or t
tcagactactatgtcacgaccggtgctcgatttagtgtagtgtgaaggggggactggaggtgggataggggctgtctatcgatatccgggaacaccttttacgaactccggtccctcgagacgtccgactctccactactccattgacgacgtccaaggaactcgacgttctcgttgacggctgcactcctcgtccacggccggcgaccacggccgtttattctgcgcgagntcggggtggatgggcacgcgtcgtaggggacaacgttgggttccgacccgtggggaccagggtaccctggtcgtacccgtactccctccacggccctccgaccgaaccgggacccctactccggttcctttaccccccgttgggccggtcccgttcgaccttaccggacgggaccgtccgaccggttcccggagaacgtccgactacggtccgggtcccgtcggggcctcggtcccgttaggggtccgaaacggggtaccttacccgtttcccaacgtacgttacgtacggttcgtacggacggccggggtcttagggggaccgtaaagggggccggaacgtaacgttaggacttacggtctagccttagcaagttcgngcgcgcgacgtacgtcgttcggtcggtacggacggacggacgacgtcgtacgtacgtacgtacgacgacgaccgtacggtccgtccgtcccgtaccgtcctccgtcccgtccc

SEQ ID NO: 49989 - DNA, 509 bp, Homo sapiens
  misc_feature: GYAE6OF01CDLFP.24.20.B09.1.454.CMB.1.raw
  modified_base (355)..(355): a, c, t, g, unknown or other
  misc_feature (355)..(355): n is a, c, g, or t
  modified_base (474)..(474): a, c, t, g, unknown or other
  misc_feature (474)..(474): n is a, c, g, or t
  modified_base (482)..(509): a, c, t, g, unknown or other
  misc_feature (482)..(509): n is a, c, g, or t
tcagactactatgtcacgaccggtgctcgatttagtgtagtgtgaagggactggagtggataggggctgtctatcatatcgggaacaccttttacaatccgtccctcgagagtcgactctccatatccattgacacgtccaagaatcagttctcgttgaggctgcactctgtcacggccgcggacacggtccgttttatttctgcgcgagagtggggtgagtgggcagctcggtggggacaacgtggttcgacccctggggccagggaaccctggtctccgtctcctcacgccctccaccgaagggcccagtccggtccttccccccgtggcccgtccctcgcctaccgaggacnccacctccggagacgccacgaggccggcccgtggggctcggccgtggtaccgtaaacggactttaccgtccaaactagttacgttacgtcgtggacggcgggacgtggacgaacgggcncgtaatgnnnnnnnnnnnnnnnnnnnnnnnnnnnn

SEQ ID NO: 49990 - DNA, 484 bp, Homo sapiens
  misc_feature: GYAE6OF01DNHZR.24.20.B09.1.454.CMB.1.raw
  modified_base (467)..(484): a, c, t, g, unknown or other
  misc_feature (467)..(484): n is a, c, g, or t
tcagactactatgtcacgaccggtgctcgatttagtgtagtgtgaagggactggagtggataggggctgtctatcatatcgggaacaccttttacaatccgtccctcgagagtcgactctccatatccattgacacgtccaagaatcagttctcgttgaggctgcactctgtcacggccgcggacacggccgttttatttctgcgcgagagtggggtgatgggcagctcgtggggacaactggttcgaccccgtggggccagggaaccctggtctccgtctcctcagcctccaccaacgggcccatccggtccttcccccgtggccgccctgcctccgaggacgccacccgtccgagacgccacgaggccggcccgtgggcctcgccttgggtacaacgggaccttaaccgttccaacagttagtacgtctaggaggtccgggcgtgggacaacgggcgacaatagnnnnnnnnnnnnnnnnnn

SEQ ID NO: 49991 - DNA, 439 bp, Homo sapiens
  misc_feature: GYAE6OF01DYQ6K.24.20.B09.1.454.CMB.1.raw
  modified_base (424)..(424): a, c, t, g, unknown or other
  misc_feature (424)..(424): n is a, c, g, or t
  modified_base (430)..(439): a, c, t, g, unknown or other
  misc_feature (430)..(439): n is a, c, g, or t
tcagactactatgtcacgaccggtgctcgatttagtgtagtgtgaagggactggagtggataggggctgtctatcatatcgggaacaccttttacaatccgtccctcgagagtcgactctccatatccattgacacgtaccaagaatcagttctcgttgaggctgcactctgtcacggccgcggacacggtccgttttatttctgcgcgagagtggggtgatgggcagctcggtggggacacgtggttccgacccgtggggccagggaaccctggtctccgtctcctcagcctccacacgggccatcggtcttcccctggccgccctgctccaggacgtcacctccgagacgcacacgccggcccgtgggctcgcctggtcaaggacctactccacatagtagtctgaggcggctggcaaggcncatagnnnnnnnnnn

SEQ ID NO: 49992 - DNA, 534 bp, Homo sapiens
  misc_feature: GYAE6OF01DSFY0.24.20.B09.1.454.CMB.1.raw
  modified_base (512)..(534): a, c, t, g, unknown or other
  misc_feature (512)..(534): n is a, c, g, or t
tcagactactatgtcacgaccggtgctcgatttagtgtagtgtgaagggactggagtggataggggctgtctatcatatcgggaacaccttttacaatccgtccctcgagagtcgactctccatatccattgacacgtccaagaatcagttctcgttgaggctgcactctgtcacggccgcggacacggtccgtttattctgcgcgagagtggggtgagtgggcagctcggtggggaacaacgtggttccgaccccgtggggccagggaaccctggtcctccgtctcctcgacgccctaccaaccgaacgggccccaagtccggttcccttccccccgtggcccgccctgcctccgaagggcgtccaccctccggaagacgccgaacgacggcccgggtcccgtcggggcctcgggtccgtagggtaccaaacgggtaccttaaccgttcccaacgtaattacggtagtccgtggacggcggggtctagggacgaagggccgtacaagtcgnnnnnnnnnnnnnnnnnnnnnnn

SEQ ID NO: 49993 - DNA, 582 bp, Homo sapiens
  misc_feature: GYAE6OF01CVHTS.24.20.B09.1.454.CMB.1.raw
  modified_base (201)..(201): a, c, t, g, unknown or other
  misc_feature (201)..(201): n is a, c, g, or t
  modified_base (540)..(540): a, c, t, g, unknown or other
  misc_feature (540)..(540): n is a, c, g, or t
  modified_base (544)..(544): a, c, t, g, unknown or other
  misc_feature (544)..(544): n is a, c, g, or t
  modified_base (546)..(553): a, c, t, g, unknown or other
  misc_feature (546)..(553): n is a, c, g, or t
  modified_base (555)..(582): a, c, t, g, unknown or other
  misc_feature (555)..(582): n is a, c, g, or t
tcagactactatgtcacgaccggtgctcgatttagtgtagtgtgaagggactggagtggataggggctgtctatcatatcgggaacaccttttacaatccgtccctgagagtcgactctccatatccattgacacgtccaaagaatcagttctcgttgaggctgcactctgtcacggccgcggacacggtccttttattcngcgcgagagtgggggtgagtcggggcaggccgtcggtaggggaactaacgttcgggttcccgaccccggtgggggcccaacggggaaccctgggttcctccggttcctcccttcacgtcccctacccgaccgaacggggccccagtcccggttcccttccccccgtggcccgcccctgcctccgaggacgccacccgtccgaagcgccaacgacggccggcccgtgggcctgcccgtggtacgaacgggaccttacccttaccgaactagttaacggttagtcgttcggaacgggccgggtccgtaggggtaccgaacgggcccgacgaacgttaaggnacgngnnnnnnnngnnnnnnnnnnnnnnnnnnnnnnnnnnnn

SEQ ID NO: 49994 - DNA, 424 bp, Homo sapiens
  misc_feature: GYAE6OF02G4TN0.24.20.B09.1.454.CMB.1.raw
  modified_base (419)..(424): a, c, t, g, unknown or other
  misc_feature (419)..(424): n is a, c, g, or t
tcagactactatgtcacgaccggtgctcgatttagtgtagtgtgaagggactggagtggataggggctgtctatcatatcgggaacaccttttacaatccgtccctcgagagtcgactctccatatccattgacacgtccaagaatcagttctcgttgaggctgcactctgtcacggccgcggacacggccgtttatttctgcgcgagatggggtggatgggcagctcgtggggacaactggttcgacccctggggccagggaaccctggtctccgtctcctcagcctccaccaagggcccatcggtctcccctggcgccctgctccaggagcacctccgagagcacagcggccctgggctgcctggtcaaggactacttccacatagtagtctgagcgggctgggcaaggcgcatagnnnnnn

SEQ ID NO: 49995 - DNA, 424 bp, Homo sapiens
  misc_feature: GYAE6OF02GNBND.24.20.B09.1.454.CMB.1.raw
  modified_base (420)..(424): a, c, t, g, unknown or other
  misc_feature (420)..(424): n is a, c, g, or t
tcagactactatgtcacgaccggtgctcgatttagtgtagtgtgaagggactggagtggataggggctgtctatcatatcgggaacaccttttacaatccgtccctcgagagtcgactctccatatccattgacacgtccaagaatcagttctcgttgaggctgcactctatcacggccgcggacacggccgtttatttctgcgcgagatggggtggatgggcagctcgtggggacaactggttcgacccctggggccagggaaccctggtctccgtctcctcagcctccaccaagggcccatcggtcttccccctggcgcccctgctccaggagcacctccgagagcacagcggccctgggctgcctggtcaaggctacttccacatagtagtctgagcgggctggcaaggcgcatagnnnnn

SEQ ID NO: 49996 - DNA, 427 bp, Homo sapiens
  misc_feature: GYAE6OF02G465O.24.20.B09.1.454.CMB.1.raw
  modified_base (415)..(415): a, c, t, g, unknown or other
  misc_feature (415)..(415): n is a, c, g, or t
  modified_base (421)..(427): a, c, t, g, unknown or other
  misc_feature (421)..(427): n is a, c, g, or t
tcagactactatgtcacgaccggtgctcgatttagtgtagtgtgaagggactggagtggataggggctgtctatcatatcgggaacaccttttacaatccgtccctcgagagtcgactctccatatccattgacacgtccaagaatcagttctcgttgaggctgcactctgtcacggccgcggacacggccgtttatttctgcgcgagatggggtggatgggcagctcgtggggacaactggttcgacccctggggccagggaaccctggtctccgtctcctcagcctccaccaagggcccatcggtcttccccctggccgccctgctccaggagcacctccgagagcacagcggccctgggctgcctggtcaaggactacttccacatagtagtctgagcgggctggcaaggcncatagnnnnnnn

SEQ ID NO: 49997 - DNA, 427 bp, Homo sapiens
  misc_feature: GYAE6OF02HK8LF.24.20.B09.1.454.CMB.1.raw
  modified_base (414)..(414): a, c, t, g, unknown or other
  misc_feature (414)..(414): n is a, c, g, or t
  modified_base (420)..(427): a, c, t, g, unknown or other
  misc_feature (420)..(427): n is a, c, g, or t
tcagactactatgtcacgaccggtgctcgatttagtgtagtgtgaagggactggagtggataggggctgtctatcatatcgggaacaccttttacaatccgtccctcgagagtcgactctccatatccattgacacgtccaagaatcagttctcgttgaggctgcactctgtcacggccgcggacacggccgtttatttctgcgcgagatggggtggatgggcagctcggtggggacaactggttcgacccctggggccagggaaccctggtctccgtctcctcagcctccacaagggcccatcggtctccccctggcgccctgctccaggacgcacctccgagagcacagcggccctgggctgcctggtcaaggactactccacatagtagtctgagcgggctgggcaaggcncatagnnnnnnnn

SEQ ID NO: 49998 - DNA, 430 bp, Homo sapiens
  misc_feature: GYAE6OF02HQUYW.24.20.B09.1.454.CMB.1.raw
  modified_base (317)..(317): a, c, t, g, unknown or other
  misc_feature (317)..(317): n is a, c, g, or t
  modified_base (330)..(330): a, c, t, g, unknown or other
  misc_feature (330)..(330): n is a, c, g, or t
  modified_base (340)..(340): a, c, t, g, unknown or other
  misc_feature (340)..(340): n is a, c, g, or t
  modified_base (416)..(430): a, c, t, g, unknown or other
  misc_feature (416)..(430): n is a, c, g, or t
tcagactactatgtcacgaccggtgctcgatttagtgtagtgtgaagggactggagtgggataggggctgtctatcatatcgggaacaccttttacaatccgtccctcgagagtcgactctccatatccattgacacgtccaagaatcagttctcgttgaggctgcactctgtcacggccgcggacacggccgtttatttctgcgcgagatggggtgatgggcagctcgtggggacaactggttcgacccctggggccagggaaccctggtcctccgtctcctcagcctccacaaggcccatcggtctcccctggcnccctgctccaggncacctcgagngcacagcgccctgggctgcctggtcaaggactacttccacatagtagtctgagcgggtctgggcaaggcgcatagnnnnnnnnnnnnnnn

SEQ ID NO: 49999 - DNA, 434 bp, Homo sapiens
  misc_feature: GYAE6OF02IFCWU.24.20.B09.1.454.CMB.1.raw
  modified_base (340)..(340): a, c, t, g, unknown or other
  misc_feature (340)..(340): n is a, c, g, or t
  modified_base (428)..(434): a, c, t, g, unknown or other
  misc_feature (428)..(434): n is a, c, g, or t
tcagactactatgtcacgaccggtgctcgatttagtgtagtgtgaagggactggagtggataggggctgtctatcatatcgggaacaccttttacaatccgtccctcgagagtcgactctccatatccattgacacgtccaagaatcagttctcgttgaggctgcactctgtcacggccgcggacacggccgtttatttctgcgcgagagtgggggtggatggggcagctcggtggggacaacgtggttcgaccccgtggggccagggaaccctggtctccgtctcctcagcctccaccaagggcccatcggtcttccccctggcgccctgcctccaggngcacctccgagagcacagcggccctgggctgcctggtcaaggactacttccacatagtagtctgagcgggctgggcaaggcgcatagnnnnnnn

SEQ ID NO: 50000 - DNA, 462 bp, Homo sapiens
  misc_feature: GYAE6OF02F3CDF.24.20.B09.1.454.CMB.1.raw
  modified_base (315)..(315): a, c, t, g, unknown or other
  misc_feature (315)..(315): n is a, c, g, or t
  modified_base (450)..(462): a, c, t, g, unknown or other
  misc_feature (450)..(462): n is a, c, g, or t
tcagactactatgtcacgaccggtgctcgatttagtgtagtgtgaagggactggagtggataggggctgtctatcatatcgggaacaccttttacaatccgtccctcgagagtcgactctccatatccattgacacgtccaagaatcagttctcgttgaggctgcactctgtcacggccgcggacacggccgtttatttctgcgcgagatggggtggatgggcagctcgtggggacaactggttcgaccctggggccagggaccctggtctccgtcctcctcacgcctccacgacggccagtcgtccttccccgnggccgccgtgcctccgaggacgccaccgtccgagacgccacgacggccgcccgtgggcctcgccgtggacgaacggtacctaccttaccactagttagtactcgtaggacggcgggcgtggacgaggcacagtgnnnnnnnnnnnnn

SEQ ID NO: 50001 - DNA, 424 bp, Homo sapiens
  misc_feature: GYAE6OF02HANU1.24.20.B09.1.454.CMB.1.raw
  modified_base (413)..(413): a, c, t, g, unknown or other
  misc_feature (413)..(413): n is a, c, g, or t
  modified_base (419)..(424): a, c, t, g, unknown or other
  misc_feature (419)..(424): n is a, c, g, or t
tcagactactatgtcacgaccggtgctcgatttagtgtagtgtgaagggactgggagtggataggggctgtctatcatatcgggaacaccttttacaatccgtccctcgagagtcgactctccatatccattgacacgtccaagaatcagttctcgttgaggctgcactctgtcacggccgcggacacggccgtttattctgcgcgagatggggtggatgggcagctcgtggggacaactggttcgacccctggggccagggaaccctggtctccgtctcctcagcctccaccaagggcccatcggtcttccccctggcgccctgctccaggagcacctccgagagcacagcggccctgggctgcctggtcaaggactactccacatagtagtctgagcgggctggcaaggcncatagnnnnnn

SEQ ID NO: 50002 - DNA, 434 bp, Homo sapiens
  misc_feature: GYAE6OF02JDI6S.24.20.B09.1.454.CMB.1.raw
  modified_base (426)..(434): a, c, t, g, unknown or other
  misc_feature (426)..(434): n is a, c, g, or t
tcagactactatgtcacgaccggtgctcgatttagtgtagtgtgaagggactggagtggataggggctgtctatcatatcgggaacaccttttacaatccgtccctcgagagtcgactctccatatccattgacacgtccaagaatcagttctcgttgaggctgcactctgtcacggccgcggacacggccgtttatttctgcgcgagatgggggtggatgggcagctcgtggggacaactggttcgacccctggggccagggaccctggtctccgtctcctcacgcctccaccaagggcccatcggtcttccccctggccgccctgcctccaggacgcacctccgagacgcacagccggccctgggctgcctggtcaaggactacttccacatagtagtctgagcgggctggcaaggcgcatagnnnnnnnnn

SEQ ID NO: 50003 - DNA, 431 bp, Homo sapiens
  misc_feature: GYAE6OF02G95LW.24.20.B09.1.454.CMB.1.raw
  modified_base (422)..(431): a, c, t, g, unknown or other
  misc_feature (422)..(431): n is a, c, g, or t
tcagactactatgtcacgaccggtgctcgatttagtgtagtgtgaagggactggagtggataggggctgtctatcatatcgggaacaccttttacaatccgtccctcgagagtcgactctccatatccattgacacgtccaagaatcagttctcgttgaggctgcactctgtcacggccgcggacacggccgtttatttctgcgcgagatgggggtggatgggcagctcgtggggacaactggttcgaccctggggccagggaccctggtctccgtctcctcagcctccaccaagggcccatcggtcttccccctggcgccctgcctccaggagcacctccgagagcacagcggccctgggctgcctggtcaaggactacttccacatagtagtctgagcgggctgggcaagggcgcatagnnnnnnnnnn

SEQ ID NO: 50004 - DNA, 506 bp, Homo sapiens
  misc_feature: GYAE6OF02JY0A4.24.20.B09.1.454.CMB.1.raw
  modified_base (485)..(506): a, c, t, g, unknown or other
  misc_feature (485)..(506): n is a, c, g, or t
tcagactactatgtcacgaccggtgctcgatttagtgtagtgtgaagggactggagtggataggggctgtctatcatatcgggaacaccttttacaatccgtccctcgagagtcgactctccatatccattgacacgtccaagaatcagttctcgttgaggctgcactctgtcacggccgcggacacggccgtttatttctgcgcgagagtggggtggatgggcagctcggtggggacaacgtggttccgaccccgtggggccagggaaccctggtctccgtctcctcacgcctccaccgaagggccccagtccggtccttcccccgtggccgcccctgcctccgaggacgccaccgtccgagacgcacgacggccggcccgtgggccgtcgcccgtggtccgaaacgggtaccttaccttcccaactaacttaggtaacgtccgtaggacggccgggacgtgggacgaacgggcgacatagcgnnnnnnnnnnnnnnnnnnnnnn

SEQ ID NO: 50005 - DNA, 591 bp, Homo sapiens
  misc_feature: GYAE6OF02H5DYY.24.20.B09.1.454.CMB.1.raw
  modified_base (548)..(548): a, c, t, g, unknown or other
  misc_feature (548)..(548): n is a, c, g, or t
  modified_base (550)..(551): a, c, t, g, unknown or other
  misc_feature (550)..(551): n is a, c, g, or t
  modified_base (553)..(553): a, c, t, g, unknown or other
  misc_feature (553)..(553): n is a, c, g, or t
  modified_base (555)..(555): a, c, t, g, unknown or other
  misc_feature (555)..(555): n is a, c, g, or t
  modified_base (557)..(591): a, c, t, g, unknown or other
  misc_feature (557)..(591): n is a, c, g, or t
tcagactactatgtcacgaccggtgctcgatttagtgtagtgtgaagggactggagtggataaggggctgtctatcatatcgggaacaccttttacaatccgtccctcgagagtcgactctccatatccattgacacgtccaagaatcagttctcgttgaggctgcactctgtcacggccgcggacacggtccgttttatttcgtgcgcgagagtgggggtggagtggggcaggcgttggtggggactaacgttgggttccgaccccgtggggccagggaaccctggtcctccgtctcctcgacgcctccaccgaaggcccagtccggtccttccccccgtgggcccgtccccgtcgcctccgaggacgccacccgtcggagacgaccgacgacggccggtcccgtcggggtcctcggtcccggttgggtaaccgtaaacggtaccttaccgttacccgaaacgttagtttaacgtaacgttccggttaggggaaccgggccggggtacgttacggggaacccgtaacggggcccacgtaacgtaggngnngngngnnnnnnnnnnnnnnnnnnnnnnnnnnnnnnnnnnn

SEQ ID NO: 50006 - DNA, 474 bp, Homo sapiens
  misc_feature: GYAE6OF02HBJ0L.24.20.B09.1.454.CMB.1.raw
  modified_base (410)..(410): a, c, t, g, unknown or other
  misc_feature (410)..(410): n is a, c, g, or t
  modified_base (451)..(452): a, c, t, g, unknown or other
  misc_feature (451)..(452): n is a, c, g, or t
  modified_base (454)..(474): a, c, t, g, unknown or other
  misc_feature (454)..(474): n is a, c, g, or t
tcagactactatgtcacgaccggtgctcgatttagtgtagtgtgaagggactggagtggataggggctgtctatcatatcgggaacaccttttacaatccgtccctcgagagtcgactctccatatccattgacacgtccaagaatcagttctcgttgaggctgcactctgtcacggccgcggacacggccgtttatttctgcgcgagatggggtggatgggcagctcggtggggacaacgtggttcgaccccgtggggccagggaaccctggtctccgtctcctcacgcctccaccaacggggcccatccggtccttccccccgtggccgcccctgcctccgagggacgccacctccgagacgccacaggccggcccgtggggctgccctggtcaaggctacttcccanatagtagtctggagcgggctgggacaacgggcgacagtagnngnnnnnnnnnnnnnnnnnnnnn

SEQ ID NO: 50007 - DNA, 527 bp, Homo sapiens
  misc_feature: GYAE6OF02FZU2O.24.20.B09.1.454.CMB.1.raw
  modified_base (500)..(500): a, c, t, g, unknown or other
  misc_feature (500)..(500): n is a, c, g, or t
  modified_base (502)..(527): a, c, t, g, unknown or other
  misc_feature (502)..(527): n is a, c, g, or t
tcagactactatgtcacgaccggtgctcgatttagtgtagtgtgaagggactggagtggataggggctgtctatcatatcgggaacaccttttacaatccgtccctcgagagtcgactctccatatccattgacacgtccaagaatcagttctcgttgaggctgcactctgtcacggccgcggacacggccgtttatttctgcgcgagatggggtgatgggcagctcgtggggacaactggttccgacccgtggggccagggaccctggtctccgtctcctcacgcctcccaccgaacgggcccacgtcggtcccttccccccgtggccgcccctcgcctcccgacggacgcaccctccggagacgccgaacacggcccggcccgtggggcctcgcccgttggtaccgaacgggtaccttaccttacccaacgtacgtaaggttacgtcgtacgggacggccggggtctcggggaccgtaagggccgccgtaagtaggcngnnnnnnnnnnnnnnnnnnnnnnnnnn

SEQ ID NO: 50008 - DNA, 491 bp, Homo sapiens
  misc_feature: GYAE6OF02ISVWD.24.20.B09.1.454.CMB.1.raw
  modified_base (418)..(418): a, c, t, g, unknown or other
  misc_feature (418)..(418): n is a, c, g, or t
  modified_base (463)..(465): a, c, t, g, unknown or other
  misc_feature (463)..(465): n is a, c, g, or t
  modified_base (467)..(491): a, c, t, g, unknown or other
  misc_feature (467)..(491): n is a, c, g, or t
tcagactactatgtcacgaccggtgctcgatttagtgtagtgtgaagggactggagtggataggggctgtctatcatatcgggaacaccttttacaatccgtccctcgagagtcgactctccatatccattgacacgtccaagaatcagttctcgttgaggctgcactctgtcacggccgcggacacggccgtttatttctgcgcgagagtgggggtggatgggcagctcggtgggacaacgtggtccgacccgtggggccaggaccctggtcctccgtctcctcagcctccaccgaacgggcccatccggttcctccccccgtcggccgtcccgtcgcctccgacggcgccaccctccgagacgccaacgacggccggcccgtggggctcgccgtcgggtacaacggactactccanatacgtagtcgtggacgcgggctcggacgaacgggcacgagtagnnngnnnnnnnnnnnnnnnnnnnnnnnnn

SEQ ID NO: 50009 - DNA, 693 bp, Homo sapiens
  misc_feature: GYAE6OF02JJO0Z.24.20.B09.1.454.CMB.1.raw
  modified_base (219)..(219): a, c, t, g, unknown or other
  misc_feature (219)..(219): n is a, c, g, or t
  modified_base (288)..(288): a, c, t, g, unknown or other
  misc_feature (288)..(288): n is a, c, g, or t
  modified_base (611)..(611): a, c, t, g, unknown or other
  misc_feature (611)..(611): n is a, c, g, or t
  modified_base (623)..(624): a, c, t, g, unknown or other
  misc_feature (623)..(624): n is a, c, g, or t
  modified_base (628)..(629): a, c, t, g, unknown or other
  misc_feature (628)..(629): n is a, c, g, or t
  modified_base (634)..(634): a, c, t, g, unknown or other
  misc_feature (634)..(634): n is a, c, g, or t
  modified_base (650)..(650): a, c, t, g, unknown or other
  misc_feature (650)..(650): n is a, c, g, or t
  modified_base (667)..(667): a, c, t, g, unknown or other
  misc_feature (667)..(667): n is a, c, g, or t
  modified_base (686)..(686): a, c, t, g, unknown or other
  misc_feature (686)..(686): n is a, c, g, or t
tcagactactatgtcacgaccggtgctcgatttagtgtagtgtgaagggactggagtggatagggctgtctatcatatcgggaacacctttttacaatccgtccctcgagagtcgactcctccatatccattgacacgtcaaagaatcagttctcgttgaggctgcactctgtcgaccggccgcggacacggtccgttttatttctcggtcgccggagngtggggtggatgggcaggcgtcggtggggactaacgtggttccgacccctgggggccaggggtaacccncggttacgttcccgttctccctacacgccctccgaccgtaaacgggccctagtcccggttacccttcccccgtcggtcccgtcccgtcggaccgttacccgaaagggccgtcccgtaaaccccgtcccgggtaaacgcgtacccgaaaccgtaccgggccggggtaacccccttgggggcccctttcgcccgtttggggtaacccggaaaacgggtaccctttaccctcccgaaacttaaccggttaaggttaacgtccgtcggacggtccggggaccgtggtaaccggaaacgggtcccgagacgttacggactggtaccgngactagacctgnngcgnngctcngtcgcgcgacgcgagntcgactcgctcgtacgngtcgtcgtacgacgccgcnctatcgc

SEQ ID NO: 50010 - DNA, 512 bp, Homo sapiens
  misc_feature: GYAE6OF01BLCCR.51.6.A06.1.454.CMB.1.raw
  modified_base (410)..(410): a, c, t, g, unknown or other
  misc_feature (410)..(410): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgcccaacccactattcttattggtaccagcagaagccaggccaggcccctgtgttgttgatatataaagacactgagaggcttcagggatccctgagcgattctctggctccactcagggacaatggtcacattgaccatcagtggagtccaggcagaagacgaggctgactatttctgtcaatcttnagtacatcagtggtacttatgttccttacgggaactgggaacctaaggtccaccggtctaggtcacgcccaaggcccaaccccactagtccacctcttcccg

SEQ ID NO: 50011 - DNA, 510 bp, Homo sapiens
  misc_feature: GYAE6OF01A8WRR.51.6.A06.1.454.CMB.1.raw
  modified_base (358)..(358): a, c, t, g, unknown or other
  misc_feature (358)..(358): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattgcccaacccatattcttattggtaccagcagaagccgggccaggcccctgtgttggtgatgtataaagacactgagaggccctcagggatcccgtgagcgattctctggctccgaggtcagggacaacggtcacnttggccatcagtggagtccgaggcagaggacgaggctgactattatgtcaatcaacagaacaccattggtacttagtgtcttcggaactgacgacagtcaccgtcctggtcagcccaggccccaacccactcgcactctcgttcccctaccc

SEQ ID NO: 50012 - DNA, 552 bp, Homo sapiens
  misc_feature: GYAE6OF01D8Y0L.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggccctgtgttgttgatatataaagacactgagaggcctttcgagggatccctagacgcgtattctctggctccacctcgagggacaagtggtcactattcgacctatcagtggagtccaggcaagaagacgaggctgacttatttctgtactattcttacagactatacagttgttacttagttgttcgttacggtacgtcgggacctaaggtccaaccggttccgtaggtccacgaccccgaacggccccaaaccccgtactacgtaccctactccgttaccccgg

SEQ ID NO: 50013 - DNA, 522 bp, Homo sapiens
  misc_feature: GYAE6OF01ESW17.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattgccaacccactattcttattggtaccagcagaagccaggccaggccctgtgttgttgatatataaagacactgagaggccttcagggatccctgagcgattctctggctccacctcagggacaatggtcacattgaccatcagtggagtccaggcagaagacgaggctgacttatttctgtcaatcttacagacatcagtggtacttatgtcttacggaactgggacctaaggtcctaccggttcctaggtccacgaccccaaggaccccaaaccccactagtccacgtccgttcccgg

SEQ ID NO: 50014 - DNA, 501 bp, Homo sapiens
  misc_feature: GYAE6OF01D0RCU.51.6.A06.1.454.CMB.1.raw
  modified_base (491)..(491): a, c, t, g, unknown or other
  misc_feature (491)..(491): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggccctgtgttgttgatatataaagacactgagaggccttcagggatccctgagcgattctctggctccactcagggacaatggtcacattgaccatcagtggagtccaggcagaagacgaggctgacttatttctgtcaattcttcagacatcagtgtacttatgtcttcggaactgggaaccaggtcaccgtcctagtcacgcccaaggcccaaccccactgtcnccttctcccg

SEQ ID NO: 50015 - DNA, 481 bp, Homo sapiens
  misc_feature: GYAE6OF01BNL1W.51.6.A06.1.454.CMB.1.raw
  modified_base (237)..(237): a, c, t, g, unknown or other
  misc_feature (237)..(237): n is a, c, g, or t
  modified_base (371)..(371): a, c, t, g, unknown or other
  misc_feature (371)..(371): n is a, c, g, or t
  modified_base (452)..(452): a, c, t, g, unknown or other
  misc_feature (452)..(452): n is a, c, g, or t
  modified_base (454)..(454): a, c, t, g, unknown or other
  misc_feature (454)..(454): n is a, c, g, or t
  modified_base (464)..(464): a, c, t, g, unknown or other
  misc_feature (464)..(464): n is a, c, g, or t
tcagcgatcgtatacacgaccggtgctcgatttagatctactgacagggcacgaccggtgctcgatttagatctactgacagggcacgaccggtgctcgatttagatctactgacagggggtggtccaggaggcagaactctgggtgtctcaccatggcctggatccctctacttctccccctctcactctctgcacaggctctgagcctctatgtgctgacacagccaccctggtntccgtgtccccaggacagacggccaggatcacctgctctgagatgcattgccaacccactattcttattggtaccagcagaagccaggccaggcccctgtcgttgttgatatataaagacactgagaggccttnagggactccctgagcgattctctggctccacctcagggacaatggtcacattcgacctatcagtgagtcaggcagagacgngntgactattcngtcaatctacagctacg

SEQ ID NO: 50016 - DNA, 500 bp, Homo sapiens
  misc_feature: GYAE6OF01DRGSU.51.6.A06.1.454.CMB.1.raw
  modified_base (493)..(493): a, c, t, g, unknown or other
  misc_feature (493)..(493): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctggtgtccgtgtccccaggacagacggccaggatcacctgctctggagatgcattgccaacccatattcttattggtaccagcagaagccaggccaggccctgtgttgttgatatataaagacactgagaggcctttcgagggatccctgagcgattctctggctcacctcagggacaatggtcacattgaccatcagtggagtccaggcagaagacgaaggctgacttatttctgtcaatcttcagtacaatcagttggtacttatgttcttcggaactggaccaggtcaccgtctaggtcacgcccaaggcccaacccactgacnctctccg

SEQ ID NO: 50017 - DNA, 864 bp, Homo sapiens
  misc_feature: GYAE6OF01DWX58.51.6.A06.1.454.CMB.1.raw
tcagcgatcgtatacacgaccggtgctcgatttagatctactgacaggggggtggggtccaggtaggcagaactcctgggtggtctcaccactgggcctggatcccctctacgttcctcccccgtaccgtccacgtctcgtgcgaccaggctctgacggccgtcctagtgtggctcgaacacgagccgacccttcggtgtaccgtgtcccccaggacaggaccggccagggactcgacctcgcctcgtgggagactgcattcgcccaaacctacgtacttcgttagttcggtacccagaccagaaacgcccaaggccacggcccctagtcgttggttacgaagttaagttaagttaaaaggacaaccttggaaggacgggtcctttcggacgggtacgttccccgtaggacgcggactttcgtccgtccggtctccctaaccgtcgtacgggactaacggttcggtaccaccgtaagtttcggaaccctacttccgtaaggtcgggtacgttaccgacgggacctaacgggaaacggtaccgggtacgggtcctaaccggtaacgttaacgttttccgtaccggttaaccgtaaacgttcgtttaccgtaacgtaaccgtaacgttacggaacggtttacgggttaacctttaaacgttccggtttacccgttaccggggtaaacccgttacgggggtaacccgtaaacggggtttcccgtaaccccggggtttccgggttaacggtaaccccgggttaacccggaaccccccgggtaaaaccgggtaaccccccgtaaaacccccccgttaacccgttaacccggttaccccgtaaacccgtttcccggttttaccccccggg

SEQ ID NO: 50018 - DNA, 508 bp, Homo sapiens
  misc_feature: GYAE6OF01BIR72.51.6.A06.1.454.CMB.1.raw
tcagcgatcgtatacacgaccggtgctcgatttagatctactgacaggggggagcctagctgtgctgtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattcgccaacccactattcttattggtaccagcagaagccaggccaggcccctgtgttgttgatatataaagacactgagaggccttcgaggggactcccgtgacgcgtattctctggctccacctcgaggacagtggtcactatgaccatcagtggactccgaggcagaagacgaggctgacttattcgtatcaattcttacagacatcagtcgtacttagtgtcttacggaacgtcggacgagtctaccgtctaggcacgcccgaaccgg

SEQ ID NO: 50019 - DNA, 535 bp, Homo sapiens
  misc_feature: GYAE6OF01EV527.51.6.A06.1.454.CMB.1.raw
  modified_base (526)..(526): a, c, t, g, unknown or other
  misc_feature (526)..(526): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgcccaacccactattcttattggtaccagcagaagccaggccaggccctgtgttgttgatatataaagacactgagacggccttcgagggactccctgagcgattctctcggcctcccacctcgagggacaagtcggtacactattcgacctatcgaggtggacgtccgaggcaagaagacgaggctagacttatttctgtacaattcttacagacatctaggtgttacttatcgttcttcggaacgtgggaaccaggtccaccgtcctaggtccacgcccgaaggccccaacccactcgtccnctcgtcccg

SEQ ID NO: 50020 - DNA, 501 bp, Homo sapiens
  misc_feature: GYAE6OF01A7GI3.51.6.A06.1.454.CMB.1.raw
  modified_base (487)..(487): a, c, t, g, unknown or other
  misc_feature (487)..(487): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggccctgtgttgttgatatataaagacactgagaggccttcagggatccctgagcgattctctggctccacctcagggacaatggtcacattgacccatcagtggagtccaggcagaagacgaggctgactatttctgtcaatcttcagacatcagtggtacttatgtcttcggaactgggaccaaggtcaccgtcctaggtcacgcccaaggcccaaccccnctgtccactctccg

SEQ ID NO: 50021 - DNA, 658 bp, Homo sapiens
  misc_feature: GYAE6OF01BX2TB.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagcccacccgtcggtcgtccgtcgtcccccaggacaggacggccaggactcacctgctcgtggagatgctattcgaccaaccctattattctttagtcggtaaccagcaagaacgccaggccacgccctgtgttgtgatataataaagacactgagacgtccttcgagggtactcccgtgacgcgtatttcgtctacggctacccactacgaagggtacctaatggtacactagttcgaacctatacgagttcggacgtcgagggtacaaggaacgaacggaggacctagtaacttatttcgtagtacctaagttcttacgaagtactatacgaggttacggttacctttagtcgttacgttaccggaacgttacgggaacccgtaacggttacccgtaacccggttccgttacgggtaccacccggaccccggtaaaaccggtaccccccgtaaacccttaccgtacgttacccgaacccgtttccggtttaacccccg

SEQ ID NO: 50022 - DNA, 570 bp, Homo sapiens
  misc_feature: GYAE6OF01CP7A3.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaacccactattctattggtaccagcagaagccaggccaggccctgtgttgtgatatataaagacactgagaggccttgagggatcccgtgagcgattctctggcctccacctcgaagggacaagtggtacactattgaccatcagtggagtaccgaggcaaggaagacgaaggctgacttatttctgtactaattcttacaagtacaagtcaggttggttactttagtgttacgttacggaacgttgggaacctagggtccacccggttccgttaagggtaccaacggaccccgaaacgggcccccaaacccccgtacgttcgtacctaccttccgttaccccg

SEQ ID NO: 50023 - DNA, 492 bp, Homo sapiens
  misc_feature: GYAE6OF01AKMLD.51.6.A06.1.454.CMB.1.raw
  modified_base (431)..(431): a, c, t, g, unknown or other
  misc_feature (431)..(431): n is a, c, g, or t
tcagcgatcgtatacacgaccggtgctcgatttagatctactgacagggggagcctagctgtgctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagagccaggccaggcccctgtgttgttgatatataaaagacactgagaggccttcagggatcccctgagcgattctctggctccacctcagggacaatggtcacattgaccatcagtggagtccagggcaagaagacgaggctgactatttctgtcaatcttcanacatcagtgtacttatgtcttaggactgggacctaaggctaccgtctaggcagcccaacgg

SEQ ID NO: 50024 - DNA, 629 bp, Homo sapiens
  misc_feature: GYAE6OF01D2B53.51.6.A06.1.454.CMB.1.raw
  modified_base (241)..(241): a, c, t, g, unknown or other
  misc_feature (241)..(241): n is a, c, g, or t
  modified_base (303)..(303): a, c, t, g, unknown or other
  misc_feature (303)..(303): n is a, c, g, or t
tcagcgatcgtatacacgaccggtgctcgatttagatctactgacagggggtggggtccaggaggcgagaactctcgggtgtcctcaccattcggcctggtatcccttcgtacttctccccctctcactctctgcacaggctctgaggccttcctatgtgcttggtacctacagccaccttacggtgtccgtgtccccaggacagacggccaggatcacctgcgtctggagatgcagttcncaaccatattctatgacagcagagcagctagcctgttgtgtgatagtataagacactggagngtctgaggctcctgatcgattcgcgtgctaccactcgaggacaagtcgtacactattgaacctagtacgtagtcggaacgtcctaacggcaacggaacgacggaacgtactacggtaaccttagttttccgtagttactaacttcctttaacaacgtaacctagttaccgaaggtttacgggttaactttaagttacgttaccgttacgggaacgttacgggtaacctaaggttaccctaccggttaccgttaaggtaaccgaacggaaccccgaaggaacccccgtaaacccctacttacggtaccctaccgttcccgttacccg

SEQ ID NO: 50025 - DNA, 642 bp, Homo sapiens
  misc_feature: GYAE6OF01BSPZ0.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctcgtggagatgcattgacccaacccactattcttattggtaccagcagagccaggccaggccctgtgttgttgatatataaagacactgagagcttcagggatcctgagcgtattctctcggctccacctcaagggacaaagtggtactaactattcgaacccagttaccgaaggtcggaacgtaccgagggaccgaagaaacgacggaggactggaactttagtttcctaggtacctaatttcctttacaagtacctaattccgaggttacggtaactttagttcggttaccgtttacggaacgttacggggtaaccaacgggttacctacccggttaccgttaagggttcccaaaccgggtaccccgaaacgggtacccccgtaaaaccccgtaccgtacccgttactaccccgttaccggtttacccccgg

SEQ ID NO: 50026 - DNA, 556 bp, Homo sapiens
  misc_feature: GYAE6OF01DCMOV.51.6.A06.1.454.CMB.1.raw
  modified_base (317)..(317): a, c, t, g, unknown or other
  misc_feature (317)..(317): n is a, c, g, or t
  modified_base (397)..(397): a, c, t, g, unknown or other
  misc_feature (397)..(397): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgagctgacgcagccaccctcagtgtcagtgtctccaggacaaacggccaagatcacctgctttggagatgcgttgccaaagaaatctgctttttggaccatcagaggccaggccaggccctgtattggtcatctatgaggacaccaagcgaccctcggaatccctgagngagtcgctggctccgaggtcagggacaagtcggccaccttgactatcacgtgggacccagatggaacgagtaggaaggtnactaccacttgttattcgacagacagcgaggtggtagtcggtagggggttccgttcgggcgggagggacgaaggcgtacggacccgtcgtggacgtcgagccccgaaggccctccggcccccgttcggtacctaccgtcgttccgttccccgtaccccg

SEQ ID NO: 50027 - DNA, 538 bp, Homo sapiens
  misc_feature: GYAE6OF01B1BLS.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtcgtccccaggacagacggccaggatcacctgctctggagatggcattcgccaaacctactattcttaattggtaccagcagaagccaggccaggccctgtgttgttgatataataaagacactgagaggccttcgagggatccctgagcgattctcgtggctccactcaggacaatggtacacattgaccatcgagtgagtccagcagaacgacgaggactgacttattacgtgtacaattcttcaagacatctagtagggttacttatgtcttacggaactgggaccaaagggtccaaccggtcctagggtcacggtacccaaacggccctaaaccccgataccgtcacctcgttacccg

SEQ ID NO: 50028 - DNA, 698 bp, Homo sapiens
  misc_feature: GYAE6OF01CQY56.51.6.A06.1.454.CMB.1.raw
  modified_base (212)..(212): a, c, t, g, unknown or other
  misc_feature (212)..(212): n is a, c, g, or t
tcagcgatcgtatacacgaccggtgctcgatttagatctactgacagggggtgggtccaggaggcagaactctgggtgtctcaccatggcctggatccctctacttctccccctctcactctctgcacaggctctgaggcctcctatgtgctgacacagccacctcggtgtccgtgtccccaggaccagacggccaggactcacctgcttcnggagatgcaattcgaccaaaccctattagtttcttatttcggaaccagcagaagccaaggccacggccctgtgttgtgataatataaagacactgagacggtccttagacgggtactcccgtaggacgtcgtaacttctccgtcggtccttacccacgttaccgaagggaaccaaagttcggttaccaacgtagtttacgaacctagtaccgtagtacgggaacgtaccgaaggaccgaaggaaacggtacggaacggactaggtaacctttagtttaccgtagttacgtaaatttccgtttacgaacgttacctaattaccgtaaggtttaacggttaactttaacgttcgttaccgttacggtaaacgtaccgggtaaacctaacgggttaccgtaaccggttaccgtaacgggttaccgaaccgtaccccgaaacgggcccctaaaaccccgtacgttacgtaccctacgtccgttaaccccg

SEQ ID NO: 50029 - DNA, 595 bp, Homo sapiens
  misc_feature: GYAE6OF01A3G6A.51.6.A06.1.454.CMB.1.raw
  modified_base (304)..(304): a, c, t, g, unknown or other
  misc_feature (304)..(304): n is a, c, g, or t
tcagcgatcgtatacacgaccggtgctcgatttagatctactgacagggggtgggtccaggaggcagaactctgggtgtctcaccatggcctggatccctcgtaccttctccccctcctcactcgtctgcacaggctctgaggcctcctatgtgctgacacacgccaccctcggtgtccgtcgtccccaggaccagacggccaggactcacctgctctggagatgctattgccaaccatattcttagttggaccagcagtaagccaggccacggccctgtgtcgtgatatataagacactgagngtcctcgaggactccgtaggacgacgtattcctcgtcggtccttccacgtcgagggacctaagttcggtacactagttcgaacctatcgagtcggacgtccagggcaaggaagacggagctagacttatttctagtactaacttcgttacaagtactatacgtagttagttacttacgttcgttaccgttacgggtaacgttcgggaaccgtacgggtcccgaaccggttcgtaggtaccacgacccgaacgaccccgtaaaccctcgtacgtacctaccgtcgttacccg

SEQ ID NO: 50030 - DNA, 550 bp, Homo sapiens
  misc_feature: GYAE6OF01DNZJN.51.6.A06.1.454.CMB.1.raw
tcagcgatcgtatacacgaccggtgctcgatttagatctactgacaggggggagcctagctgtgctgtgggtccaggaggcagaactctgggtgtctcaccatggcctggatccctctacttctccccctctcactctctgcacaggctctgaggcctcctatgtgctgacacagccaccctcggtgtccgtgtccccaggacagacggccaggatcactgctctggagatgcattcgccaacccacttattcttattcggtaccagcagaagccaggccacggcccctgtcttggttatttataaagtctttgagacggccctcgacgggacccctgacgcgtattctcgtcggctccagcctcacgcgacaacacgtcacgttcaccatcaggtggagtccgaggcaggacggacgaggcgtagtacttacgttactgtacagtctagtctaacgacagcaggtcggctacgttagttgtacgttcgttcgggacgggacgggaacctaaacgtcgtacccgttaccgtaggtccaggcccgtaacgg

SEQ ID NO: 50031 - DNA, 543 bp, Homo sapiens
  misc_feature: GYAE6OF01AHS3J.51.6.A06.1.454.CMB.1.raw
  modified_base (446)..(446): a, c, t, g, unknown or other
  misc_feature (446)..(446): n is a, c, g, or t
tcagcgatcgtatacacgaccggtgctcgatttagatctactgacaggggggagcctagctgtgctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttacgagggactcccgtgacgcgtattctcgtggctcccacctcgagggacaagtcgtcacattcgaccatcagtggagtcgagggcaggaacgacgaggctagacttatttctagtactatcttanagtactactctagtgttaacttagtcgttcgttacggtaacggtcgggaaccctagggtccacccgttaccgtaggtccacggtcccgtaaacccgg

SEQ ID NO: 50032 - DNA, 541 bp, Homo sapiens
  misc_feature: GYAE6OF01EI99R.51.6.A06.1.454.CMB.1.raw
  modified_base (396)..(396): a, c, t, g, unknown or other
  misc_feature (396)..(396): n is a, c, g, or t
  modified_base (475)..(475): a, c, t, g, unknown or other
  misc_feature (475)..(475): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccatattcttaattggtaccagcagacgcacgcgacgccgtcgtgttgttgtatatataaagacactgagaggcgttctagggatcctgagcgattctctggctccaccctcgacggacgaatggtcacattgaccatcaggtggagtccaggcgacgaaagacgaggntcgacttatttctgtacaatcttcagacatcgagtggtaactttatgttcgttacgtaacgtgggtaccaacggttacncccggttaccgtaggtcgacgacccgaacggacccctaaccccaactttgcctaacctcttacccg

SEQ ID NO: 50033 - DNA, 669 bp, Homo sapiens
  misc_feature: GYAE6OF01ALZGE.51.6.A06.1.454.CMB.1.raw
  modified_base (220)..(220): a, c, t, g, unknown or other
  misc_feature (220)..(220): n is a, c, g, or t
  modified_base (414)..(414): a, c, t, g, unknown or other
  misc_feature (414)..(414): n is a, c, g, or t
tcagcgatcgtatacacgaccggtgctcgatttagatctactgacagggggtgggtccgaggaggcagaactctgggtgtctcaccatggcctggatccctctacttctcccctcctcactctctgcacaggctctgagtcctcctatgtgctgacacagccaccctcggtcgtccgtcgtccccaggacagaccggccagggatcgacctgctctgganatgacattcgcccaaccactattcttaattggtaaccagcagaacgccaggccacggccctgtcgttgtgatatataaagacacgtgagacggtccttacgagggactcccgtagacgcgtaacttcgtcgtcggtcctacccgtacctacggaacgggactaacgtcggtaaccacgtacgttacgaaccctntacgtaacgggtaggtaccgtaccgagtacgaacggtaaacgaccgggtagccgttaacgtaacgtttactttacgtaggttaccctaaagttccctttaacgaacgtaacttagtacgttaggttacgtttaacttagttcgttacggttaccggacgtacgggtactaaacggtccgtacccgttagtacggaccgtacccggtaccgaaccggttacccaaaccctacgtagtacctaccgttcctaccccg

SEQ ID NO: 50034 - DNA, 529 bp, Homo sapiens
  misc_feature: GYAE6OF01B4BDG.51.6.A06.1.454.CMB.1.raw
  modified_base (398)..(398): a, c, t, g, unknown or other
  misc_feature (398)..(398): n is a, c, g, or t
  modified_base (517)..(517): a, c, t, g, unknown or other
  misc_feature (517)..(517): n is a, c, g, or t
tcagcgatcgtatacacgaccggtgctcgatttagatctactgacagggggtgggtccaggaggcagaactctgggtgtctcaccatggcctggatccctctacttctccccctctcactctctgcacaggctctgaggcctcctatgtgctgacacagccaccctcggtgtccgtgtcccccaggacagacggccaggatcacctgctctggagatgcattgccaaccactatcttatggtaccagcagagcaggcaggccctgtgttgtgatatataaagacactgagaggccttcagggactccctgagcgattctctcggcctccacctcgagggacaatggtcactattcgacctatcagtgacgtcaggcagaagacgagctgactatttcngtcattctcagacatacgtagttagtacttatgttacttacggaacttcggggaccaagggttccaccgtccgtaggtccacggtcccgaaacggcccctaaaccccgactcggtaccncgttccttcccg

SEQ ID NO: 50035 - DNA, 553 bp, Homo sapiens
  misc_feature: GYAE6OF01ETV9N.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgcccaacccatattcttattggtaccagcagaagccaggccaggccctgtgttgtgatatataaagacactgagaggccttcgagggactcccgtgagcgtattctcgtggcctccacctcgagggacaagtcggtacacattgaccatcagtggacgtccaggcaagaagacgaggctagacttatttctgtactaattcttacagactatcgtagtgttacttattcgttacgttacggaacgttgggaacctaaggtcctaccggtccgtaggtccacggacccgaacggaccccaacccacgttagtccctaccgtccgttaccccg

SEQ ID NO: 50036 - DNA, 775 bp, Homo sapiens
  misc_feature: GYAE6OF01DK5Q9.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattcgacccaaccacttattcttattggtaccagcagagccaggccacggccctgtgttgttgatataataaagactactgagacggccttcgagggactccctggacgtcgtacttcgtctcggcctccaccgtcgaagggactaacgttcggtaccactagtttacgaaccctagttaccgaaggggttcggaacgttacccggaacgggtaaccgaaagggtaaaacggtaaccgggaacgggttaccgttaacggtaaaccttttaaacgtttttccgttaacggttaaccttaaacgtttccgtttacgaacgtaacctagttaccgtaaggtttacggtttaacctttaacgttcgtttaccgttaccggggtaaaccgttcggggtaaacccgtaaacgggttaccccaaacccgggtttacccggtttaagggtaccccgttaaacccggaccccccggtaaaaaccgggtacccccccctaaaaccccccgtacccgtttacgggttacccccttaaacccgtttcccccgttttaaccccccggg

SEQ ID NO: 50037 - DNA, 723 bp, Homo sapiens
  misc_feature: GYAE6OF01DB7W6.51.6.A06.1.454.CMB.1.raw
tcagcgatcgtatacacgaccggtgctcgatttagatctactgacagggggtgggtccaggaggcagaactctgggtgtctcaccatggcctggatccctctacttctcccctctcactctctgcacaggctctgaggcctcctatgtgctgacacagccaccctcggtgtccgtgtccccaggacagacgccaggatcacctgctctggagatgcattcgccaaccattattcttattggtaccagcagagccaggccacggccctgtgttgtgatatataaagcactgagaggtccttcgagggtactcccgtagacgtcgtatttcgtcgttcggccttacccgaccttcgaacggggtaacctaaagttcggtacaacctagtttacgaaccctaacgttacgaacgggttcgggaacgttaccccggaaggggacccaaaggggaaacggaacgggttaacgggtacccgttagggtaaaccttttaggttttcctaacggtttacctaaaagttttccctttaaccaggtaaccttaacgttaaccgttagggtttacggttaaccttttaagttcgttaccggttttaacgggaaccgtttacggggaaccgtaaacgggttccgtaaccccggttcgtaagggtcccaacggtaccccgaaaacggccccctaaaaccccgtacgttcggttacccaccgtttcccttcccccgg

SEQ ID NO: 50038 - DNA, 496 bp, Homo sapiens
  misc_feature: GYAE6OF01CWKGN.51.6.A06.1.454.CMB.1.raw
  modified_base (403)..(403): a, c, t, g, unknown or other
  misc_feature (403)..(403): n is a, c, g, or t
  modified_base (463)..(463): a, c, t, g, unknown or other
  misc_feature (463)..(463): n is a, c, g, or t
  modified_base (486)..(486): a, c, t, g, unknown or other
  misc_feature (486)..(486): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggcctttcagggatcccctgagcgattctctggctccacctcagggacaatggtcacattgaccatcagtggagtccaggcagaagacgaggctgactatttcngtcaatctcagacatcagtgtacttatgtcttcggaactggaccagtcaccgtctagtcngcccaaggcccaacccactgtcncgtctacccg

SEQ ID NO: 50039 - DNA, 507 bp, Homo sapiens
  misc_feature: GYAE6OF01A5M7M.51.6.A06.1.454.CMB.1.raw
  modified_base (231)..(231): a, c, t, g, unknown or other
  misc_feature (231)..(231): n is a, c, g, or t
tcagcgatcgtatacacgaccggtgctcgatttagatctactgacaggggggagcctagctgtgctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctgganatgcattgccaacccactattcttattggtaccagcagaagccaggccaggcccctgtgttgttgatatataaagacacagagaaggccttcaggggatccctgagcgatttctctcggctccaccttcgagggacaagtgggtcaacattgacctagtcagtggagtccaggccaagaagacgaggctgattatttctagtcaaattcttacagacatcgagtgtacttatgtcttaggactgggaccaggtcaccgtctaggcacgcccgaacg

SEQ ID NO: 50040 - DNA, 596 bp, Homo sapiens
  misc_feature: GYAE6OF01ETBVR.51.6.A06.1.454.CMB.1.raw
  modified_base (255)..(255): a, c, t, g, unknown or other
  misc_feature (255)..(255): n is a, c, g, or t
tcagcgatcgtatacacgaccggtgctcgatttagatctactgacagggcacgaccggtgctcgatttagatctactgacagggggtgggtccaggaggcagaactctgggtgtctcaccatggcctggatccctctacttctccccctcctcactctctgcacaggctctgacggcctcctatgtgctgacacacgccaccctcggtgtccgtcgtccccaggacagacggccaggatccacctgctcgtgganatgcattcgacccaaccctacttatttacttattcggtaaccagcaagaacgccacgggcccacggcccctgttcgttgtagtataataataaagacactgagacggtcttacgagggactcccgtgagcgtattctcgtgcctccacctcgaggactatcggtcacattcgacctatcgagtgacgtccgaggacaggaacgacgagctgtaacttatttctacgtactacgttcttacgaacgactacgtacgtagggttacgttactttacgtacggtttaccggttaaccgggtaacggttaccgggtaacccgttaacgggtaccgtaaccccggg

SEQ ID NO: 50041 - DNA, 596 bp, Homo sapiens
  misc_feature: GYAE6OF01A641F.51.6.A06.1.454.CMB.1.raw
  modified_base (363)..(363): a, c, t, g, unknown or other
  misc_feature (363)..(363): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgcccaacccatattcttattggtaccagcagaagccaggccaggccctgtgttgttgatatataaagacacgtgagaggccttcgagggactcccgtgagcgtattctcgtcggcctccacctcgagggacaagtggtcanattcgacagtcagtaggacgtcgaggacaggaagacggagcgtagtacttagtttctagttactaattccttacaagtactaattacgaggttacggttactttagttgttaccgttacgggtaacgttcgggtaacctaacggttaccgtaccgttccgtagggtaccaaccgaccccgtaacggacccctaaacccctacgtaccgttacctacccgttccgttaccccgg

SEQ ID NO: 50042 - DNA, 599 bp, Homo sapiens
  misc_feature: GYAE6OF01CWCG6.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgacccaacccattattcttattggtaaccagcaagaacgccaggccacggccctgtgttgttgatataataaagacactgagacggtccttcgagggtactcccgtgacgcgtattctcgtcggcctccacctcgagggaactaacgtggtacactattacgacctatcgaggtcggacgtccgaggacgaaggaagacggaggctagaacttatttcgtagtactaacttcttacagtaacgtatacgtaggttacggttacttagttacgttcgttacggaacgtcgggtaaccaacggttaccgaccgtccgtacggtaccgacggaccctaacggaccctaaccccctataccgtactaccttcgttaccccg

SEQ ID NO: 50043 - DNA, 573 bp, Homo sapiens
  misc_feature: GYAE6OF01DSGTL.51.6.A06.1.454.CMB.1.raw
  modified_base (232)..(232): a, c, t, g, unknown or other
  misc_feature (232)..(232): n is a, c, g, or t
tcagcgatcgtatacacgaccggtgctcgatttagatctactgacaggggggagcctagctgtgctgtgggtccaggaggcagaactctgggtgtctcaccatggcctggatccctctacttctccccctctcactctctgcacaggctctgaggccctcctatgtgctgacacagccaccctcggtgtccgtgtccccaggacagacggccaggatcacctgctcgtgganatgcattcgccaacccactattcttattgtaccagcagaacgccaggccacggccctgtgttgtgatatataaagacactgagaggtccttgagggactccgtgagcgtattcgtctggcctccactcgaggactaagtgtacactattcgaactatcgaagtggacgtccgaggacaaggaacgaacggaggtctagtaacttacgttttctacgttactaagttcctagtaacgactacgacgtagttggtacctttagtcggttcgttacgggaacgttcggaaccgtaaggtacccgtacccgtaccgtacggtaccaaccggtcccgaaacccggg

SEQ ID NO: 50044 - DNA, 730 bp, Homo sapiens
  misc_feature: GYAE6OF01C7HKC.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacacgcccaccctcggtcgtccgtcgtccccaggacagaccggccaggatccacctgctctggagatcgctattcgacccaaccctacttatttaccttagttcggtaaccagacaagaacgccgacggcccgacggtcccctggttcgtttgttagaattataaataaagactacgtaggacgacggtccgtttacgacgggtaactcccgtaggacgtacgtacttcgtcgtcggtcctaccgaccgtacgacgggaactaacgtcgtacaacgtacgttacgacctagtacgaggtacggtaacgtaccggaacggacgaaacggaaacggtaacgggaacggtactacggtactttacgttttacgtcgtaaccttaactttacctacgaacgtactaacgttacgtacggttttaacggttactttaacgttcgtttaaccgtacgggtaacgttaccgggtaacgtaccgggtacccgtaccggttaccgtacggtaacgtcccgaaccccggtaaaccgacccctaaccccgtacgtacccgtccgtaacccgttccgttacccccg

SEQ ID NO: 50045 - DNA, 584 bp, Homo sapiens
  misc_feature: GYAE6OF01CJ2CT.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgacccaaacccacttattcttattcggtaccagcagaagccaggccacggccctgtgttgttgatataataaagacactgagacggccttgagggactccctggagcgtattctcgtcggcctcccacctcgaagggacaagtcggtacactagttcgacctatcagtggacgtccgaggcaaggaaggacgaggtactagtactatttctagtactaatcttacagtacaatcgagttgttacttagttcgttacgttacggaacgtcgggaaccgtaggtacctaccggttccgtaggtaccgaccggaccccaacggaccccctaaacccgacttccgtaaaccctctccgttccccg

SEQ ID NO: 50046 - DNA, 697 bp, Homo sapiens
  misc_feature: GYAE6OF01BMUDC.51.6.A06.1.454.CMB.1.raw
  modified_base (219)..(219): a, c, t, g, unknown or other
  misc_feature (219)..(219): n is a, c, g, or t
tcagcgatcgtatacacgaccggtgctcgatttagatctactgacagggggtgggtccaggaggcagaactctgggtgtctcaccatggcctggatccctctacttcctccccctcctcactctctgcacaggctctgagcctcctatgtgctgacacagccaccctcggtgtccgtcgtccccaggacagaccggccaggatccacctgctcgtgganatgctattcgaccaaccctatattcttagttcggtaccagcaagaacgccaggccacggccctgtcgttgtgattataataaagacacgtgagacggtccttagagggtactcccgtaggacgtcgtacttctcgtcggccttaccgaccgttcgaacgggactaaagtcggtactaactacgttacgacctagtacgagggtacgacgtaccgagggacaaggaacgacggacggtacgtacggtaactttacgtttcgtagttactaattccgttacaaggtaactacgtacgtacggttacggtttaacttacgtttaggttacccgttacgggtaaacgtcggggttaaaccgaaccgggtttacccgtaacccggttccgttaacgggtacccgtaaccggaaccccggtaaaccggaaccccctaaaccccgtacgttcccgttacccgacccgtttccgtttaccccccgg

SEQ ID NO: 50047 - DNA, 602 bp, Homo sapiens
  misc_feature: GYAE6OF01EVWFS.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattcgcccaacccactattcttattggtaccagcagaagccaggccaggccctgtgttgtgatataataaagacacgtgagacggccttcgagggactcccgtgacgcgtactttctcgtcggcctcccaccgtcgagggacaagtggtacactattcgacctatacgagtggacgtccgaggcaaggaagacgaggctagacttatttctgtactaatcttacagactatacgtaggttacgttaacttagttcgttacgttacggaacgttacggggaacctaacgggtccgtaacccggttccgtaaggtaccgaacggaccccgtaaacggaccccctaaacccctacgttacgtaccctacccgttccgttaccccg

SEQ ID NO: 50048 - DNA, 816 bp, Homo sapiens
  misc_feature: GYAE6OF01D3WT3.51.6.A06.1.454.CMB.1.raw
tcagcgatcgtatacacgaccggtgctcgatttagatctactgacaaggggtcggtacgaggacgaacagaacctctgggtgtactccacatgcctggatccctctaccttctccccgtccgtccacgtctctgccttactagggtcgtctggacggcctcctaatggttgcctacgaccacgtacgaccctacccgttcggtcgtccgtcgtccccgaggaccaggacggccaggactcaaccgtcgcgtcctggagtatgcgtacttcgcccaacccagttattcctttagttcggtaaccaagtccttaacgaacgtccgaaggccaaggtcccgtggtgttacgttcggaccgtagtaagtaaacgtacgacgttggaagtagggtccttcggaggtactacccgtcgtaagaaccgtaattcgtacgtggacgtaccgaaccgtcgagggacaagtggtacacgtattacgaacctacgtaccgacggtacggaacgtcccgaaacgggaccgaaggtaacggaacggtaacggtaccgttaaggtaaccgttaagtttagttacggtacctaaaccgttacaaaaccgtacgtaaccctaaccgtaaacgtttaccgggttaaaccgtttaacgtttacgtttaacccgtttaccgggtaaccgttacgggaacccggtaaaccgtaaacggttaccttaacccggtttcccggttacggggttaccgtaaccggtaccccggtaaacggtaaccccctaaaccccgtaacccgttcggttacccgtaccgttcccggtttacccccggg

SEQ ID NO: 50049 - DNA, 600 bp, Homo sapiens
  misc_feature: GYAE6OF01APPWZ.51.6.A06.1.454.CMB.1.raw
  modified_base (215)..(215): a, c, t, g, unknown or other
  misc_feature (215)..(215): n is a, c, g, or t
  modified_base (231)..(231): a, c, t, g, unknown or other
  misc_feature (231)..(231): n is a, c, g, or t
  modified_base (418)..(418): a, c, t, g, unknown or other
  misc_feature (418)..(418): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctgganatgcattgccaacccntattcttaattggtaccagcagaacgccaggccaggccctgtgttgttgatatataaagacacgtgagaggcctttcagggactcccgtgacgcgtattctctggcctccactcgagggacaatggtcactattcgaccatacagtaggacgtccgaggcaaggaagacggagcctgacttatttcncgtacaagttcttacaagtactataccgtaggttaggttaacctttagttcgttaccgttacggaaaccgttcgggacctaaacgggtccaacccggtttccgtaagggtacctaaccggaccccgaaacgggccccctaaaaccccgtacgtacgttacccaaccctttcggttacccccg

SEQ ID NO: 50050 - DNA, 562 bp, Homo sapiens
  misc_feature: GYAE6OF01A6COV.51.6.A06.1.454.CMB.1.raw
  modified_base (425)..(425): a, c, t, g, unknown or other
  misc_feature (425)..(425): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgacccaacccacttattcttattggtaccagcagaagccaggccacggccctgtgttgtgatatataaagacatgagaggccttcgagggactccctgacgcgtattcctcgtcggcctccacctacgacgggaacaagtggtcactagttacgaccatcgagtggacgtccgaggcaagaacgagaggctagacttatttcngtactaattcttacagtactatacaggttcgttaacttagttcgttcgttacggaacgtgggaacctagggtccctaccgtaccgtaggtccacgacccgaacggcccctaacccgctacgtcctacttctaccccg

SEQ ID NO: 50051 - DNA, 542 bp, Homo sapiens
  misc_feature: GYAE6OF01ASINS.51.6.A06.1.454.CMB.1.raw
  modified_base (414)..(414): a, c, t, g, unknown or other
  misc_feature (414)..(414): n is a, c, g, or t
  modified_base (517)..(517): a, c, t, g, unknown or other
  misc_feature (517)..(517): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattctattggtaccagcagaagccaggccaggccctgtgttgttgatatataaagacactgagaggccttcagggatcccgtgagcgattctctggctccacctcgagggacaatggtacacattgaccatcagtggagtccgaggcagaagacgaggctgactatttctgtcaattcttnagacatcagttagtacttagtgttcgttacggaacgtcgggacctaaacgggtccaacccggttccgtaaggtccacggaccccaaacgggccccaaaccccnctacgtaccaccgttcgttaccccg

SEQ ID NO: 50052 - DNA, 666 bp, Homo sapiens
  misc_feature: GYAE6OF01EZJ6W.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacacgcccaccctcggtgtccgtcgtccccaggacagacggccaggatcacctgctctggagatgcattcgacccaacccattattcttatcggtaccagcagaagccagccacggccctgtgttgtgatactaataaacgacactgagacggtccttagaggtactcccgtggacgcgtattctcgtggcctaccgaccgtacgagggaactaacgttcggactaactacgtttacggaacctaacgtaccgtagggttcggaaccgttacccggaagggacctaaagggaaacggtaacggaacggtacgtaaggtaactttaacgtttctaggtacctaattcttacagaactattaccgtaggttacgttacttagttcgttacgttaccggaagtaccgggaaccgtacgttacccgtaaccggttaccgtacggtaccgaaccgtaaccccgaaaccggcccctaaaacccgtcgttaaccgtacctaccgtccctttccccgg

SEQ ID NO: 50053 - DNA, 515 bp, Homo sapiens
  misc_feature: GYAE6OF01B92W6.51.6.A06.1.454.CMB.1.raw
  modified_base (401)..(401): a, c, t, g, unknown or other
  misc_feature (401)..(401): n is a, c, g, or t
  modified_base (499)..(499): a, c, t, g, unknown or other
  misc_feature (499)..(499): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggccctgtgttgttgatatataaagacactgagaggccttcagggatccctgagcgattctctggctccacctcagggacaagtggtacacattgaccatcagtggatccaggcagaagacgaggctgactatttcngtcaatcttcagacatctaggtggttacttagtgttacttacggaacgtcgggaaccaggtccaccgtccgtaggtcacgacccgaacgcccaacccnctacgcactcttcccg

SEQ ID NO: 50054 - DNA, 501 bp, Homo sapiens
  misc_feature: GYAE6OF01AOJ3P.51.6.A06.1.454.CMB.1.raw
  modified_base (101)..(101): a, c, t, g, unknown or other
  misc_feature (101)..(101): n is a, c, g, or t
  modified_base (216)..(216): a, c, t, g, unknown or other
  misc_feature (216)..(216): n is a, c, g, or t
  modified_base (273)..(273): a, c, t, g, unknown or other
  misc_feature (273)..(273): n is a, c, g, or t
  modified_base (400)..(400): a, c, t, g, unknown or other
  misc_feature (400)..(400): n is a, c, g, or t
  modified_base (411)..(411): a, c, t, g, unknown or other
  misc_feature (411)..(411): n is a, c, g, or t
  modified_base (464)..(464): a, c, t, g, unknown or other
  misc_feature (464)..(464): n is a, c, g, or t
  modified_base (484)..(484): a, c, t, g, unknown or other
  misc_feature (484)..(484): n is a, c, g, or t
tcagcgatcgtatacacgaccggtgctcgatttagatctactgacagggggtgggtccaggaggcagaactctgggtgtctcaccatggcctggatccctntacttctccccctcctcactctctgcacaggctctgaggcctcctatgtgctgacacagccaccctcggtgtccgtgtccccaggacagacggccaggatccacctgctctgganatgcattgccaacccatattcttattggtaccagcagaagccaggccaggccctgtntgttgatatataaagacactgagaggccttcgagggatcccgtgagcgattctctggctccacctcgaggacaatggtcacattggaccatcagtggagtccaggcagaagacgagctgactattcngtcaatcttanagcatcagtgtacttagtgtactcggaatgggaaccaggtccacgtctaggcncgacccaacggcctaacccngtactcacgtctacccg

SEQ ID NO: 50055 - DNA, 620 bp, Homo sapiens
  misc_feature: GYAE6OF01DDBU5.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgaccaacccatattcttattggtaccagcagaagcagccaggccctgtgttgtgatatataaagacactgagaggccttgagggactccctagagcgattctacgtcggcctccaaccgtcgaagggacaagtcggtacactattacgaacctatacgagtaggtacgtccgaaggacgaaggaaacgacggaacggtcgtacgtaacttagtttcgtacgtacgtaacttcgttacaagtactatacgtaaggttacggttacttagttcgttacgtttacggaacgttacgggaaccgtaacggtccgtaacccgttaccgtaggtaccgaaccggaccccgtaaaccgggacccctaaccccgtacttccgtacctccgttccgttacccccgg

SEQ ID NO: 50056 - DNA, 675 bp, Homo sapiens
  misc_feature: GYAE6OF01A7MR1.51.6.A06.1.454.CMB.1.raw
tcagcgatcgtatacacgaccggtgctcgatttagatctactgacaggggggagcctagctgtgctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgccaacccactattccttattcggtaccagcagaagccaggccaggcccctgtgttgtgatatataaagacactgagtaggccttcgagggactccctaggagcggaatttctcgtggcctccacccgtcgaagggactaagtcgggtacaaccgtatttcgaaccctagtcgtaacggtgggacgttacccgagggaccaggaaacgacggtaacggcttaggaacctttagttttacctaggttaccgtaactttcctttacgaacggtaactacgttacgtaagggtttaccgtttaacgtttaacgttcggtttaccgtttaccgggtaaaccggtttacggggaaaccccggtaaaggggttacccccttaacccgggttacccgttaaccgggttacccgtaaacccgggacccccgtaaaaccccgggg

SEQ ID NO: 50057 - DNA, 668 bp, Homo sapiens
  misc_feature: GYAE6OF01BJY52.51.6.A06.1.454.CMB.1.raw
  modified_base (304)..(304): a, c, t, g, unknown or other
  misc_feature (304)..(304): n is a, c, g, or t
  modified_base (340)..(340): a, c, t, g, unknown or other
  misc_feature (340)..(340): n is a, c, g, or t
  modified_base (391)..(391): a, c, t, g, unknown or other
  misc_feature (391)..(391): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatccacctgctcgtggagatgcattcgacccaacccattatttctttagttcggtaccagacagaacgccgacggcccacggcccttgtgtttgttagatataanaaagacacgtggagacggtccttcgaggtctcccgngacgcgtattcctcgtgcctccacctgaggtacatggtacactattcactntcgtaggtgacgtaccgaggacaaggaaacgacggacgacgtacgtactttagtttctacgtactaacttccgttacaacgtacagttacgtaaggtttacgttacgtttacgttacggttaccggttaccgggtaaccgttaacggggtaaccctaaagggtaccccgttaccggttacccggttacgggttaccgacccgggtaccccgtaaacccgggacccccgtaaacccctacgttaccgtacccgttaccgttcccggtttaaccccccg

SEQ ID NO: 50058 - DNA, 662 bp, Homo sapiens
  misc_feature: GYAE6OF01CY3EE.51.6.A06.1.454.CMB.1.raw
  modified_base (178)..(178): a, c, t, g, unknown or other
  misc_feature (178)..(178): n is a, c, g, or t
tcagcgatcgtatacacgaccggtgctcgatttagatctactgacagggcacgaccggtgctcgatttagatctactgacagggcacgaccggtgctcgatttagatctactgacagggggtgggtccaggaggcagaactctgggtgtctcaccatggcctggatccctctacttcncccctctcactctctgcacaggctctgagcctcctatgtgctgacacagcccaccctggtcgtccgtgtccccaggacagaccggccaggactcacctgctctggagatgcattcgacccaacccacttattcttattcggtaaccagcaagaacgccaggccacgtcccctgtgtttgttgatatataaagacacgtagacgacggtccttacgacgggtactccccgtaggacgtcgtaactttccgtaccgtcggtccctaccccgtacccgtaccggaacggggtaacctaacggtttacggtacctaaccgttaagtttaccggaaccctaacgttccgtaacgggttacggtacggtacccgtaacggaccgaaacgggtaacggtaaccgggaacggtacgttacggtaaaccttttacgttttaccgttacggttaaccttaaacgttcccgtttaaccgaagtacccgttaaacg

SEQ ID NO: 50059 - DNA, 592 bp, Homo sapiens
  misc_feature: GYAE6OF01B1ZPN.51.6.A06.1.454.CMB.1.raw
  modified_base (425)..(425): a, c, t, g, unknown or other
  misc_feature (425)..(425): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattgcccaacccatattcttattggtaccagcagaagccaggccaggccctgtgttgttgatatataaagacactgagaggccttcagggactccctgagcgattctctggctccacctcgagggacaatggtacactattgaccatcgagtggactccgaggcaagaagacgaggctagacttatttcgtgtactaatccttanagtacatacgagttaggttaacttagttgttaccgttacggaacgttcggggtaaacctaacgggttacccgtacccggttaccgtacgggttacccacggacccccgtaaacgggaccccctaaaccccggacttaccgtacccttaaccgtccgtttacccccgg

SEQ ID NO: 50060 - DNA, 696 bp, Homo sapiens
  misc_feature: GYAE6OF01BS9U1.51.6.A06.1.454.CMB.1.raw
  modified_base (216)..(216): a, c, t, g, unknown or other
  misc_feature (216)..(216): n is a, c, g, or t
tcagcgatcgtatacacgaccggtgctcgatttagatctactgacagggggtgggtccaggaggcagaactctgggtgtctcaccatggcctggatccctctacttcctccccctcctcactctctgcacaggctctgaggcctcctatgagctgacacagccaccctggtgtctgtgtcctcaggacagacggccaggactcacctgctctgganatgcattcgaccaaagacaatatgtcttacgtcggtaccagacgaagaagaccgaggccgacggtcccctgttcgtttaggtttaatttaagtaaacgtacgtttaggaggtacgtcccgtacgacgggtaccccgttgacgtcgtacttccgtcgtacgccgtacctacgcctacgaacggaccgaacgtaaaccgtacgtaccgtaaccggtttacgaaccctacgttaccgtaaggttacgggaacggtcccggaagggtaccgaaagggaacgggaacggacggtaccgtacggtaaccgtttaattaccgtaggtacctaaggtacctaagtacgaacgaccgaggacgtaagtcgtactactttagtcgttacgttacggtccgggaccgggaaggaaccctaaacgtcggtacccgttaccggtaggttacccacggtacccggaacggtcctccccggaccccgttacccgg

SEQ ID NO: 50061 - DNA, 647 bp, Homo sapiens
  misc_feature: GYAE6OF01B5BDC.51.6.A06.1.454.CMB.1.raw
  modified_base (216)..(216): a, c, t, g, unknown or other
  misc_feature (216)..(216): n is a, c, g, or t
  modified_base (233)..(233): a, c, t, g, unknown or other
  misc_feature (233)..(233): n is a, c, g, or t
  modified_base (425)..(425): a, c, t, g, unknown or other
  misc_feature (425)..(425): n is a, c, g, or t
tcagcgatcgtatacacgaccggtgctcgatttagatctactgacagggggtgggtccaggaggcagaactctgggtgtctcaccatggcctggatccctctacttctccccctctcactctctgcacaggctctgaggcctcctatgagctgacacagccaccctcggtgtcagtcgtccccaggacagacggccaggatcacctgctctggaantgcattcgaccaaacgntatgacttattggtaccagcagaacgccggccagcccctgtgttggtgatgtaataaagactactgagacggccctacgagggtctcccgtgacgcggtacttctacgtcggctccgaggtcgacgggacaacgtcacgtattcggcctatcgaggtacggacgtccgaagggcctaagggacgggtaacgnggtacgttacgacgtttaacgtttattcgttaccaaactacaaaccgtaacgacctaaccgtaagtttacggttaaccgtttattaccggttaccgtttacggaacgttccgaccggttaaaccgaacgggtccctaacccggttccgtaggggttacccacggtaccccaaacggaccccctaaccccgtacttacggtacctccgttccgttacccccgg

SEQ ID NO: 50062 - DNA, 657 bp, Homo sapiens
  misc_feature: GYAE6OF01DHR07.51.6.A06.1.454.CMB.1.raw
tcagcgatcgtatacacgaccggtgctcgatttagatctactgacagggggtgggtccaggaggcagaactctgggtgtctcaccatggcctggatcccctctacttctccccctcctcactctctgcacaggctctgaggcctcctatgtgctgacacagcccaccctcggtcgtccgtcgtccccaggacagacggccaggatccacctgctcgtggagatcgactattcgacccaaaaccgattagtcgtctttagttaggtaccagcaggaacgcccgggccacgcccgtgtggttggtgtatgtaataaagacacgtgaggacgcctacgaggactccgtgagcgtacttctcgtgctcgaggtacgagggactaacggtcacgagttcgacctagtacgaggtaggacgtaccgacgggacgaaggacgggacgaggtacgtacgtaacttagttattacgtacaaacgttacaaacgtacgaactaccgttaagtttcggttaactttagttcgttaccgttaccgtaacgttacgaccgtaaaccgtacggtacccgtaccgttcccggttacgggtcccaacggtacccgaaccgtaaccccgaacccctacgttaccgtaccctaccttccgttcccgtaccccccg

SEQ ID NO: 50063 - DNA, 693 bp, Homo sapiens
  misc_feature: GYAE6OF01A0TSJ.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgccaacccacttattcttattggtaccagcagaacgccaggccacggccctgtgttgttgatatataaagacactgagacgccttcgaggactccctgacgcgtattctcgtcggcctcccacgtcgaggacagtggtaccactattacgacctatactaggtggacgtaccgagggtcgaaaggaacggaacggacggtaccgtaacggtacctttaacgttttccgtagttaactaacgtttcctttacgtaacggtaactaacgttaccgttaaggtttacgggttaacttttaggttacgtttaccgttaaccgggtaacggttaccgggtaaaccgttaacgggttaccctaacccgggttaccgttaccgggttaccggaacccggtaaccccgtaaaccggaacccccgtaaacccccgtacggtttaacccgtaccgttacccgttcccgtttacccccggg

SEQ ID NO: 50064 - DNA, 546 bp, Homo sapiens
  misc_feature: GYAE6OF01BCJ2X.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgcccaacccatattcttattggtaccagcagaagccaggccaggccctgtgttgttgatatataaagacactgagaggccttcagggactccctgagcgtattctcgtcggcctaccacctcgaacgggacaagtggtacactagttggaccatcgagtggacgtccgaggcaggaggacggaggctagacttacttattgtacaatacaacagacacgtattaggtacttagttcgtacttacggactgaccgacgtaacggtcgaccgtccgtgggtaccacgacccgaacggcccaaacccactacgtctacctcgtcccg

SEQ ID NO: 50065 - DNA, 711 bp, Homo sapiens
  misc_feature: GYAE6OF01C0D2I.51.6.A06.1.454.CMB.1.raw
  modified_base (101)..(101): a, c, t, g, unknown or other
  misc_feature (101)..(101): n is a, c, g, or t
  modified_base (172)..(172): a, c, t, g, unknown or other
  misc_feature (172)..(172): n is a, c, g, or t
tcagcgatcgtatacacgaccggtgctcgatttagatctactgacagggggtgggtccaggaggcagaactctgggtgtctcaccatggcctggatccctntacttctcccctctcactctctgcacaggctctgaggcctcctatgtgctcgacacacgccaccctcggtntcccgtgtccccaggacacgacggccaaggactccacctgcctacgtggacgatgaccattcgaccaaccctgttatttacttatttcggaaccacgtcaagaacgccacggcccgacgccccgttgtacgttgttagtattaataataaaacgtacaccgtagacgaacggtcctagtacgggaactcccgttagacgtcggtactcgtcgtcggacctaccctacgttaccgagggaactagtcggtactacgtacttacgaacctataccgaggttacggaacgttcccggaggacgtaaaggaacgacggaacgtacgtttacgactttacgttacgttacgtactaacgtttctacgtaacgactaacgttaccgtaagttcgttaacttacgttgtttacccgttacggaaccgttagggtaaccctacggtaccgttaacccgtccggttaaccggtactaacccggtaaccctaaccggtaacccccaccccgtttaaccgtcctaacccgttcctcccgtttaacccccg

SEQ ID NO: 50066 - DNA, 646 bp, Homo sapiens
  misc_feature: GYAE6OF01BTE3M.51.6.A06.1.454.CMB.1.raw
  modified_base (480)..(480): a, c, t, g, unknown or other
  misc_feature (480)..(480): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgacggcctcctatgtgctgacacacgcccacccgtcggtcgtccgtcgtccccaggacaggacggccaggactcactgctcgtggagatgactagttccgacccaaaccctattactttaccgtttagttacggtaaccagacgaacgaacgccgacggaccgaccggtcccttggtgtttgtacgtaattaataataaacgacacgtagacgacgtccttcgacggtactccgagacgtacgtacttccgtcgtcgcctaccgaccgtcggaacggactaagtcggtacacgtacgttacgacctatcgtaggtacggactacgaggacgaagaaggacgagntagacttagttatcgtacaactacaacacaactaaccgttagttacgttaattagtcggttacctacggactcggaccgtaacgacgtacccgacgtcgtaggaccacccggacccgaaccgacccccgtaacccgtgttaccgtacctccgttacccgttccccg

SEQ ID NO: 50067 - DNA, 509 bp, Homo sapiens
  misc_feature: GYAE6OF01ASZCI.51.6.A06.1.454.CMB.1.raw
  modified_base (473)..(473): a, c, t, g, unknown or other
  misc_feature (473)..(473): n is a, c, g, or t
  modified_base (494)..(494): a, c, t, g, unknown or other
  misc_feature (494)..(494): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcgagggacaatggtcacattgaccatcagtggagtccaggcagaagacgaggctagacttatttctgtactaatcttcagacatcagtggtacttatgtctcggaactggaccaggtccaccgtcctaggtacncgacccgaaggcccaaccccnctagccactctcccg

SEQ ID NO: 50068 - DNA, 803 bp, Homo sapiens
  misc_feature: GYAE6OF01EPJJS.51.6.A06.1.454.CMB.1.raw
  modified_base (244)..(244): a, c, t, g, unknown or other
  misc_feature (244)..(244): n is a, c, g, or t
tcagcgatcgtatacacgaccggtgctcgatttagatctactgacagggggggagcctagctgtgctgtgggtccaggaggcagaactctgggtgtctcaccatggcctggactccctctacttcctccccctctcactctctgcacaggctctggacggcctcctatgtgctgacacacgcccaccgtcggtcgtccgtcgtcccgaggacacgacggcctaggactcacctgcctcgtggantgcctattccgaccctaaacctacttactttacttagttcggtaaccgagacaacggaacgccgacggccgtaccggtcccgttggtcgtttaggtagtaacttaataaacgtaaaacgtactacgttaggaacggtaccggtacctttaggaaccggtaccttccccggtaagtaccgggtaccgtaacttttcccgtccggttacggtccccttacccgtaccccgttacgggaaacgggtaaacctacggtttccgttaaccgtaacttaacggttaccgtaaccgtaacgttcggtaacggtacgggtacgtaaccggaacgggtacgaaacgggaacggacggaacggtcgtacgttaaccttaatttccggtacttaacgtactttacctaacggtacaacgtaccgtagttaacgggtaccggtttaaactttgtttaaccgggttaccgttttacgggaaacgggtttacgggaaacccgttaaacgggtccccgttaaacccggttcccgggttaacttaacccggaaaccggaccccgtaaaccccggg

SEQ ID NO: 50069 - DNA, 647 bp, Homo sapiens
  misc_feature: GYAE6OF01DN3W2.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgagcctcctatgtgctgacacagccaccctcggtgtccgtgtccccaggacagacggccaggatcacctgctctggagatgcattcgacccaaaccctacttattctttattcgggtaaccagcaagaacgccaggccacggccctgtgttgttgatataataaagacactgagaggccttcgagggtactcccgtgagcgtacttctcgtcggcctcccacctcgacgggactagtcggtacactattcgaacctatacgtaggtggtacgtacccgaagggacaaggaaacggacgagggtacttagactttatttctgtactacttcttacaagtactatcgtaagttacggttattagttcgttaccgtttacgggaaccgttacgggaaccgtaacgggttcccaacccggtttccggtaacgggttacccaacccggaacccccgaaaccggaccccctaaaccccctacgttccggtaccctacccgttcccggtttcccccgg

SEQ ID NO: 50070 - DNA, 694 bp, Homo sapiens
  misc_feature: GYAE6OF01BF4LN.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattgccaacccactattcttatggtaccagcagagccaggccaggccctgtgttgttgatatataaagacactgagaggccttcgagggatcccgtggacgtcgtattctcgtcggcctccaccctcgacggggactaaagtcggtactaacgtaatttcggaacctataccgaggttaggacgttacccgaagggtaccaagggaaacggaaccggtaagggacccgttaggtaaccgtttaagtttttccgtacggtttacctaaactttccttttacgaacgtaactacgttacgtaaggtttcgggttaacttttagttcgttaccggtttaccgggtaacgttcggggtaacccgtaaagggttcccgtaacccggttccgttaacgggttccgaccggtacccccgaaacgggtacccccctaaaccccgtaccttacgttacccttacccgttccgtttacccccgg

SEQ ID NO: 50071 - DNA, 862 bp, Homo sapiens
  misc_feature: GYAE6OF01EDVHP.51.6.A06.1.454.CMB.1.raw
  modified_base (209)..(209): a, c, t, g, unknown or other
  misc_feature (209)..(209): n is a, c, g, or t
  modified_base (273)..(273): a, c, t, g, unknown or other
  misc_feature (273)..(273): n is a, c, g, or t
tcagcgatcgtatacacgaccggtgctcgatttagatctactgacagggcgaccggtgctcgatttagatctactgacagggggtggggagcctagctgtgctggtgggtccagggaggcagaactcgtgggtgtctcaccatcggcctggactccctctacttcctcccctctcactctctagcacaggtctctgacgcctctatgtnctagacacacgcctaccgtcggtcgtccgtcgtacccaggacagacggcaggatcactgctcgngacatgactattcgaccctaacctacttacttcttaacgttcggtaaccagacaagaacgccgacggccgtaacggtccccgttaggttacggtttcggttaggtaaattaacgttaaagtaaaaacgtaccgtaacgtacggtaacgtaaccggtacccgttttaacggaacggggttaaccgtttaccccggtaagggttaaccgggtacccgggtttaaacttttcccgggttaccgttaaccgggggttacccccttaacccgttaaccccggtttaaccgggaaaacccgggggtaaaccgtttaaagggttcccgggtttaaaacccgttaaacccgttaacggttttaaccccgggaaacccctttaacgtaacccgggtaacggtttaacgggggtaaccggttaaacccggtaacggggtaaaccgaaacgggtaaaacgtaccggtaaccgggtacgttaaacgggttaacctttaaccggtttacgttacggttaaccgttaaacttccgttaaacgtaccgaaaccgttacgttacgggttaagttaccggttttaaacgttacggtttaacccggg

SEQ ID NO: 50072 - DNA, 715 bp, Homo sapiens
  misc_feature: GYAE6OF01D5BTT.51.6.A06.1.454.CMB.1.raw
  modified_base (531)..(531): a, c, t, g, unknown or other
  misc_feature (531)..(531): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgctattcgcccaaaccctattatttcgttattcggaaccagcagaacgccgaggcccacggccctggtgttgttgattataataaaggacacgtgaggtacggccttcgagggacttcccgtgaacgtcgtattcctcgtcggcctaccaccgttcgaacggggtaacctaaaggttcggtactaaccgtagtttaccgaaccgtacgttacgtacgggtagggtaaccgttacccgaagggtacaagggaaaggaccggaaggtcgtacgtactttaattttccgtagtacctaattccttacgagtaacgtntaaccggtaggttacggttactttaacgtcggttaccttacgggaacggtaccgggaaacgtaccggggttcctaaccccgggttaccgtttaacgggacccgtaacccggaaccccgtaaacgggaacccccctaaaccccgtacgtttacccgacccgttacctttcccgtttaccccccgg

SEQ ID NO: 50073 - DNA, 583 bp, Homo sapiens
  misc_feature: GYAE6OF01CHM1W.51.6.A06.1.454.CMB.1.raw
  modified_base (425)..(425): a, c, t, g, unknown or other
  misc_feature (425)..(425): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgcccaaacccatattcttattcggtaccagcagaagccaggccaggccctgtgttgttgatatataaagacactgagaggtccttcgagggtactcccgtgacgcgattctctcggctcccacctcgagggactaagtgtacactattcgaccatcgagtggagtccgaggcaaggaacgacggaggctagacttagtttcngtacaacttcttacagactattacgtaggttacgttactttagttgttaccgttacggaacgtcgggaacctaggtacccgtaccgttccgtaggtcctacgaccccaacgggaccccaaaccccgtacgttacgtaccctaccgttcgttacccccg

SEQ ID NO: 50074 - DNA, 765 bp, Homo sapiens
  misc_feature: GYAE6OF01E2KBB.51.6.A06.1.454.CMB.1.raw
  modified_base (146)..(146): a, c, t, g, unknown or other
  misc_feature (146)..(146): n is a, c, g, or t
tcagcgatcgtatacacgaccggtgctcgatttagatctactgacagggcacgaccggtgctcgatttagatctactgacagggcacgaccggtgctcgatttagatctactgacgaggggtggtccaggaggcagactctgggtntctcaccagtggcctggactccctctaccttcctccccctcctcactctctgcacgaggcctcgtcgacggtcctcctagtcgtcgcctagaccacgacgcccctacccgttcggtccgtccgtccgtcccgaggacacggccggaccgagactcgaccgtgctcgaggacgatcgctacgttccgaccctaacccgtactttactttacgtttacgttacggtaacctagacgaacgaacgccggaacggacccgaaccggtccccgtttaggttacgttttacgttacgtaaagtttactaaaacgtaaacgtaacctacggtacggtaacgggtaccgtaccgttaacgggaccgggtaccttacccggtagtaacgttaccggtaactttccgtaccgtccgggtacccttacccgaacccggttacggaacgggtaacttaacggtccggactaaccttaggtaccgtaacctagttaccgtaggtacggtacggccgtacgggaacgtaacggaaacggtaccggtacggttaccgtacgttaacccgttttaccgtttacgtaacccgttaacttaaccgtttaaccttaaccggaccgttaacgttacccg

SEQ ID NO: 50075 - DNA, 916 bp, Homo sapiens
  misc_feature: GYAE6OF01DUD02.51.6.A06.1.454.CMB.1.raw
tcagcgatcgtatacacgaccggtgctcgatttagatctactgacagggggtgggtccaggaggcagaactctgggtgtctcaccatggcctggatccctctacttctcccctctcactctctgcacaggctctgacggcctctatgtgctgacacacgcccaccgttcggtcgtccgtcgtcccccgaaggacaggaccggccaaggacttccgaaccgtgtcctcgtagggaagtactcggactacgttccggaacccctaaacctactttactttaccttttaaggtttaccggtaaccacgacgaaacggaaacgacccgaacgggacccgtaaccgggtcccgttaggttgtttacggtagtaaggttaataaacgttaaacgaactacgtaggaacggtaccggtaccgttaggacgggtacctcccggtaggacggtacgttacgttactccggtacggtcctacccgtaccgtaacggtaacgggtaactaacggttcggtaaccgtaacgttaacgttaaccgtaaaccgtacggtacggtaacggggttacggttaaccggtaaccgggtaacgggtaacggaaacggggtaaacggaaaccgggtttacgggaaaccggtttacgtaaccgggtttttactttaccggtttaacgtaacccgtttaacctttaccgttaaggaacggtaaccttaacgttaccgggttaacggttaacgtttaacctttacggtttacggttaccggttaaaccggggttacggtaaaccggggttaaacccgtaacgggttaaccccgtaaccggggtttaaccttaacgggtaccgaaacccggtacccgtaaacccggaccccgtaaacccgttcgtaccgtttaacctaccgttccccgtttaacccccgg

SEQ ID NO: 50076 - DNA, 766 bp, Homo sapiens
  misc_feature: GYAE6OF01D2RQG.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctggtgtccgtgtccccaggacagacggccaggatcacctgctctggagatgcattcgaccaacccattattccttagttggtaaccagcaagaacgccgacggccacggccctgtcgttgttgatataataaagactactggaggtacggtccttacgagggtactcccgtagacgtcgtattcgtcgtcggtcctccaacccgtcgaacgggaactaaagtcggtaccacgtagttacgaaccctagtacgtaagggttcgggtaacgttaccccggaagggtaccgaaagggaaacggtaaccgggaacgggtaccgtaacggttaaccgttttaagttttacccgttagtttaacccgtaaagttttccttaccgaacggtaacctaacgttaccgtaaggtttacggtttaacctttaagttcgggtttaccgtttaccgggtaaaccggttaccggggtaaacccgtaacgggttacccgtaacccgggttaccgttacgggttacccaccgggtaacccccggaaaccgggaacccccctaaacccccggtacgttaccgggttaacccctacccgttcccgtttaccccccgg

SEQ ID NO: 50077 - DNA, 854 bp, Homo sapiens
  misc_feature: GYAE6OF01E3CZ7.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagcccacccgtggtgtccgtcgtcccccgaggacaggaccggccaggactccaccgtgcctcgtaggagactgctattccgacccctaaccctacgttactttcttagttcggtaccagcgaagaacgccgacggccacggccctggtgttgtgaatataagaaagcacgtagaggcgtaccgttacgacggtacctcccgtagacgtccgtatttcctccgtcggacccttacccgtaccgttaccggaacggggtaaccttaaacgggttcggttaaccctaaacgttaaccgtttaccggaaacccttaacgttacccgggtaagggtttacccgggaaccggtttacccggaacgggtaaccgaaaggggaaacgggtaacggacgggtaccgtaacggttaacctttacgttttacgtaccgttactaacgtttaccgttaacgacgtaacgtactacggtaacggttttacggtttaaacctttcggttaccgttttaaccgggttacccgggtaaacgggttacccggggtaaccgttaaaccggggttaacccgttacccccggttaaccggtttaaccgggtaaccccgttacccggaaaccccccggtaaaccccgggacccccccgtaaaacccccgttcggttacccggttaccccttaccccgttcccggttttacccccccg

SEQ ID NO: 50078 - DNA, 793 bp, Homo sapiens
  misc_feature: GYAE6OF01CQYXV.51.6.A06.1.454.CMB.1.raw
  modified_base (742)..(742): a, c, t, g, unknown or other
  misc_feature (742)..(742): n is a, c, g, or t
tcagcgatcgtatacacgaccggtgctcgatttagatctactgacagggggtgggtccaggaggcagaactctgggtgtctcaccatggcctggatccctctacttcctccccctctcactctctgcacaggctctgacgcctcctatgtgctgacacacgcccacccgtcggtcgtcccgtcgtaccccgaggacacggaccggccaaggactccaccgtcgcttcgagggatactcggactagttccgaccctaaacccctatttacgtttacttacgttacggaacccagacaacggaaccgccgacggacccgtacccgggtccccgttaggttcggtttggttaacgtaatttaaagttaaacgtaaaacggtacctaacgttagggaaacggtacccgggtttacccgtttacggaaccggggtaacccttccccggtaggtaaccggtcgttaaccgttccgtaccgttcggtacccctaccccgtaaccggttacggaaacgggtaaccttacggtacggttaacctaacgtaacgttaccgaacctaacgtacggacgggttacgggtaaaccgccggaacggtaacgaaagtaaccgggtacgtacggaacttacggttactttactttgacgttactagtttcttacgaacgtactaagttacggtaggttactagtttaccgtgttacccgtacggtacgtacggtaactaccgtcgtaacccgtcgganacccgtaccggacccgaacaccccacctacgtcgaccctcctccgttcccc

SEQ ID NO: 50079 - DNA, 778 bp, Homo sapiens
  misc_feature: GYAE6OF01A4GQP.51.6.A06.1.454.CMB.1.raw
tcagcgatcgtatacacgaccggtgctcgatttagatctactgacagggggagcctagctgtgctgtgggtccaggaggcagaactctgggtgtctcaccatggcctggatccctctacttctccccctcctcactctctgcacaggctctgaggcctcctatgtgctgacacagcccacctcggtcgtccgtgtcccccaggacaggaccggccaggactcacctgctcgtggagatgcagttcgccaacccacttactttcttagttcggtaacctagaccaagaacgtccgaacggtcccacgggtcccccttggttcgtttagttgaattattaagtaaacgactacgtagtacggacggtaccttacggaggggtacctcccgtagacgtcgtacgttcgtcgtcggtccctacccgtacccgtacgtaacgggacctaacgttcgggtacctaacgtacgtttacgaacccgtagttaccgtaacgggttacgggtaaccgttacccggtaacgggaaccgtaacggaaacgggtaacccgggacgggttaccgttacggttaaccttttaacgttttcccgttacgtaaccgttaacgtttcccgtttaaccgtaacgtaacctaacgttacgtaacgggttaccgtttaaaccgtttacgttaccggttacccgtttacggggtaaccgttaacggggtaaccccgtaaacgggtacccgtacccggtttaccgttaccgggtacctaccggtaaccccgtaaacccggg

SEQ ID NO: 50080 - DNA, 519 bp, Homo sapiens
  misc_feature: GYAE6OF01C23U2.51.6.A06.1.454.CMB.1.raw
  modified_base (310)..(310): a, c, t, g, unknown or other
  misc_feature (310)..(310): n is a, c, g, or t
  modified_base (403)..(403): a, c, t, g, unknown or other
  misc_feature (403)..(403): n is a, c, g, or t
  modified_base (415)..(415): a, c, t, g, unknown or other
  misc_feature (415)..(415): n is a, c, g, or t
  modified_base (512)..(512): a, c, t, g, unknown or other
  misc_feature (512)..(512): n is a, c, g, or t
tcagcgatcgtatacacgaccggtgctcgatttagatctactgacagggggtgggtccaggaggcagaactctgggtgtctcaccatggcctggatccctctacttctcccccctcctcactctctgcacaggctctgaggcctcctatgtgctgacacagccaccctcggtgtccgtgtccccaggacagacggccaggatcacctgctctggagatgcattgccaaacccactattcttattggtaccagcaagaacgcaggccaggccctgtgttgttgatataataaagacactgagaggccttanagggactccctgagcgattctctggctccactcaggaacaatggtcatattgacatcagtgagtccagcaagaagacgaggctgactatttcngtacaatcttanagacatcagttagtacttatgtacttcgaacgtggaccaaaggtccaccgtactaggacacgacccgaacgacccaaacccgactacggactccgtnttacccg

SEQ ID NO: 50081 - DNA, 636 bp, Homo sapiens
  misc_feature: GYAE6OF01EY8XR.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctcgtggagatgacattcgacccaaacccacttatttctttaagttcgggtaaccagacaagaacgcccgaaggcccaacgggtcccctggttcggtttgttaggtaattaacttaagtaaaacggacctaacgtaggaacggtacggtcctttacgagggtactcccgtagacgtcgtattctcgtcggcctcccgacctcgaacgggactaacggtggtaccactagttacgaccatacgaggtcggacgtcgaaggcaaggaacgacgagcgtagtacttagttctagtactactcttacgagactagtacaggttgttaacttagtcgttacgttacggtaacgtcgggtaacctacggtacctacccgttcgtaggaccacgacccaacggacccaacccgtataccgtctaccgtcgtacccc

SEQ ID NO: 50082 - DNA, 769 bp, Homo sapiens
  misc_feature: GYAE6OF01CO9IL.51.6.A06.1.454.CMB.1.raw
  modified_base (249)..(249): a, c, t, g, unknown or other
  misc_feature (249)..(249): n is a, c, g, or t
tcagcgatcgtatacacgaccggtgctcgatttagatctactgacagggggggagcctagctgtgctgtgggtccaggaggcagaactctgggtgtctcaccatggcctggactccctctacttcctccccctctcactctctgcacaggctctgacggcctcctatgtgctgacacacgcccacccgtcggtcgtccgtcgtccccgaggaccacggaccggccaggactccaccgtgctcgtagganagtcgctacgttcgaccctaaaccctacttactttctttacgttacggtaacctagacgaaggaacgccgacggaccgaccggtccccgttggttggtttgttagtaacttaagtaaagtaaacgactaacgtaggaacggtacggtacccgttcggaacgggtcctacccgtaggacgtaccgttactttcgtcgtcggtccctaccctaccgttacggaacggtaacgtaacgttcggacctaacgttacgtaccgaacctagtaccgtagggtacggtacgtaccggaacgggaacgtaaagggaaaccggacgggacggtaccgttaacggttaacttttaacgtttccgtaggttaaccttaaccgttccgttaacgaacggtaacctagttaaccggtacggtttaacggttactttacggttacgttacccgggttaacggtaacggttacggaaccggtacggttacccgtacccgtacggtacggtaccgaacccgtacccgaaaccccgg

SEQ ID NO: 50083 - DNA, 678 bp, Homo sapiens
  misc_feature: GYAE6OF01CY8CN.51.6.A06.1.454.CMB.1.raw
  modified_base (218)..(218): a, c, t, g, unknown or other
  misc_feature (218)..(218): n is a, c, g, or t
  modified_base (224)..(224): a, c, t, g, unknown or other
  misc_feature (224)..(224): n is a, c, g, or t
  modified_base (297)..(297): a, c, t, g, unknown or other
  misc_feature (297)..(297): n is a, c, g, or t
  modified_base (511)..(511): a, c, t, g, unknown or other
  misc_feature (511)..(511): n is a, c, g, or t
  modified_base (661)..(661): a, c, t, g, unknown or other
  misc_feature (661)..(661): n is a, c, g, or t
tcagcgatcgtatacacgaccggtgctcgatttagatctactgacagggggtgggtccaggaggcagaactctgggtgtctcaccatggcctggatccctctacttctccccctctcactctctgcacaggctctgaggcctcctatgtgctagacacacgcccaccctcggtcgtccgtcgtccccaggacaggacggccaggactccacctgcctntggganatgctagtcacccaaacctattattcttattggaccagcagacgccagccagcctgtgttgtgatataataanacactgagacggtccttacgaggtactcccgtgacgtacgtacttcgtcgtcggcctaccgactcggaacggaacgtaacgtggtacctaagtacgtttacgaaccttaactacgtaaggtacggacgtaccgaacgggacgaaggtaaacggaccgaaggtacgttacggttaactttacgtttacgtacggtaaccctaatttaccgttaanaacggtactactacgttaacggttgttaaccttagttacggttaccgttaggtaaccggtacggtaaaccgtaacggtacctacccggtacgttacgggacccgaacgaaccccgtaacgaaccccgtaaacccgtacgtccgttaaccnccgttccttacccccgg

SEQ ID NO: 50084 - DNA, 616 bp, Homo sapiens
  misc_feature: GYAE6OF01BT0BX.51.6.A06.1.454.CMB.1.raw
  modified_base (507)..(507): a, c, t, g, unknown or other
  misc_feature (507)..(507): n is a, c, g, or t
  modified_base (570)..(570): a, c, t, g, unknown or other
  misc_feature (570)..(570): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctcgtggagatgctattcgacccaaacccacttatttactttattacgggtaccagacaagaacggccacggcccaacgggccccttggttcggtttgttgtaattaataagtaaaacggacaacgtaggaacggacggtcctttacggaagggtactcccgtagagccgtattcgtctcggctaccacgtacgagggacaagtcggtacactattcgaacctatcgtaggtgacgtaccgagggacaaggaacgaacggaggctaggtacttactttcgtgtactagttctagacactntacgtaggtgttactttgtcgttcgttacggacgtcggactacggtcgtacgtcgtaggtacncgacccgaacggccccaacccgtcgtacgtcctaccgttcgtcccg

SEQ ID NO: 50085 - DNA, 770 bp, Homo sapiens
  misc_feature: GYAE6OF01AXRR1.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacacgcccacccgtcggtcgtccgtcgtcccccaggacagacggccaggactccacctgctcgtgggacgatgctattcgaccctaaacccacttactttcttagttcggtaccagcaggaacgccgacggccgacggtcccctaggttcgttggttacgaattaagtaagtaaacgtaccacgtagacggacggtcctttacggacgggtacctcccgtaggacggtacgtactttccgtccgtacggtccctaccctaccgtcggaacgggactaacggtcggtaccacgtacgttacgaacccgacgttacgtaggtacgggtacgtacccggaagggaccgaaagggtaacggaacgtacgggtacgtacgttactttacgtttaccgttagtaccttaacgttaccttacaacgtaactagttacgtaaggtttacggtttaacgtttacgtttacggttacgtttaaccggaaccggttaccgggtaacgtaaacccgggttaccctaaccgggttacccgtagggtaacccgacccggacccgtaaacccgggaacccccttaaacccgtaccgttaacccgtacttccccgttccgtttacccccg

SEQ ID NO: 50086 - DNA, 659 bp, Homo sapiens
  misc_feature: GYAE6OF01ERCEH.51.6.A06.1.454.CMB.1.raw
  modified_base (449)..(449): a, c, t, g, unknown or other
  misc_feature (449)..(449): n is a, c, g, or t
tcagcgatcgtatacacgaccggtgctcgatttagatctactgacagggggtgggtccaggaggcagaactctgggtgtctcaccatggcctggatccctctacttcctccccctcctcactctctgcacaggctctgaggcctcctatgtgctgacacagccaccctcggtgtccgtgtccccaggacagacggccaggatcacctgctctggagatgcattcgaccaaccctactattcttagttggtaccagtcagaacgccaggccaggccctgtgttgtgatataataaagacactggagaggccttcgagggactccctaggacgcgtattctctcggctcccacctcgagggacaagtggtacagattcgaacctatacgaggtggacgtccgaggaccaaggaagacgtaaggctaggacttatttctgtacaattcttanacgtaacagtcctaagggttacgttaacctttagttcggtttaccgttagggtaaaccgttcggggtaaaccgtaaaccgggttcccttaaacccgggttacccgttaaggggtaccctaaaccgggacccccgtaaaaccggggtacccccctaaaaccccccgtacggttacgttaaccccgaacccgtttcccgtttaaccccccgg

SEQ ID NO: 50087 - DNA, 639 bp, Homo sapiens
  misc_feature: GYAE6OF01ETGK1.51.6.A06.1.454.CMB.1.raw
tcagcgatcgtatacacgaccggtgctcgattttagatctactgacagggggtgggtccaggaggcagaactctgggtgtcctcaccatggtcctggatccctctacttctccccctcctcactctctgcacaggctctgacggcctcctatgtcgctgacacacgcccaccctcgggtgtccgtcgtcccccaggacagacggccaggactccacctcgctcgtggtagactcgaccattacgacccaacctacttatttcttagttcgtaccagcaagaacgccgagcccgacgtccctagtgttcgtgattataagtaagacactagagacggtccgttcgacggactccctgacgtcgtacttcgtcgtcgcctcctacctcgagggactagtcgtacacattcgacctatcgaggtggacgtcccgaaggcaaggacgacggagtcgttagtacttacgtttactcgttactacgttcgttacacgacaattaccgtagtacgttaacgtttactacggttacttacggtaacgtacgggacctaacgggtaccctaccgttccgtaaggtcccgtaaccgaccccgtaaccgacccctaaccccacgttacgaccctacgttccttacccccg

SEQ ID NO: 50088 - DNA, 710 bp, Homo sapiens
  misc_feature: GYAE6OF01A66FR.51.6.A06.1.454.CMB.1.raw
  modified_base (185)..(185): a, c, t, g, unknown or other
  misc_feature (185)..(185): n is a, c, g, or t
  modified_base (280)..(280): a, c, t, g, unknown or other
  misc_feature (280)..(280): n is a, c, g, or t
tcagcgatcgtatacacgaccggtgctcgatttagatctactgacagggcgaccggtgctcgatttagatctactgacaggggtgggagcctagctgtgctgtgggtccaggaggcagaactctgggtgtctcaccatggcctggatccctctacttcctcccctctcactctctgcacaggctntgacgcctcctatgtgctcgacacacgccctacccgttcggtcgtccgtcgtccccaggacacggacggccaggatccaccgtgctcgttggganagtgctacttcgacccaaaccctacttacttttaccttagttaccggtaaccacgacgaacgaacggcccgaacgggacccgtacggtccccgttggttcggtttaggtttaggtaacgttaaataaaacgactaacgtggtaacggacggtccgttacggtaaggtacgtccccgtaggacggtccgttaagtttccgtcgttcgggacccttccccgtaaccgttacggaagggtaaacgtacgttacggtaccgaccttacgttacgaaccctactacgacgggttacggtacgtaccggaggacggtaacgaaacgggacgaggtccgtacggtacctttacgttaccgttacgtacttaccttacgttcgaaacgtactaacgttacggtacgtttaaggttactttaggtccgtttaaaccggg

SEQ ID NO: 50089 - DNA, 567 bp, Homo sapiens
  misc_feature: GYAE6OF01E4PBR.51.6.A06.1.454.CMB.1.raw
  modified_base (232)..(232): a, c, t, g, unknown or other
  misc_feature (232)..(232): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattgccaacccntattcttattggtaccagcagaagccaggccagccctgtgttgtgatatataaagacactgagaggcctttcagggatccctgagcgattctctggctccactcagggacaatggtcacattgaccatcagtggatccaggcagaagacgaggctagacttattctgtcaatcttcagtactatacgagttacgggttactttaattcgttcgttacggtaaacgtcgggacctaaagggtccaacccgggttcctaagggttcccacggacccccgtaaagggacccccctaaacccccgtacgtacggttccctaccgttcctttaccccggg

SEQ ID NO: 50090 - DNA, 618 bp, Homo sapiens
  misc_feature: GYAE6OF01AQBIW.51.6.A06.1.454.CMB.1.raw
tcagcgatcgtatacacgaccggtgctcgatttagatctactgacagggggggagcctagctgtgctgtgggtccaggaggcagaactctgggtgtctcaccatggcctggatccctctacttctccccctctcactctctgcacaggctctgaggcctcctatgtgctgacacagcccaccctggtgtccgtcgtccccgaggacaggacggccaggactccacctgccttacgtggagatgctattcgaccaacccacttattcttagttcggtaccagccaagaacgccaggccacggccctgtgttgtgatataataagacactagagacggtccttagagggtactccccgtagacgtcgtactttcgtcgtcggtccctacccgtaccgtacggtacgggaactagtcggtacacgtattcgaacctagtaccgagtcggacgtccgaagggctaaggaacgacggacgctagtaccttagtttcacgttacaacttctacatacattcgtagtgtttacttagttacgttaccggttagggtaaccgtcgggaaccttaacgggtacctaccccgttaacgtagggtacccacggtaaccccgaaacccgg

SEQ ID NO: 50091 - DNA, 775 bp, Homo sapiens
  misc_feature: GYAE6OF01CYROX.51.6.A06.1.454.CMB.1.raw
  modified_base (229)..(229): a, c, t, g, unknown or other
  misc_feature (229)..(229): n is a, c, g, or t
  modified_base (383)..(383): a, c, t, g, unknown or other
  misc_feature (383)..(383): n is a, c, g, or t
  modified_base (390)..(390): a, c, t, g, unknown or other
  misc_feature (390)..(390): n is a, c, g, or t
tcagcgatcgtatacacgaccggtgctcgatttagatctactgacgagggggtgggtccagggaggcagaactctgggtgtctcaccagtcggcctggactccctctacttcctccccctctcactctctgcacaggctcgtgggcctctatgtgctgacacagccaccgtcggtcgtccgtcgtccccgaggacacggaaccggccaaggtactccaccgtggctcgnggagatggcattcgacccaaccctattagttcctaagtcggtaaccagacgaagacgccgtaggccgaggtccctgtagttacgtagataagtaacaacgactacgtagaagcgtaccgttagaagggacctcccgtaggacgtcgtactcgtntacggcnccaacgtacgaggtaacaatggtacatacgtacgaacgtactagtacggtacgacgtacgagaccgaaggtaaccgaagacgtaaccgtggtaaaccgttttatttacccgaggttaaccgtaacttaccgtttaacggaaacgtaccctaagtacccggtaagttacccggggtaattttaccgtaacgggttaccggtttaaacccggggaaacgtttccgggggaaaaaccctcgggttaaacccgtttaacccgggaaccgttttaaaacccgggtaccgggggaaaccccaaccggtaacccccgggttaaaccccaaccccggttaccgttaacgtacccccggttacttaaccccgttccccggtttaaacccccccg

SEQ ID NO: 50092 - DNA, 756 bp, Homo sapiens
  misc_feature: GYAE6OF01DD9DK.51.6.A06.1.454.CMB.1.raw
  modified_base (127)..(127): a, c, t, g, unknown or other
  misc_feature (127)..(127): n is a, c, g, or t
  modified_base (482)..(482): a, c, t, g, unknown or other
  misc_feature (482)..(482): n is a, c, g, or t
tcagcgatcgtatacacgaccggtgctcgatttagatctactgacagggggtgggtccaggaggcagaactctgggtgtctcaccatggcctgggtcctcctactctcccctccctcactctctgcncagcgtctgaggcctcctatgtgctcgacacacgacccaccctccggtgtccgtcgtccccgacggacgacgaccggccgacggtactacctaccgtcgctcgtggagatgtcattcgacccaaccctacttactttcttacgttacggtaccgagacgacgaacggaccgaccggtccgaccggtcccgtgttggttacgttagaataataagtaaacgactacgacgtaggacggtccgttacggagggtaccgtaccctaggaggacctattcctcgtacggtccacccgtaccgtacggtacgggaactaacggttgccgtaacgtactttaccggaactaacgttacggnggtacggtacgtaccgagggtaacgaaggtaaacgaccggtagaccgttagttacgttaactttcgttaacgttacacgttttacttaccgaagacgttacgtagtttaaccgggtaggtttactttaagcggtttaccgttaaccgggtacgacggtaaccgtaccgtacccgtaccgttaccggttaggacccgtaacccggacccgaaccggaaccccgtaccccctaacggttcgttacccccgtattccccggttccccgttccccccg

SEQ ID NO: 50093 - DNA, 743 bp, Homo sapiens
  misc_feature: GYAE6OF01CY6LM.51.6.A06.1.454.CMB.1.raw
  modified_base (279)..(279): a, c, t, g, unknown or other
  misc_feature (279)..(279): n is a, c, g, or t
tcagcgatcgtatacacgaccggtgctcgatttagatctactgacagggcgaccggtgctcgatttagatctactgacagggggtggggagcctagctgtgctggtgggtccaggaggcagaactctgggtgtctcaccatggcctggactccctctactcctccccctcctcactctctgcacaggctctgacggcctcctatgtgctgaccacacgccctacccgttcggtcgtcccggtaccgtcccccgaggacacggaccggaccgaaggtacncctaacccgtcgacctccgtaggaagtaatcgtacctagttacccgacccaaacccctacctttatttaccgtttagttaccgggtaaccacgacgaacgaaaccggccgtaacgggcccgaccggtccccgttgttaccggtttgtttacgtaaattaactaagtaaaacgacgtaacgtacggaacggtacggtacctttaacgggacgggttaacctccccggttagaacggtaccgttactttccgtccgtcggttaccctacccgtaccgttacggaacggactagtcggtaccattacgtacgacctacgtacgtaacggtacggacgtacggaggaccgtaagggaacggacgtacggtacttacgtactttacgtttacgttacgtaaccttacttaccttacgaaaggtacccttaaggttacggttaagttaacggttgtttacgttacccggg

SEQ ID NO: 50094 - DNA, 721 bp, Homo sapiens
  misc_feature: GYAE6OF01AQ3UR.51.6.A06.1.454.CMB.1.raw
tcagcgatcgtatacacgaccggtgctcgatttagatctactgacaggggggagcctagctgtgctgtgggtccaggaggcagaactctgggtgtctcaccatggcctggatccctctacttctccccctctcactctctgcacaggctctgaggcctcctatgtgctgacacagcccaccctcggtcgtccgtcgtccccaggacagacggccaggactccacctgctcgtggagatgctattcgacccaaaccctacttactttcttacgtttcggtaacccagaccaagaacggccgacggcccgacgggtcccccttggttgtttcgttggaacttaagtaagtaaacgacacgtagaaggacggtccttacgacgggtactcccgtagacgtcgtactttctcgtcggccctaccgacctcggaggtactagtcggtaccacgtagttcgaacctagtacgaggtacggacggtaccgaagggacgaaggtaaacggacggacggtcgtaacgtaactttacgtttacgtagttaccttaacgttccgttaacctaacggtaacctacgttaaccgtaggtttacgtttaacgtttacgttccgtttaccggttaaccgggtaacggttaacccgggtaacccgtaaaccggttacccggtacccggtttacccggttacgggtacccgtaacccggtaaccccggtaaaccccgg

SEQ ID NO: 50095 - DNA, 599 bp, Homo sapiens
  misc_feature: GYAE6OF01A5CGF.51.6.A06.1.454.CMB.1.raw
  modified_base (146)..(146): a, c, t, g, unknown or other
  misc_feature (146)..(146): n is a, c, g, or t
  modified_base (169)..(169): a, c, t, g, unknown or other
  misc_feature (169)..(169): n is a, c, g, or t
tcagcgatcgtatacacgaccggtgctcgatttagatctactgacagggcacgaccggtgctcgatttagatctactgacagggcacgaccggtgctcgatttagatctactgacagggggtggtccaggagcagaactctgggtntctcaccatggcctggatccctntacttctccccctctcactctctgcacaggctctgacgcctcctatgtgctacgacacacgcccacccgtcgggtctccgtcgtccccaggaccacggaccggaccaggactaccacctgtcctcgtggatatgctacttcgacccaacctacttagttacttacgttcggtaccagacaagacgaccgacggcccggtaccgtcgtgttgtagtagtaataataaagacacgtagacgtacggtctcgtacggacgtctcgagtacgtacttctcgtcgtctccgtacctacgacggaacgtacgtacgtacactacgtactaccgtacgtacgtagtacggacgtaccgacggacgaggaaacggacgaggtcgtagtacgttactttacttgttaccgtaacttcgttactaacgtacgtacgtacg

SEQ ID NO: 50096 - DNA, 798 bp, Homo sapiens
  misc_feature: GYAE6OF01BLXVZ.51.6.A06.1.454.CMB.1.raw
  modified_base (227)..(227): a, c, t, g, unknown or other
  misc_feature (227)..(227): n is a, c, g, or t
tcagcgatcgtatacacgaccggtgctcgatttagatctactgacgagggggtggggtccaggaggcagaactctgggtgtctcaccatggcctggatccctcctacttctcccctcctcactctctgcacaggctctgaggcctcctatgtgctgacacacgccacccgtcggtcgttcccgtcgtccccgaggacaggaccggccaggactccaccgtgcttcgngggagtattcggctattccgacccaaaccctattaacttttaccttagtttacggtaccgagtacgaaggaacgaccgaacggaccgaaccggccccttgtcgttggttagattaataataaagtacacgtaggagtacggtacgttcggacgggacctccgtagacgtacgtacttcctcgtcggtcctccgtaccgtcggaacggactaaacgttcgggtactaccgtacgttaccgtaaccgacttaccgtaagggtacgggtaaccgttaccgggaacgggtaaccgaacgggtaaacggtaacgggttacggtacgttaacgtaacgttttacttttaccgttagtttaaccgttaacctttcgtttaaccgaacgtaacctagttaccgtaaccggttcggtttaactttacggttcggttacggttaaccgggtaacggttacggggtaacctaccggtaacccgttaacccggtaccggttagggaccctaaacggacccccgtaaacggaacccccgtaacccgtacgttacccgttactccccgttccgtttaaccccccg

SEQ ID NO: 50097 - DNA, 767 bp, Homo sapiens
  misc_feature: GYAE6OF01DUESJ.51.6.A06.1.454.CMB.1.raw
  modified_base (78)..(78): a, c, t, g, unknown or other
  misc_feature (78)..(78): n is a, c, g, or t
  modified_base (101)..(101): a, c, t, g, unknown or other
  misc_feature (101)..(101): n is a, c, g, or t
  modified_base (223)..(223): a, c, t, g, unknown or other
  misc_feature (223)..(223): n is a, c, g, or t
tcagcgatcgtatacacgaccggtgctcgatttagatctactgacagggggtgggtccaggaggcagaactctgggtntctcaccatggcctggatccctntacttcctccccctctcactctctgcacaggctctgagcctcctatgtgctgacacacgccaccctcggtgtcccgtcgtaccccaggacacggacggccaggactcacctgcctcgtggantgactattcgacccaacccattatttcttagttcggaccagacgagaacgccgacggcccgacggtcccttgttcgttgttagtaataagttaataaacgactacgtagacggacggtaccgtcggacggtactccgtagagtccgtacttcgtacgtcgtcctacccgtacccgtacgaacgggtaacgtaacggttacgtacgtaacttacgttaccgtaacctaacgttacgtacgggtacgggtaaccggtaccggaacggtaaccggaaacggaacgggtaaccgggacggtaccgtaacggttaacttaagttttaacgttacggtaacctaaacgtaacccaaacgtaaccgaaccttaaccgttaagtttaccggttaaacgtttacgtttacggttacccgtttaccggtacgtaccggtaacccgtaacgtaccggtacccgttacccggtccggttaccgggaccaaccggtaaccccgaaccgtacccccgtaacccttacgtacccgtcccgtaccttcccgttacccccg

SEQ ID NO: 50098 - DNA, 699 bp, Homo sapiens
  misc_feature: GYAE6OF01A4ABJ.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtcccccaggaccaggacggccaggatcacctgctctggagatgcattgccaaacccactattcttattggtaccagcagaagccaggccaggccctgtgttgttgatagtataaagacactgagacggccttcgagggactccctagagcgtattctctcggctccacctacgagggacaagtggtacaacgtattcgaacctatcctaggttcggaacgttcccgagggacaagggaaacgacgagggtacctaggtaaccttatttcgtacgttactaacgttctttacgaacggtaacacttacgtaaggttacggtttaaccgttacgttacggtttaccggttacgggtaaaccgttacgggggtaaaccccgtaaaacgggttacccgttaaaccccggttcccgttaaacgggggtacccctaaaccggtaccccccggtaaaacgggtcccccctaaaaccccccggaactttaccccgggtaaccctaacccgttcccgtttaccccccggg

SEQ ID NO: 50099 - DNA, 727 bp, Homo sapiens
  misc_feature: GYAE6OF01ACYOV.51.6.A06.1.454.CMB.1.raw
  modified_base (279)..(279): a, c, t, g, unknown or other
  misc_feature (279)..(279): n is a, c, g, or t
tcagcgatcgtatacacgaccggtgctcgatttagatctactgacagggggtgggtccaggaggcagaactctggggtgtctcaccatggcctggatccctctacttctcccctctcactctctgcacaggctctgaggcctctatgtgctgacacacgccctacccgtggttacgtccgtcgtccccgaaggacaggaccggccaggactcacctgacctcgtagggagatcggactattcgacccaacctacgttattccgtttagttcggtaaccngactaggaacgccgacggacccgaccggtccctaggttgttacgttacgaattaagtaacgtaaaacggcctacgttaggacggtaacggttccttaacggacgggtaccttcccgtaggtacgacgttacttctccggtacggtccttacccgtacgtacggtacgggtactaacgtggtacaacgtattacgactacgtacgaggtcgacgtaccgaggacaaggacgacgcgtctaggtacttacgttcgtacgtactaacttccgtaggaacgtactcggttacgacgtttacgggtactttacgttacggttaccgttaacgggacggttaccggaccgttaaccggtccctaccggttaccgtaagggtcccaaccggtaaccccgtaacggtaccccaaaacccgttcgtaacccggttccctaccgttccggttaccccg

SEQ ID NO: 50100 - DNA, 674 bp, Homo sapiens
  misc_feature: GYAE6OF01DA3YQ.51.6.A06.1.454.CMB.1.raw
  modified_base (419)..(419): a, c, t, g, unknown or other
  misc_feature (419)..(419): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacacgcccaccctcggtcgtcccgtgtcccccaaggacacggaccggccaggactcacctgctcgtggagatgcattcgacccaaaccctattatttctatttcggaccagcaagaacgccacggcccacggccctggtgttgttgagtataagtaaagacacgtaggaaggacggtccctttagacgggtactcccgtaggagacgtattctcgtcggtcctccaccgcgaggtaacacgtcggactacgtagtacgactancgtaggtaggacgtccgaaggacaagggtaacggacgacggtacgtacgtacgttacgtttctagtacctaatttccttagaaccgtagtaactacgtaggtttaggttactttagttcgtttaacggttacgggtaacgtaccggggtaaacctaaccggttaccgacccggttaccggtaaggtccgtaaccggaacccgaaccggaccccctaaacccgtacccttaggtacccaccgttccttacccccgg

SEQ ID NO: 50101 - DNA, 790 bp, Homo sapiens
  misc_feature: GYAE6OF01DC1PN.51.6.A06.1.454.CMB.1.raw
tcagcgatcgtatacacgaccggtgctcgatttagatctactgacagggcacgaccggtgctcgatttagatctactgacagggcacgaccggtgctcgatttagatctactgacagggggtggtccaggaggcagaactctgggtgtctcaccatggcctggatccctctacttctccccctctcactctctgcacaggcctctgaggtcctcctatgtgctgacacacgccctacctcgggtctccgtacgtccccgaggacacggacggcccgaacggactacctaccgtcgtactccgttggaagtagtacgaccgtaacgttacggaccccaaacccgtacctttacttttacgtttaacgtttcggtaacccacgaccgtaacggaacggaccgacggcccgtaaaccgggtccccccgttaggttcggttttacggtttacggtaactttaagttaaacgtaaaacggaaccgttaacgttcgggaacggttacgggggttaccctttaaccggtaacggggtacctttaccccgggtagtaacccggtgttaacgtttccgtacgtttaccgggcccgttaccccgtaaccgtacgggaacgggttaacctaacggttacgttacgaacgttacgttaaccgttaacctaacgttacgtacggttaacggacggttaccgtaacgggaccggaacggtaaacgacgggaacgtaccggttaagtaccgttacgtttacgtacgggttaccttaacttactttaacggacgttaactaaccgg

SEQ ID NO: 50102 - DNA, 747 bp, Homo sapiens
  misc_feature: GYAE6OF01ETP0Q.51.6.A06.1.454.CMB.1.raw
tcagcgatcgtatacacgaccggtgctcgatttagatctactgacagggggtgggtccaggaggcagaactctgggtgtctcaccatggcctggatccctctacttcctccccctcctcactctctgcacaggctctgacggcctcctatgtgctagacacacgcccacccgttcgggtcgtccgtccgtaccccgaggacacggaccggccgaaggactcacctgctcgtaggagatcgctattccgacccaaccctacttactttctttacgttacggtaaccagacaacgaacgccgaacggccgaccggtcccgttggttgtttcgttagtaattaagtaaagtaaaacgacgtaacgtaggaacggacggtccgttacggagggtacctaccggtggaacgtcgttactttcctcggtcgcctaccgaccgtacggtaacggaactaacggttcgtactaacgtacgttaacgaacctagtacggtagggtacggtacggtaccgacgggtacgaaacgggaaacggtacggacggtacgtacggttactttacgtttcttaagtacttaacgttctacagtactagttacgaggtttacgtttaacttacggtttagttccgttaacggtcggtaaccgtaaccggtaacgtaccgttacccggtcgttacggtaccgaaccggaccccgtaaaccgacccccgtaacctacgttaccgtcctaaccgtccgttacccccg

SEQ ID NO: 50103 - DNA, 865 bp, Homo sapiens
  misc_feature: GYAE6OF01DZVQ2.51.6.A06.1.454.CMB.1.raw
tcagcgatcgtatacacgaccggtgctcgatttagatctactgacgagggggtgggtccaggaggcagaactctgggtgtctcaccatggcctggatccctctacttcctccccctcctcactctctgcacaggctctggacggcctcctatgtgctgacacgacgcccacccgtcggtcgtccgtcgtaccccgaaggacacggaccggccaaggactccgacctgctcgtagggatagtcgactacgttccgaacccctaaaccctatttactttacgtttacgttacggtaaccacgacgaaacggaacggacccggaacggtacccgaaccgggtccccgttggtttcggttttacggttagtaattaattaaaacggtaaaacgtaccgtaacgtaggaacggtacggtacccgtttaggaacggttacctaccgtaggacgtaccggttacttccgtaccggtccggtaccctacccgaaccgtacgggaacggtaacgtaacggtcggtaacctacgtacgttacgaacctagtacggtacggtacggaacgtacccggaaggacgaaaacgggtaacggacgggtaacgtacgttacgttaacgtttagtttaacgttacggtaaactaaaccgtactaaaaccgaccggttaaccttaaccgttaagtttaccggtttaacgttaccgtttacgttcccgggttaacgtacgttaccggtaacccgtaaccggtaccggtaccccgttccgggttaccgttaccggggaaccctaacccgggtaaccccgaaacccgtaacccccgtaaacccgttcgttacccgtaaccccttcccggttccgttaacccccccg

SEQ ID NO: 50104 - DNA, 821 bp, Homo sapiens
  misc_feature: GYAE6OF01CTAJI.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctggaggcctcctatgtgctgacacagcccacccgtcggtgtccgtgtccccaggacagacggccaggactcacctgctctggagatgctattcgacccaaccctattacttacttacgttacggtaaccagcgaagaacggacccgacggcccgtaacgggccccgttggttcgtttggttaggtaattaagttaaacgtaaaacggtacctacgtaggaacggtacggtcccgtttacgacgggtacctccccgtaggtacggtcgtacgttcgtccggttcggacccttacctaacccgttcggaacgggtaacgtaacggttcggtaaccctacgtaacgtttacccgaaaccgtacgtaacgtagggttaaccggaaccgttaccggaacgggaacgaaagggtaaacgggaaccgggtaacggtaaccgttacgggtttaaaccgtttaacgttttacgtacgttacttaacctttaccgttaacgaaacgttactaacgtaacgttaacgggttacgtttactttacggtttcgttaccggttacggtaaccggtaacgggtacccgtaaacgggtccgttaaccccggtaccggttaacggtacccgaacccggtaccccgaaaccgggtaccccctaaaccccgtcgttaccgtaccctccgttccgttaccccccgg

SEQ ID NO: 50105 - DNA, 860 bp, Homo sapiens
  misc_feature: GYAE6OF01DR5NL.51.6.A06.1.454.CMB.1.raw
  modified_base (699)..(699): a, c, t, g, unknown or other
  misc_feature (699)..(699): n is a, c, g, or t
tcagcgatcgtatacacgaccggtgctcgatttagatctactgacagggggtgggtccaggaggcagaactctgggtgtctcaccatggcctggactccctctaccttcctccccctcctcacctctctgccacaggctctggaggcctcctatgtgctgacacgacgcccaccgtcggtcgtccgtcgaccccgaggacacggaccggccgtaaggtctccacccgtcgtccgtagtggggaacgagttcggacctacggttaccgaccccctaaaacccctactttacgtttactttacggttacgggtaaaacctaaggtaaacggaaccggacccgaaccgggccccgtaacccgggttccccgttaggttccggtttaggttaaggtaattaacgttaaacgtaaaacgtaccgtaaccgttgggaaacggtccgggttaccctccggggtaacggggtaccttccccggtaggaaccggtccggttaactttccgtcgtccggtccctacccgtaccgtaccggtaagggaacctagtacggtacctaacgtcgtacgaccctagtacggtagggtcgtacgtacgacgggacaaggtaacgacggtacgtacgtaacgttcgttaccgttcgtacgtactactttaccgtacgtaagtaaccgtagtaacgtaggtttacgttaaccgtttnttacggtttaacgttaaccgggttacggaacgggttaaacccgtaacgtacccggtaccgttccgggtaaacgggtccccaaccggtacccggaaaccccggaccccctaaccggtaccttaaccgcccttaaccgttccccgttacccggttccccccgg

SEQ ID NO: 50106 - DNA, 738 bp, Homo sapiens
  misc_feature: GYAE6OF01A1DBT.51.6.A06.1.454.CMB.1.raw
  modified_base (221)..(221): a, c, t, g, unknown or other
  misc_feature (221)..(221): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgacggcctcctatgtgctgacacacgccaccctcggtgtccgtcgtccccaggacagacgccaggactccacctgcctcgtgganatgctattccgacccaaccctacttatttccttagttcggtaccagtacaagaacgccgacggcccacgggtccccttggttcgttcgttgtataataataaacgacacgtaggaggtacggtccttacggacgggtactcccgtagacgtcgtacttccgtcgtcggtcctcccgaccgtaccggaacgggtacctaaggtcggtacctaacgtacgttaccggacctacgtacgtaagggtcggtaacgtacccggtaaggaccgaaacgggaaacggaaccgggaacggtccgttacgttaacctttacgtttccgttacggtactaacttcgttacaacgtactaacgtacgtacggttacgtttaacgtttagttacggttacgttaccgggtaacgtaccgggtaaccgtaaccgggttaccgtaacccggttcgtacggtacccgtaaccgtacccggaaccggtacccctaaccccgtacgtaccgtccttacccgttcttaccccccg

SEQ ID NO: 50107 - DNA, 679 bp, Homo sapiens
  misc_feature: GYAE6OF01CYE3A.51.6.A06.1.454.CMB.1.raw
  modified_base (254)..(254): a, c, t, g, unknown or other
  misc_feature (254)..(254): n is a, c, g, or t
  modified_base (340)..(340): a, c, t, g, unknown or other
  misc_feature (340)..(340): n is a, c, g, or t
  modified_base (352)..(352): a, c, t, g, unknown or other
  misc_feature (352)..(352): n is a, c, g, or t
  modified_base (440)..(440): a, c, t, g, unknown or other
  misc_feature (440)..(440): n is a, c, g, or t
tcagcgatcgtatacacgaccggtgctcgatttagatctactgacaggggggagcctagctgtgctggtgggtccaggaggcagaactctgggtgtctcaccatggcctggactccctctacttcctccccctctcactctctgcacaggctctgacggtcctctatgtgctgacacgacgcccacccgtgggtcgtcccgtcgtaccccgagggaccaggaccggccaagggtacctccaccgtgctgaggangtcgactactccgacccaaacctattcttacttagttacgaccagacaaggaacgccacggtaccgccggtccttgttcgttgtanaattaactaaanaaacgctacgtggaacgtcggtaccctaggacggtaccttccgaggacgtctactcgtcgtcggccttacccgacgtaggaacggtanaacgttcgacaacttagtaccgaactagtacgagggtaacggacgacgaacgggagaaacggtaaacggacggtacggactttacgtacgtttactttccgtagtaaccctaatttcgtaacgagtacctatacggttacgttaggttaccttagtcggttaaccgtaagggaccgtaccggggaaaccttaccggtacctacccgggtacgtaacggcgaaccccgtacgaaaccccg

SEQ ID NO: 50108 - DNA, 648 bp, Homo sapiens
  misc_feature: GYAE6OF01AC2BA.51.6.A06.1.454.CMB.1.raw
  modified_base (331)..(331): a, c, t, g, unknown or other
  misc_feature (331)..(331): n is a, c, g, or t
tcagcgatcgtatacacgaccggtgctcgatttagatctactgacagggggtgggtccaggaggcagaactctgggtgtctcaccatggcctggatccctctacttctcccccctcctcactctctgcacaggctctgaggcctcctatgtgctgacacagcccaccctcggtgtccgtgtccccaggacagacggccaggactcacctgcctcgtgggagatgctattcggaccccaaacccctacttactttcctttagttcggtaacccagcaaggaacgcccaggcccacggtccctggttgttgttgatatataaagacactgagnggccttcgagggtactccgtgacgcgtattctcgtcggtcctccctacctcgtaacgggacaagtcggtacactagttacgaccactcgaggtcggacgtccgacggacgaaggaacggaacggagggtacctacgtactttacgtttctagttactattccttaacgacgactatactaggttacggtttactttagttcggttacgttaccggtaaccgtcgggaaccgtacgggtacctaccggttcgtacgggtacgaccggacccgaacggtaccccaacccctacgtaccgtactccgttccgttaccccg

SEQ ID NO: 50109 - DNA, 840 bp, Homo sapiens
  misc_feature: GYAE6OF01CTG0B.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctggacgcctcctatgtcgctgacacacgcccacccgtcggtcgtccgtcgtaccccgaggacacggccggccaaggactccaccgtgtcctcgtagggaagtagtcgacctacgttccgaacccctaaacccctactttacgtttaccgttaacgtttcggtaaccgacggaccgaacggaaccggacccgtaaccgggacccgaaccgggttccccgttgggtttacggttttaggttacgtaaacgttaaagttaaacgtaaaacgtaaccgtaacggtaggaacggtaccggttccgttacggacgggtacctcccgtagacgtcgtacttcgtcgtcggtcctacccgtaccgtacgaacggactaacggtcgtaccaacgtacgttacgacctagtacggtacggtacgggtaccgtaccggaacggtaacgaaagggtaaacggacggtaacgtacgtacgttaacgtttacgtttaccgtacgttaaccgttaacgtttccgttaaccgaacgttacgtaacgttacgttaaggtttaaccgggttacttacggttacggttaccggtacgggtaaccggtacgggtaccgtaaccggttacccgtaaccggttcccggtacggtaaccgaacccggtacccgtaaacccggtaccccaaaccggttcacggttcccctacgtttccccgttaccccg

SEQ ID NO: 50110 - DNA, 624 bp, Homo sapiens
  misc_feature: GYAE6OF01BLHIV.51.6.A06.1.454.CMB.1.raw
  modified_base (607)..(607): a, c, t, g, unknown or other
  misc_feature (607)..(607): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtcgtccgtgtcccccaggacagacggccaggatcacctgctctggagatgcattcgacccaacccacttattcttattggtaccagcaagaagccacggccacggccctgtgttgttgattataataaagacagtgagagccttgaggctccctagagtcgtattctctcggcctcctacccgtcgaaggactaaagtcgtacactattacgaccatcgaggtgacgtaccgaggcgaaggaagacggaggtcacggtaattacgtttctagttactaagtttcctacaacggtaactagtaaccgtacggttacgtttaacttacgtttacgtaccgttacgggaaaccgttcgggaaaccgtcgggtaaccttacccgggtaccgttacgggaccacggtaacccaacccggaccctaaccccgactacgtaccnccgtttaccgtaccccg

SEQ ID NO: 50111 - DNA, 684 bp, Homo sapiens
  misc_feature: GYAE6OF01E2TH2.51.6.A06.1.454.CMB.1.raw
  modified_base (257)..(257): a, c, t, g, unknown or other
  misc_feature (257)..(257): n is a, c, g, or t
  modified_base (563)..(563): a, c, t, g, unknown or other
  misc_feature (563)..(563): n is a, c, g, or t
tcagcgatcgtatacacgaccggtgctcgatttagatctactgacagggggggagcctagctgtgctgtgggtccaggaggcagaactctgggtgtctcaccatggcctggatccctctacttcctccccctctcactctctgcacaggctctgacggcctctatgtgctgacacacgcccacccgtcgggtcgtcccgtcgtcccccgaggaccacggaccggccaagggtactccaccgttgccttcgtaggganacttggactacgttccgacccaaaccctacttactttactttagttacggtaaccagacgaagaacgccgacggccgacggcccgtgtgttgtgtatactaataacgcacgtggagacgtctcgacggtactccgtgacgtccgtatcgtcgtcgtcctaccctacgtacggacgggtaactacgtcggtacctactacgttccgactagtacgtaggtacgtaccgtacgacggtacgaacgtaacggacgaacgtcgttaacgcgtttacttcgtacgtactacgttaccgtacaagtaacctnttacggtacggttacgtttacgtagttacggttccgttaacgggaaccggttaccgggaaccgtacggttacccgtaccggttaccggtaacgtcccggaaccgtaccccgtaaaccccgg

SEQ ID NO: 50112 - DNA, 783 bp, Homo sapiens
  misc_feature: GYAE6OF01BLA3F.51.6.A06.1.454.CMB.1.raw
  modified_base (759)..(759): a, c, t, g, unknown or other
  misc_feature (759)..(759): n is a, c, g, or t
  modified_base (765)..(765): a, c, t, g, unknown or other
  misc_feature (765)..(765): n is a, c, g, or t
tcagcgatcgtatacacgaccggtgctcgatttagatctactgacaggggggtgggtccaggaggcagaactctgggtgtctcaccatggcctggactccctctacttcctccccctcctcactctctgcacaggctcgtgacggcctcctagtgtacgctgacacgcgccctacccgtggtcgtccgtacgtcccccgaggacgagacgggccaggactccgacctgctcgtaggagtatgacgtataccgacctaacccgtattactttacgttaacgttacggaaccagacgaacgacgacgacggaccgaccgtcccgttgtggttagttaggtaattaacgtaaagtaaacgaaccgtactacggtacggacgtaccgttaccgtaagggtaccttaccggtacgtaacggtccgttacgttccgttccggtacggttccctaaccctaccgttaacggacggtaacgtaagttccgggtaactaacccgttataacggaaccgtaacgtacggttaacggtaacgggtaccgtaaccggtacgggtaaccgaagggtaaaccgggacggtaacggtaacgttacgggttacctttacgtttaacgtacggttaaacctacgttacgtacgtaaacgtaccgttaagtacctaagggttagtttaccggttaacttcggtacgttaacggtaaccggtacgggaactacgtaccgtacgtcgtaagtccggtacgacccgaacgaccctacccncgttanacctcgtccgttaccccg

SEQ ID NO: 50113 - DNA, 708 bp, Homo sapiens
  misc_feature: GYAE6OF01ALFEK.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtcccccaggacagaccggccaggactcacctgctctggagatgctagttcgacccaaacccctacttatttcttagttcggtaccagcagaacgccaggccacggccctgtgttgtgatataataagacactgaggcggtccttcgagggtactccccgtgacgtccgtattcctcgtcggtcctcccacccgtacgaagggacaacgtggtacactagttacgaccagttacgtaggtggacggtccgaagggtacaagggaaacgacggacggtcgtacgactttttttagtctcgtactacttcgttacaacgtaactacgttacgtaggtttacgttaacgttacgttacgttaccggtttaaccggtaacggttaaccggggtaaccgtaaaccgggttaccccgtaaccccggttaccgttacgggttacccgacccggaaccccccggtaaaccgggtacccccctaaacccccgtaccgttacccgttaccccgtaacccgtttcccgtttaacccccccgg

SEQ ID NO: 50114 - DNA, 759 bp, Homo sapiens
  misc_feature: GYAE6OF01ENBQI.51.6.A06.1.454.CMB.1.raw
tcagcgatcgtatacacgaccggtgctcgatttagatctactgacagggggtgggtccaggaggcagaactctgggtgtctcaccatggcctggatccctctacttctcccctctcactctctgcacaggctctgaggcctcctatgtgctgacacacgccaccctcggtcgtccgtcgtccccaggacaggacggccaggatccactgctcgtggagatgctattcgacccaacccacttatttctttattcggtaccagacagaacgccgacggccacggccctgtgttcgttagaattataagtaaagactacgtaggacggtacggtccttacggaagggtactcccgtagacgtacgtacttctcgtcggcctaccgactcgacggactaagtcgtacactacgttacgactagtacgaggtacggacgtacgaacggtacgaaggtaaacgacggtacgtcgtacggttaactttacgtttaccgtacgtacttaacgttcctttaacgaactaactacgttacgtaacgggtttacgtttaacgtttacgttacggtttaccggttaacgggtaaccggttaacggggtaacccgttaaacggggttaccccgttaacccggttaaccccgggtttaacgggtaaccccggtaacccggtaaacccccggtaaaccccggtaaacccccgtaaaccccccgttacgttaccccgttaacccgttaccccgttacccgtttaaacccccccgg

SEQ ID NO: 50115 - DNA, 841 bp, Homo sapiens
  misc_feature: GYAE6OF01BL8ML.51.6.A06.1.454.CMB.1.raw
tcagcgatcgtatacacgaccggtgctcgatttagatctactgacgagggggtgggtccagggaggcagaactctggggtgtctcaccatggcctggactccctctaccttcctccccctcctcactctctgcacaggctcgtgacggtcctctatgtcgctgaacacacgtccctacccgtcgggtcgttccgtaccgtaccccgaaggaccgaggaccggccgaaggtactcctaccgtcgacttcggtagggagtacgtgcctaagttccgaacccaaacctacgtttactttacgttacgtaccgggtaaccaaggtaccgaacggtaacgaccgtaacgcccgtaccgggtcccgttaggtttgtttaggttacaaagtttaactaaaaggaaaaccaccgtaggtacgggacggtaccggttaccgttacggaccggtaacgtccccgtaaggtacgtacgttacgttccgtacggtcggaacccttaccgtacccggtaaggaacggtaacgtacgttcgaaccgtacttaacggtaacctacgtaacgttagggtaccgggttacggaccggtaaccgaacggggtacgaaaggggaaacggaacggttcgggtaacttaccggtttatttaaccgttcgttaactaacgttacctattacgactaagtccgtattaaacgggttcttaagttttaggcttaccgttacggggaactaaccgggtaccgtaaaccgggtacttacccgggtaacgttaccggaactcccggaaacccgtaacccccgacccgttaaccgttaaccgacttaccgttcccgttcccgttaaccc

SEQ ID NO: 50116 - DNA, 744 bp, Homo sapiens
  misc_feature: GYAE6OF01E4CDS.51.6.A06.1.454.CMB.1.raw
  modified_base (126)..(126): a, c, t, g, unknown or other
  misc_feature (126)..(126): n is a, c, g, or t
tcagcgatcgtatacacgaccggtgctcgatttagatctactgacagggggtgggtccaggaggcagaactctgggtgtctcaccatggcctggatccctctacttcctccccctcctcactctcngcacaggctctgaggcctcctatgtgctgacacacgcccaccctcggtcgtccgtcgtccccgaggacagacggccaggatccacctgctcgtggagatgctagttcgacccaaccctacttactttccgtttaagtttacgggtaacccagacgaacggaacgcccgacggcccgaccggtcccttggttgtttgtagtaattaactaagtaaaacgacacgtagaacggacggtaccgtttacggaacgggtacctacccgtaggacgtcgtactttccgtcgtcggtccctacccgtaaccgtacggaacgggaactaacggtcggttacaactagttacgacctacgtacgtaacgggtaggaccgtacggacggacgaaggaaacggacggacggtcgtaacgtactttatttccgtatactaacgtttccttacacgtactacgttacgtaggttacggttaactttagtcggtttaccgttaccgggtaacggtacgggtaaccgtaaccggtcccgtaccggttacccgttaggacccgtacccggaccccgaacccgtaacccccgaaccccttacgttacccgttaccctcccgttcccgttaccccg

SEQ ID NO: 50117 - DNA, 658 bp, Homo sapiens
  misc_feature: GYAE6OF01AVCBD.51.6.A06.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggancacctgctcnggagatgcattcgacccaacccacttattcttattggtaccagcagaagccaggccaggccctgtgttgttgatatataaagacactgaggaggccttcgaaggactccctagagcgtattccttcgtcggtcctcccgtacctcggaacgggtaactaagtcgggttacactagtttacgaaccctatacgtaggtgggacgtacccggagggacgaacgggaaacggtacggaacgggtccgtaggtaacctttaagttttcctacgttacaatttccttacgacgtaactagttaccaggttacggtttactttagttccgttacgttacggaacgttcgggaaaccgtacggtaccgtacccgttccggtaaggtccgaaccggtacccgaacggcccccctaaacccgtacccgtagttccctaacccttcgtttacccccg

SEQ ID NO: 50118 - DNA, 708 bp, Homo sapiens
  misc_feature: GYAE6OF01D6W2H.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctctatgtgctgacacagccaccctggtgtccgtgccccaggacagacgccaggatcacctgctctggagatgcatcgaccaacccattattcttatggtaccagcaagagccgagtccacgtccctgtgttgttgattataataaagacactagaggaacggccttacgagggtactccctagagcgtattctacgtcggcctccacccttcgaagggaacctaaagtcggtaccaacgtacttacgaacctactaccggtaaggtagggtacgtacccgaaggaccgaaaggtaaccggaacggaacgggtactaccggtaactttagtttaccgtacgtacctaaacttcttaacccgaagtaaccaagttaccgtaaacggtttacgggttaacgtttaaccgtttagggttacccttaacgggtaaaccgtttcggaacccgtaaccgtaaacgggttccccgtaacccggtttcgggtaccgggtacctaaaccggacccccgtaaaacgggtccccctaaaacccccggttacctacggttcccctacggttacccccgg

SEQ ID NO: 50119 - DNA, 661 bp, Homo sapiens
  misc_feature: GYAE6OF01DH6GE.51.6.A06.1.454.CMB.1.raw
  modified_base (125)..(125): a, c, t, g, unknown or other
  misc_feature (125)..(125): n is a, c, g, or t
  modified_base (135)..(135): a, c, t, g, unknown or other
  misc_feature (135)..(135): n is a, c, g, or t
  modified_base (153)..(153): a, c, t, g, unknown or other
  misc_feature (153)..(153): n is a, c, g, or t
  modified_base (204)..(204): a, c, t, g, unknown or other
  misc_feature (204)..(204): n is a, c, g, or t
  modified_base (209)..(209): a, c, t, g, unknown or other
  misc_feature (209)..(209): n is a, c, g, or t
  modified_base (212)..(212): a, c, t, g, unknown or other
  misc_feature (212)..(212): n is a, c, g, or t
  modified_base (216)..(216): a, c, t, g, unknown or other
  misc_feature (216)..(216): n is a, c, g, or t
  modified_base (274)..(274): a, c, t, g, unknown or other
  misc_feature (274)..(274): n is a, c, g, or t
  modified_base (279)..(279): a, c, t, g, unknown or other
  misc_feature (279)..(279): n is a, c, g, or t
  modified_base (349)..(349): a, c, t, g, unknown or other
  misc_feature (349)..(349): n is a, c, g, or t
  modified_base (355)..(355): a, c, t, g, unknown or other
  misc_feature (355)..(355): n is a, c, g, or t
  modified_base (406)..(406): a, c, t, g, unknown or other
  misc_feature (406)..(406): n is a, c, g, or t
  modified_base (488)..(488): a, c, t, g, unknown or other
  misc_feature (488)..(488): n is a, c, g, or t
tcagcgatcgtatacacgaccggtgctcgatttagatctactgacagggggtgggtccaggaggcagaactctgggtgtctcaccatggcctggatccctctacttcctccccctctcactctcngcacaggctntgacggcctctatgtgcngacacagcccaccgtggtcgtccgtcgccccaggaacgcgccgagatcacngctcnganagtncgatgaccaaccacttaattcttatagtaccagacagaacgcgacgacgtacgccgtntgttntagaatataactaaagacactagacgtagtaccgttgaacggtactcccgtagtagacgtacttcttcgnggaccncctacgtagaacgggaatacgtgtacccgtatacgttacgacagttaacgnggtacggacgtacgaacggagaacgaaggaacgaggtactccgggttaattacttacgagttacctaacttgttaaccgtanaaggaccttgtaacggtcgttacgttaagtcctaggttacggtaacggacggtaaccggttaacgacccggttaaccgtaccgtacggtaccgaaccgaaccccgttaacgggaaccccctaaaccccgtcgtaccttaacccgttaccgttccgttccccggttaaaccccc

SEQ ID NO: 50120 - DNA, 820 bp, Homo sapiens
  misc_feature: GYAE6OF01BW59O.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctctcactctctgcacaggctctggaggcctcctatgtgctgacacgacgcccacccgtcggtcgtccgtcgtaccccgaggacgagaccggccaggtactccaccgtgccttcgtaggaatacgtcgtactaacgttccgaacccctaaaccttacttacttttaccttagttacggtaccagaccgaacgtaacgcccgaacggacccgtaccggtcccgttggttaggtttgttaagtacgttaaactaacgtaaacgaccgtacgtaggtaaccggtaccggtaccgttacgggaacggtaccttacccggtaggtaacggtctttacgttcccgtcggtccgtacccttaccctaacggtacggaaggtaacgtacgtacggtacctaacgttacgtacgaacctacgttcggaggttacggaacgtaccggaacggtaaccgaagggtaaacggacggtacgtagtttaaccgtaacttttcggttacgtacgtaaccttaagtttaccgtacgtaacggttactcgttaacggttacggtttacggttaactttcggttaccggttcggtaaaccgggtacggtaccgggtaacctaccgggttaccctaaccgggttacgttaccgaccggacccggaacccgtaaccctacccccggtaaactccggtttaccaccggtttccctcccggttacccccg

SEQ ID NO: 50121 - DNA, 785 bp, Homo sapiens
  misc_feature: GYAE6OF01A7E4R.51.6.A06.1.454.CMB.1.raw
  modified_base (179)..(179): a, c, t, g, unknown or other
  misc_feature (179)..(179): n is a, c, g, or t
  modified_base (256)..(256): a, c, t, g, unknown or other
  misc_feature (256)..(256): n is a, c, g, or t
  modified_base (261)..(261): a, c, t, g, unknown or other
  misc_feature (261)..(261): n is a, c, g, or t
  modified_base (372)..(372): a, c, t, g, unknown or other
  misc_feature (372)..(372): n is a, c, g, or t
  modified_base (500)..(500): a, c, t, g, unknown or other
  misc_feature (500)..(500): n is a, c, g, or t
  modified_base (508)..(508): a, c, t, g, unknown or other
  misc_feature (508)..(508): n is a, c, g, or t
tcagcgatcgtatacacgaccggtgctcgatttagatctactgacgagggggtgggtccaggaggcagaactctgggtgtctcaccatggcctggactccctctacttcctcccctctcactctctcgcacgaggctcgtggacggtccttactagtgtcgacgtacgaacaccgaccncccgtacccgttcggtccgtccgtccgacccgaggacgacggacggccgaggactccgacgtcgtcttcgagggtanacgtntactacgttacccgaaccctaaccgtacttactttacgtttacggtaccgacctacggacgtaacgaccggacccgacgggtcccgtaccgggtccttggttcgttgttanacgtaataacggtaacacgtacggtacggaccggtacgttcgtaacggacgggcctttacgggacgtcggacgttacgtcccgtacggaccggtctacgacgtacgaggactcgtacgtatacgtacncgtaacgntacggacggtacggtacctaggacgagggaacgacggaccggtaacgtaccggtacttaaccttgttacggtacctttaacgtacgttacgtacggaaaccttcgttaaacgttccgggttatacggtttaacgttcgttaacggttaccgtacggtaccggttaacggtacctaaacgggttacccgttcggtaaacccggtgtacccggccggttaacccgaccccgtaaacgttcccccggtataccgttacccttcgggtaccccgttacccg

SEQ ID NO: 50122 - DNA, 688 bp, Homo sapiens
  misc_feature: GYAE6OF01D8ZVX.51.6.A06.1.454.CMB.1.raw
  modified_base (273)..(273): a, c, t, g, unknown or other
  misc_feature (273)..(273): n is a, c, g, or t
  modified_base (308)..(308): a, c, t, g, unknown or other
  misc_feature (308)..(308): n is a, c, g, or t
  modified_base (613)..(613): a, c, t, g, unknown or other
  misc_feature (613)..(613): n is a, c, g, or t
tcagcgatcgtatacacgaccggtgctcgatttagatctactgacagggggtgggtccaggaggcagaactctgggtgtctcaccatggcctggactccctctacttctccccctcctcactctctgcacaggctctgacggcctcctatgtgctgacacacgccacccgtcggtcgtccgtcgtccccgaggacacggaccggccaaggactcacctgctctggagatgcattcgaccaacctacttattcttattacgtaccagcaagacncgacggccacggccgtagtgttgtagataagtaanaaagactacgtagacggtcggtacttggacggtacctcgtagacgtcgtaacttcgactacggacccttacaccgtagaacggtaactagttcggactaacgtacgttccgaactagtacggacggtacggaccgtaacgagggtaacgaaggaaacgtaccggagtcctacggtaactttagttacgttactaacttaaccgtcttacaacgaaccgtagtacgtagtacgtttaacttacttacggtacggttaccggtagtaacccgggtacgttaaccggtaccgtaccggtaacggttanacccggtaccgaaacccgtaccgaacccccgtaaacccgtacgttacgtacccttaaccgtcgttacccccccgg

SEQ ID NO: 50123 - DNA, 659 bp, Homo sapiens
  misc_feature: GYAE6OF01COMYR.51.6.A06.1.454.CMB.1.raw
  modified_base (644)..(644): a, c, t, g, unknown or other
  misc_feature (644)..(644): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacacgccaccctcggtcgtccgtgtcccccaggacagacggccaggactcacctgctcgtggagatgcattcgacccaaccctattattcttagttcggtacacgcaagaacgccacggccgacggccctgtgttgttgatataataaacgacacgtagacgacggtccttacgacgggtactccccgtaggacgtcgtaactttcgtacgttcggtacctacccgtaccctacgaacggggaactaaggtcggtacacgtagttacgacctacgtacgaggtaggacgtaccgaggacgaaggaaacggcgaaggtcctacgtacttactttcgtactactaactttcctactacgactagtacgtaggttacgttacgtttagtaccgttacgttacggtaaccggtcggtaaccgtaacggtaccgtacccggtaccgtaggtaccgaccgacccggaaccgaccctaacccgtactccgtaccncgttccgttaccccg

SEQ ID NO: 50124 - DNA, 701 bp, Homo sapiens
  misc_feature: GYAE6OF01EP41T.51.6.A06.1.454.CMB.1.raw
  modified_base (145)..(145): a, c, t, g, unknown or other
  misc_feature (145)..(145): n is a, c, g, or t
  modified_base (167)..(167): a, c, t, g, unknown or other
  misc_feature (167)..(167): n is a, c, g, or t
  modified_base (333)..(333): a, c, t, g, unknown or other
  misc_feature (333)..(333): n is a, c, g, or t
  modified_base (696)..(696): a, c, t, g, unknown or other
  misc_feature (696)..(696): n is a, c, g, or t
tcagcgatcgtatacacgaccggtgctcgatttagatctactgacagggcacgaccggtgctcgatttagatctactgacagggcacgaccggtgctcgatttagatctactgacgagggggtggccaggagcagactcgtggtntctcacatcggctgactccctntacttcctcccctctcactctctgaccacgaggtccttcgtaggaccgtcccttactagtggtagcctacgaccacgaccgtcccctaccgttggtccgtcccgtaccgtacccgaggtaccgaacggacccgaccgtaggacctaccaccgtcgtctagtagganacgtcgactacgtaccgacccgtaacctacttatttcttagtacgtacgacgtacgaacgacgaccgacggaccgtacggtcccgttaggttacggttacgttataagttaacgttaaacgaaacgtacgtaacggtacgtaaccgggtcggttacctaacggtacggtacctacggtagtaacgtacgttacgttcgtaccgtaccgtaccctaccgtacgtaccggtagtaacgtacgtccgtaactacgtaactacgtaacgtacgttacggaacgtacggacgtacggacgaacgtaagaaccggtacggacggtagttaacgtcgtttacgttctaccgtatacctacgttagacgtntaacg

SEQ ID NO: 50125 - DNA, 738 bp, Homo sapiens
  misc_feature: GYAE6OF01CDORZ.51.6.A06.1.454.CMB.1.raw
  modified_base (196)..(196): a, c, t, g, unknown or other
  misc_feature (196)..(196): n is a, c, g, or t
  modified_base (253)..(253): a, c, t, g, unknown or other
  misc_feature (253)..(253): n is a, c, g, or t
  modified_base (289)..(289): a, c, t, g, unknown or other
  misc_feature (289)..(289): n is a, c, g, or t
tcagcgatcgtatacacgaccggtgctcgatttagatctactgacagggcacgaccggtgctcgatttagatctactgacagggcacgaccggtgctcgatttacgatctactgacagggggtggtccaggaggcagaactctgggtcgtctcaccatcggcctggatccctctacttcctccccctcctcactcnctcgcacaggctcgtgagtcctctatgtcgctagaccacgacgccctaccgtcggtntacccggtgtacccgaggacacggaccggcaggacncacctgctctggaacagtcggacacttccgaccgtaaccctactaactttcttacgttacggtacctagactaacgaacgacctaggacccgacgggtcccctaggttcggtttagttacggaattaaactagtaaaacggtactaacggttaggtaacgtaccggtaccgtacggtaacgggtacgttacccgttagggaacccgtaggttacctttccgtacggtcgggttaaccttacccggtacccgtacggacggtaaccgaacgttacggtacctacggttaagttaccggaaccgtttacgaccggtagggttaacccgggtcgtaacccggacggtaccggaaaagggtaccgacggggtaacgtacccgaggttaccctttaccggttaccgttaacggtaccttaaacgttaccgttaaccttaaagggtcctaaacgg

SEQ ID NO: 50126 - DNA, 739 bp, Homo sapiens
  misc_feature: GYAE6OF01ASHAU.51.6.A06.1.454.CMB.1.raw
  modified_base (186)..(186): a, c, t, g, unknown or other
  misc_feature (186)..(186): n is a, c, g, or t
  modified_base (191)..(191): a, c, t, g, unknown or other
  misc_feature (191)..(191): n is a, c, g, or t
  modified_base (225)..(225): a, c, t, g, unknown or other
  misc_feature (225)..(225): n is a, c, g, or t
tcagcgatcgtatacacgaccggtgctcgatttagatctactgacagggcgaccggtgctcgatttagatctactgacgaggggtgggagcctagctgtgctggtgggtccaggagcagactcgtgggtgtctcaccagtcggcctggactccctcttacttccctcccctctcactctctgcacngtctntgaccgtcctctagtgtacgctacgacacgtacncccgtccggttcggtccgtacccgtccggtaccccgaggaccgacggacccggcgtaggtacctaccgtaccgtacgtccgttacgtagggtaccgtagtcgtacgtaccgttaccgacccgtaaaccctttactttacgtttacgtttacgttacggtacacgacgtaacggtacgtacggtacgtccgtaccgggttcccttaggttcgtttacgtagtaactaaggtaaactagtacgtacgtacggacgtaccggttacgtacggtacgaccggtacgtacgcgtacgttccttacgtccggttcctaccgttacccgtacggtaacggtacggtaacttacggtccgttaaccacgttaacgtacctaacgtacgtacggttaaccggaccgttacggtacggaacgtacggaacggaacgacggtacgacgttaattcggttacttaacgtcgtacttactcgtacgtactacgtactacgtacggtttacttacgttcggttaacgg

SEQ ID NO: 50127 - DNA, 499 bp, Homo sapiens
  misc_feature: GYAE6OF02IT648.51.6.A06.1.454.CMB.1.raw
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggccccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaggtcaccgtcctaggtcagtcccaaggcccaacccactcgtcactctccg

SEQ ID NO: 50128 - DNA, 507 bp, Homo sapiens
  misc_feature: GYAE6OF02IW7CX.51.6.A06.1.454.CMB.1.raw
  modified_base (306)..(306): a, c, t, g, unknown or other
  misc_feature (306)..(306): n is a, c, g, or t
  modified_base (326)..(326): a, c, t, g, unknown or other
  misc_feature (326)..(326): n is a, c, g, or t
  modified_base (400)..(400): a, c, t, g, unknown or other
  misc_feature (400)..(400): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttnagggatccctgagcgattcnctggctccacctcagggacaatggtcacattgaccatcagtggagtccaggcagaagacgagctgactatttcngtcaatcttcagtacatcagtgtacttatgttcttacggaactgggacctaggtcaccggtctaggtcacgacccgaaggcccaacccactcgtccacgtcttccgg

SEQ ID NO: 50129 - DNA, 491 bp, Homo sapiens
  misc_feature: GYAE6OF02GIA4M.51.6.A06.1.454.CMB.1.raw
  modified_base (403)..(403): a, c, t, g, unknown or other
  misc_feature (403)..(403): n is a, c, g, or t
  modified_base (480)..(481): a, c, t, g, unknown or other
  misc_feature (480)..(481): n is a, c, g, or t
  modified_base (487)..(487): a, c, t, g, unknown or other
  misc_feature (487)..(487): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattgccaacccactattcttattggtaccagcagaagccaggccaggccccctgtgttgttgatatataaagacactgagaggccttcagggatccctgagcgattctctggctccacctcagggacaatggtcacattgaccatcagtggagtccaggcagaagacgaggctgactatttcngtcaatcttcagacatcagtggtacttatgtcttggaactgggaccaggtccacgtctaggtcagcccagccacccnntcactntccg

SEQ ID NO: 50130 - DNA, 670 bp, Homo sapiens
  misc_feature: GYAE6OF02JI4C9.51.6.A06.1.454.CMB.1.raw
tcagcgatcgtatacacgaccggtgctcgatttagatctactgacaggggtgggtccgaggaggcgagaactctgggtgtctcaccatggcctggatccctctacttctcccctcctccacctctctgcacaggctctgaggcctcctatgtgctgacacagccacctcggtgtccgtgtccccaggacagacggccaggatcacctgctctggagatgcattgcccaaccactattctattggtaccagcagaagccaggccaggcccctgtcgttgtgattatataaagacactgagaggccttcgagggatccctgacgcgattctctcggctcctactcgagggacaagtggtcctaacactttacgaccaattccgtaggtacggtagtacccgagggtaccaacggaaaggaaaccggtacgggtacttacggtaacttacgttttaccgtagttacgaaacctttcgtttaccgaacgtaacgtacgttacgtaacggtttacgggtttaaaccttttagttacgggtttccgtttaacggtaaacccgttgggggtaaccccaagggtttcccgtaacccggttaccgttacgggtaccgtaacgccccgtaaagggtaccccaacccgtacccgttagtacccgtacccttccgttacccg

SEQ ID NO: 50131 - DNA, 494 bp, Homo sapiens
  misc_feature: GYAE6OF02I3JM1.51.6.A06.1.454.CMB.1.raw
  modified_base (399)..(399): a, c, t, g, unknown or other
  misc_feature (399)..(399): n is a, c, g, or t
  modified_base (490)..(490): a, c, t, g, unknown or other
  misc_feature (490)..(490): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtgagtccaggcagaagacgaggctgactatttcngtcaatcttcagacatcagtgtacttatgttcttcggaactgggaccaggtcaccgtctaggtcagcccaaggcccaacccatcgtcactntccg

SEQ ID NO: 50132 - DNA, 809 bp, Homo sapiens
  misc_feature: GYAE6OF02FFKLV.51.6.A06.1.454.CMB.1.raw
tcagcgatcgtatacacgaccggtgctcgatttagatctactgacgagggggtgggtccaggaggcagaactctgggtgtctcaccatggcctggatccctctacttcctccccctcctcactctctgcacaggctctgaggcctcctatgtgctgacacacgcccacccgtcggtcgtcccgtcgtccccgaggacaggaccggccaggatccacctgctcgtgggagatcgcctagttccgaccctaaaccctacttactttccgtttagttacggtaacccgaacggaccgaaacggaaacgccccgaacgggccccgtaaccgggtccccccgtttggtttacggttttaggtttacggtaattaacgttaaaagtaaaacgtaactaacgttaggaacggtacggtcccgtttacggaacggggtaccttacccgtaggtacgtccggttaactttccgttccgtcggtacccttacccgaaccgttaccggaacggggtaaactaacggttcggtaacctaaccgttaacgtttaccgacctagtaccgaagggttacggacgtaccgagggacgaaacggtaacggacggtacggtactacgtaacctttacgttttccgacgtttaacctaacttccgttacgaacgtacttaacgtaccggttaagtttacgtttaacctttagttccgttaccgttacggtaacgtacgggaacccgtacgtaccgaccgttacgacgtacccgaccgtacccgaaccggtaccccacccgtcctcgtacctaccgttcccttaccccg

SEQ ID NO: 50133 - DNA, 502 bp, Homo sapiens
  misc_feature: GYAE6OF02GFNFP.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtgagtccaggcagaagacgaggctgacttatttctgttcaatcttcagacatcagtgtacttatgtcttcggaatgggacctaggtcaccgtctacggtcacgcccgaaggcccaacccacgtgtcctactctccg

SEQ ID NO: 50134 - DNA, 500 bp, Homo sapiens
  misc_feature: GYAE6OF02F6PSZ.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattgccaacccactattcttattggtaccagcagaagccaggccaggcccctgtgttgttgatatataaagacactgagaggccttcaggggatccctgagcgattctctggctccacctcagggacaatggtcacattgaccatcagtggagtccaggcagaagacgaggctgactatttctgtcaattcttcagacatcagtgtacttatgttcttcggaactgggaccaggtcaccgtctaggtcagcccaaggcccaacccactgtcactctaccg

SEQ ID NO: 50135 - DNA, 496 bp, Homo sapiens
  misc_feature: GYAE6OF02I46B3.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggccccctgtgttgttgatatataaagacactgagaggccttcagggatccctgagcgattctctggctccacctcagggacaatggtcacattgaccatcagtggagtcaggcagaagacgaggctgactattctgtcaatctcagacatcagtgtacttatgttcttcggaactggaccaggtcaccgtctaggtcacgcccaaggcccaacccactgtaccactctccg

SEQ ID NO: 50136 - DNA, 498 bp, Homo sapiens
  misc_feature: GYAE6OF02F342S.51.6.A06.1.454.CMB.1.raw
  modified_base (402)..(402): a, c, t, g, unknown or other
  misc_feature (402)..(402): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcgagggatccctgagcgattctctggctccactcagggacaatggtcacattgaccatcagtggagtccaggcagaagacgaggctgacttatttcngtcaattcttacagacatcagttgtacttatgttcttcggaatggaccaggtccaccgtcagtcacgccaaggcccaacccactctccactctccg

SEQ ID NO: 50137 - DNA, 496 bp, Homo sapiens
  misc_feature: GYAE6OF02JP45X.51.6.A06.1.454.CMB.1.raw
  modified_base (412)..(412): a, c, t, g, unknown or other
  misc_feature (412)..(412): n is a, c, g, or t
  modified_base (429)..(429): a, c, t, g, unknown or other
  misc_feature (429)..(429): n is a, c, g, or t
  modified_base (480)..(480): a, c, t, g, unknown or other
  misc_feature (480)..(480): n is a, c, g, or t
tcagcgatcgtatacacgaccggtgctcgatttagatctactgacagggggtggggtccgaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaacccactattcttattggtaccagcagaagccaggccaggcccctgtgttgttgatatataaagacactgagaggccttcgaggatccctgagcgattctctggctccacctcagggacaagtggtcactattgaccatcagtggagtcaggcagaagacgagctgactattctgtcatcttnagacatcagtgtacttntgtcttacggaatggaaccagtcacgtctaggtcacgccaagcccaacccngtcgtacactctaccg

SEQ ID NO: 50138 - DNA, 494 bp, Homo sapiens
  misc_feature: GYAE6OF02HVGGH.51.6.A06.1.454.CMB.1.raw
  modified_base (479)..(479): a, c, t, g, unknown or other
  misc_feature (479)..(479): n is a, c, g, or t
  modified_base (490)..(490): a, c, t, g, unknown or other
  misc_feature (490)..(490): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgcccaaacccatattcttattggtaccagcagaagccaggccaggcccctgtgttgttgatatataaagacactgagaggccttcagggatccctgagcgattctctggctccacctcagggacaatggtcacattgaccatcagtggatccaggcagagacgaggctgactatttctgtcaatcttcagacatcagtgtacttatgttcttgaactgggaccaggtcacgtctaggtcagcccaaggcccaacccntcgtacacctntccg

SEQ ID NO: 50139 - DNA, 494 bp, Homo sapiens
  misc_feature: GYAE6OF02HGE8X.51.6.A06.1.454.CMB.1.raw
  modified_base (483)..(483): a, c, t, g, unknown or other
  misc_feature (483)..(483): n is a, c, g, or t
  modified_base (487)..(487): a, c, t, g, unknown or other
  misc_feature (487)..(487): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtgtacttatgtcttcggaactggaccagtcaccgtctaggtcagcccaaggcccaacccgctntacnctctccg

SEQ ID NO: 50140 - DNA, 556 bp, Homo sapiens
  misc_feature: GYAE6OF02H2QBD.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccatattcttattggtaccagcagaagccaggccaggcccctgtgttgttgatatataaagacactgagaggccttcagggactcccgtgagcgattctctggctccacctcgagggacaagtggtcacattcgaccatcaggtggagtccaggcaaggaagacgaggctgacttatttctgtactaatcttacagtacatacgtagtcgttaacttagttcgtcgtttacggaaacgtcgggtaaccgtagggttccaccggttaccgtacggtcaaccggacccgtaaggaccccaaccccgactcgtccctactccgttacccgg

SEQ ID NO: 50141 - DNA, 687 bp, Homo sapiens
  misc_feature: GYAE6OF02H1YQP.51.6.A06.1.454.CMB.1.raw
tcagcgatcgtatacacgaccggtgctcgatttagatctactgacagggggagcctagcgtgtgctcgtgggtcccaggaggcagaacttctgggtgtctcaccatggcctggatccctctacttctccccctcctcactcttcgtgcacaggcttctgaggcctctaatgtgctgacacagccaccctggtgtccgtgtccccgaggacagacggcaggatcgacctgctctggagatgcattcgcccaacccatattcttatttcggtaccagacagaagccagggccaggcccctggtcgttgttgattagtaagtaaagacacgtggaagtacggcctttacgaaggggtacttccccgtggtacgtcgactttccgtcgtacggccttaccctaccgttacgaacgggacctaagttcgggtaccaacgttagtttacggaaccctagttaccgtaaggttacgggaaccgttcccgaagggacgaacggaaacggaccggaacgggacgtaggtaacctttaacgttttccttaggttacctaaacttccgtttacgaagtaacctaagttcgtaagttcggtttaactttaacgtcggttacgttaccggaaacgttcgggtaaccctaaggttcccgtaaccggttccgttaaggggtccgtacggtaccccgtaacgg

SEQ ID NO: 50142 - DNA, 962 bp, Homo sapiens
  misc_feature: GYAE6OF02HLI29.51.6.A06.1.454.CMB.1.raw
tcagcgatcgtatacacgaccggtgctcgatttagatctactgacagggggtggggtcccaaggaggccagaacgtctgggtcgtctcaccatggcctggatccctctacttctcccctcctcactctctgcacaggctctgaggcctcctatgtgctgactacagtccaccctcggtcgtaccgtcgtccccgaaggacaggaccggaccaaggacgtccacctgctacgtggacgtagtcgactacgttcgacccaaaccctacttaactttacctttaagtttcgggtaaccctaggtaccgtaaggaaacggacccgaacggggcccctaacggggtaccccccttagggttcggttttagggtttacggtaagttaagttaaagggttaaaaacgggtaacctaaccgttagggtaacgggtaaccgggttaccccttttaaccggtaacgggggttaaccttacccccgttaaggtaacggtaccgggtaaacttttccgttaccggttacgggtaccccttaccccgtaacccgttaccggaacgggggtaaaccctaaaacggttacggggttaaccaaaccgttaaacgttttaccggaaaccctaacttttacccggaaacggggttacgggtaaaccggtttacccggaaacggggtaccgtaaacgggaaacgggtaaccgggtaacggggtacccgttaacgggtaaaccgtttaaccgtttttaccggttacggttaacccgttaaacgttaccgttaacgtaaccgtaaccgtacgttacgtaacggtttacggttaactttacgttcggttaccgttaacggaaacgttacggggaaccgtacgggttccgtaaccgggttccgttaaggttaccgaacggtacccgtaacggaccccgtaaaccccggtaccgttaccggtacctaccgttacccgttaccccgg

SEQ ID NO: 50143 - DNA, 615 bp, Homo sapiens
  misc_feature: GYAE6OF02IAMNV.51.6.A06.1.454.CMB.1.raw
  modified_base (313)..(313): a, c, t, g, unknown or other
  misc_feature (313)..(313): n is a, c, g, or t
  modified_base (331)..(331): a, c, t, g, unknown or other
  misc_feature (331)..(331): n is a, c, g, or t
tcagcgatcgtatacacgaccggtgctcgatttagatctactgacagggggtgggtccaggaggcagaactctgggtgtctcaccatggcctggatccctctacttcctccccctcctcactctctgcacaggctctgaggcctcctatgtgctgacacagcccaccctcggtgtccgtcgtccccaggacagacggccaggatcacctgctctggagatgcattcgacccaaaccccattactttcttattggtaaccagcaagaacgccaggccacggcccctgtgttgttgatatataaagacactgagngtccttcgagggactccngacgcgtattctctcggcctcctaacctcgaagggacaagtcggtcaactattcgaccatcgagtggacgtccgaggcaaggaagacgacggctagtaacttatttcgtgtactaattcttacgacgtactatacgtagtcggttaactttagttcgtttccgttacggaaccgttacggggaacctaacgggtcctaccggtcccgttagggtaccaacccggtaccccgaaaggtacccccaaccccgtacgttaccggtaccttacccgttcgttaccccg

SEQ ID NO: 50144 - DNA, 724 bp, Homo sapiens
  misc_feature: GYAE6OF02JPVTG.51.6.A06.1.454.CMB.1.raw
  modified_base (131)..(131): a, c, t, g, unknown or other
  misc_feature (131)..(131): n is a, c, g, or t
  modified_base (232)..(232): a, c, t, g, unknown or other
  misc_feature (232)..(232): n is a, c, g, or t
tcagcgatcgtatacacgaccggtgctcgatttagatctactgacaggggtgggtccgaggaggcgagaactctgggtgtctcaccatggcctggatccctctacttctccccctcctcactctctgcacnggctctgaggcctcctatgtgctgacacagccaccctcggtgtcccgtgtcccccagggaccagtacggcccaagggactccaacctgctcgtaggaagtntgcctattcgacccaacccacttattctttaagttcggtaaccagtcagaagccaggccaggcccctagtcgttgttgatatataaagactaactgaagacggtcgttaccagggtactcccgtaggacgtcggtaacgtttctccgtggtccgtcccgtacctacccgtagggaacccgtaagtacgggtaccaacctaagtttacgaaccctacgtacgaacggttaggacgttaccgaaggtcgaaacggtaacggaaaccggagggtaccgtacggaacgttaaacgtttccgttaggtacctaagttaccgttccgaagtacccaagttaccgtaacgtggttaacctttaagttcgttacgttaccggtaacgttacgggtaaccgtaggttaccgtaacccggtcgttaacgggttccgaacggttcccaaacgggccccgtaaaccccgtaccgttacgtaccctaccgttccttaaccccggg

SEQ ID NO: 50145 - DNA, 521 bp, Homo sapiens
  misc_feature: GYAE6OF02JA04D.51.6.A06.1.454.CMB.1.raw
  modified_base (505)..(505): a, c, t, g, unknown or other
  misc_feature (505)..(505): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccactattcttattggtaccagcagaagccaggccaggcccctgtgttgttgatatataaagacactgagaggccttcgaggatccctgagcgattctcgtggctccacctcagggacaagtcggtcaactattcgacctatcgagtcggacgtccaagggcaaggaaagaccgaggctaggaacttagtttctgtacaatctacagacatcagtggtacttatgtctacggaactggtacagtcaccgtctaggtcacgtcccgaagccctaacccntacgtccactctaccg

SEQ ID NO: 50146 - DNA, 511 bp, Homo sapiens
  misc_feature: GYAE6OF02HC7TR.51.6.A06.1.454.CMB.1.raw
  modified_base (498)..(498): a, c, t, g, unknown or other
  misc_feature (498)..(498): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattgccaacccactattcttattggtaccagcagaagccaggccaggcccctgtgttgttgatatataaagacactgagaggccttcgagggtatccctgagcgattctctggctccacctcagggacaatggtcactattgacccatcagtggagtccaggcaagaagacgaggctgacttatttctgtcaattcttacagacatcgagtgtacttagtgttcttacggaactgggaccaggtcaccggtcctaggtccagcccaagcccaacccgntcgctactctccg

SEQ ID NO: 50147 - DNA, 505 bp, Homo sapiens
  misc_feature: GYAE6OF02IMHU8.51.6.A06.1.454.CMB.1.raw
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtcccccaggacagacggccaggatcacctgctctggagatgcattgccaacccactattcttattggtaccagcagaagccaggccaggccccctgtgttgttgatatataaagacactgagaggccttcagggatcccctgagcgattctctggctccacctcagggacaatggtcacattgaccatcagtggagtccaggcagaagacgaggctgactatttctgtcaatcttcagacatcagttggtacttatgttcttcggaaccttgggaccaggtcaccggtcctaggtcagcccaaggcccaaccccatcgtcactctccg

SEQ ID NO: 50148 - DNA, 657 bp, Homo sapiens
  misc_feature: GYAE6OF02JPVHF.51.6.A06.1.454.CMB.1.raw
tcagcgatcgtatacacgaccggtgctcgatttagatctactgacagggggagcctagctgtgctgtgggtccaggaggcagaactctgggtgtctcaccatggcctggatccctctacttctcccctctcactctctgcacaggctctgaggcctcctatgtgctgacacagccaccctcggtgtccgtgtccccaggacagacggccaggatcacctgctctggagatgcattcgccaacccactattcttattggtaccagcagaagccaggccacggcccctgtcgttgttgatatataaagacactagagagccttacgagggtactcccgtagacgcgtattcgtcgtcggctaccccacgtcgaacgggtactaagtcggtaccaactagtttacgaaccctagtaccgtaagggtcgggtaacgttacccggaaggaccgaacgggaaacggaccggaagggtactacggtaacctttaacgttttccgtacggttacctaaactttccgttaacctaagtaacctagtacgtaacgtttacggttaactttaacgtcggtttaccgttacgggtaaaccggttaccgggtaaccgtaacggttaccgtacccggttaccgtaacggtccgtacggacccgtaacccgg

SEQ ID NO: 50149 - DNA, 493 bp, Homo sapiens
  misc_feature: GYAE6OF02FXUZC.51.6.A06.1.454.CMB.1.raw
  modified_base (480)..(480): a, c, t, g, unknown or other
  misc_feature (480)..(480): n is a, c, g, or t
  modified_base (489)..(489): a, c, t, g, unknown or other
  misc_feature (489)..(489): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtgtaacttatgtcttcggaactgggacaggtcacgtctagtcacgccaaggccaacccgntcgcacctntccg

SEQ ID NO: 50150 - DNA, 486 bp, Homo sapiens
  misc_feature: GYAE6OF02G68Y6.51.6.A06.1.454.CMB.1.raw
  modified_base (417)..(417): a, c, t, g, unknown or other
  misc_feature (417)..(417): n is a, c, g, or t
tcagcgatcgtatacacgaccggtgctcgatttagatctactgacaggggggagcctagctgtgctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcgagggacaagtggtcacattgaccatcagtggagtccaggcagaagacgagctgactattcngtcaatctcagacatcagtgtacttatgtctggaactggaccaggtcaccgtctaggtcagcccaacgg

SEQ ID NO: 50151 - DNA, 854 bp, Homo sapiens
  misc_feature: GYAE6OF02G9E1B.51.6.A06.1.454.CMB.1.raw
tcagcgatcgtatacacgaccggtgctcgatttagatctactgacgaggggtgggtccaggaggccagaactcgtgggtgtctcaccagtggcctggagtcccctctactctcccctcctcgactctctgcacaggctctcgaggcctcctatgtgctgacacagccaccctcggtgtccgtcgtccccaggaccaggaccggccaggacttccaccgttggcctcgtagggagtactcgactattcgcccaaaccccgacttaatttccttaagttcggtaacctaaggacctaggaaagttccgaagggcctaagggccccctaggtcgtttagttacggaagttaagtacttaaaaggacctaaccgtagtaggaaggtccctttacgacgggggtacttccccgttacggtaacgacggtaacggtttcctccgttacgggaccgttcccgaaccgttccggaacgggggtaacctaaaggttcggttaccgaaccgtagtttacggaaccctaagtttccaacggtttacgggaacgttcccaaggggtccaacgggaaacggaacggaacgggtcgtaacgaaccgttaccgttttacgtaggtttaccctaacgtttccgtttaccgtaacgtaactaacgttacccgtaaggttaagggttaaccttttaacgtttacgtttaccggtttaccgggtaaaccggttcggggtaaaccctaacggggttacccgtaaacccggggtttacccgttaaacgggttacccaaacgggtaacccccgtaaagggcccccgtaaaccccggtaccgttaccgggttaccctaccgttcccgtttaccccgg

SEQ ID NO: 50152 - DNA, 498 bp, Homo sapiens
  misc_feature: GYAE6OF02FUNJZ.51.6.A06.1.454.CMB.1.raw
  modified_base (409)..(409): a, c, t, g, unknown or other
  misc_feature (409)..(409): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactattctgtcaatcttnagacatcagtggtacttatgtcttcggaatcgggacaggtcaccgtctaggtcacgcccaaggcccaaccctactcgtcacctctaccg

SEQ ID NO: 50153 - DNA, 527 bp, Homo sapiens
  misc_feature: GYAE6OF02I3M73.51.6.A06.1.454.CMB.1.raw
  modified_base (216)..(216): a, c, t, g, unknown or other
  misc_feature (216)..(216): n is a, c, g, or t
  modified_base (504)..(504): a, c, t, g, unknown or other
  misc_feature (504)..(504): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctgganatgcattcgccaacccactattcttattggtaccagcagaagccaggccaggcccctgtgttgttgatatataaagacactgagaggccttcagggactccctgagcgattctctggctccactcagggacaagtggtcaactattgaccctatccagtcggagtcccaggcagaagacgaggctagacttattctgttcaatcttcagtacatcagtgtaacttattgtcttcgaacgtggaaccagtccaccggtctaggttcacggtacccaaggcccaacccgnttacggtcctaccgtcttacccg

SEQ ID NO: 50154 - DNA, 496 bp, Homo sapiens
  misc_feature: GYAE6OF02GDEKS.51.6.A06.1.454.CMB.1.raw
  modified_base (400)..(400): a, c, t, g, unknown or other
  misc_feature (400)..(400): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagagacgaggctgactatttcngtcaatcttcagacatcagtgtacttatgttcttcggaactgcgaccaaggtcaccgtcctgggtcacgcccaaggccaacccatcgtccactccg

SEQ ID NO: 50155 - DNA, 558 bp, Homo sapiens
  misc_feature: GYAE6OF02I5XVB.51.6.A06.1.454.CMB.1.raw
  modified_base (255)..(255): a, c, t, g, unknown or other
  misc_feature (255)..(255): n is a, c, g, or t
  modified_base (302)..(302): a, c, t, g, unknown or other
  misc_feature (302)..(302): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaaccactattcttattggtaccagcagaanccaggccaggccctgtgttgtgatatataaagacactgagagccttnagggactccctgagcgtattctctcggctccacctcgaagggacaagtggtacactattcgaccatacagtggagtccgaggcaaggaagacgaggctagacttatttctagtacaattctacagacatacagtgtacttagtgttcgttacggaacgttcgggacctaaggttcctacccggttaccgtaacggttcaaccggtacccgaaacggtaccccaacccgtacgtcggtacctaccttccttaccccg

SEQ ID NO: 50156 - DNA, 642 bp, Homo sapiens
  misc_feature: GYAE6OF02HHOIO.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgcccaacccactattcttattggtaccagcagaagccaggccaggcccctgtgttgttgatataataaagacacgtgagaggccttacgagggtactcccgtgacgcgtattcctcgtcggctcccacctcgagggtaacaagtcggtacaacgtattcgacctatccgtaggtggacgtccgaggacaaggaacggacgaggctagacttatttctgtactaattcttacagtactatacgtaacgttggttaactttagttcggttaccgtttacgggaaccgttacgggtaacccgtaacgggttcccgtaaccccggtttccgttaaccgggtacccaaccggtaacccccgtaacgggaccccctaaacccccggtaccgttacggttacccctaccgttcccgtttacccccgg

SEQ ID NO: 50157 - DNA, 625 bp, Homo sapiens
  misc_feature: GYAE6OF02IMKBC.51.6.A06.1.454.CMB.1.raw
  modified_base (478)..(478): a, c, t, g, unknown or other
  misc_feature (478)..(478): n is a, c, g, or t
tcagcgatcgtatacacgaccggtgctcgattttagatctactgacagggggtgggtccaggaggcagaaacttctgggtgtctcaaccgaagtggcctggatccctctacttctccccctcctcactctctgcacaggctctgaggcctcctatgtgctgacacagcccaccctcggtgtccgtcgtcccccaggacaggacgccaggatcacctgctctggagatgctattcgacccaaaccctattactttcttagttcggtacccagccaagaacgccgacggccgacggcccctgtcgttgttgactatataaagactacgtgaggacgtccttcgagggcttcccgtgacgcgtatttcctgtcggccttcccactcgaacgggaacaagttcggtacaactattcgaccatcgagtggacgtccgaggacaaggagacgaggctgacttatttcgtcgtactaattcttanacgtacattacgtagttacggttaactttagttcgtttccggttacggaacgttacgggaacctacggttccacccggttcgtaacggttccaccgtacccgaacggtccccaaacccgtgtacccgtacctccgtcctttaccccg

SEQ ID NO: 50158 - DNA, 707 bp, Homo sapiens
  misc_feature: GYAE6OF02HQSRY.51.6.A06.1.454.CMB.1.raw
  modified_base (216)..(216): a, c, t, g, unknown or other
  misc_feature (216)..(216): n is a, c, g, or t
tcagcgatcgtatacacgaccggtgctcgatttagatctactgacagggggtgggtccaggaggcagaactctgggtgtctcaccatggcctggatccctctacttctccccctcctcacctctctgcacaggctctgaggcctcctatgtgctgacacagccaccctcggtgtccgtgtccccaggacagacggccaggatcacctgctctgganatgcattgccaaccatattcttatggtaccagcagaacgccaggccacggcccctagtcgttgtagatataataaagacactgagtacggtccttacgagggtactcccgtaggagtccgtattcctcgtcggtcctccgaccgttacgagggaactaagttcggtaccaactagtttacgaacctagtaccgtagggtacggtacgttacccggaagggccgaaacggtaaacggaccggaaggtccgttaagggtaacctttaagtttccgttagtaacctaacgttcttaccgaataacctagttaccgtaggtttacggttaactttagtcgtttaccggttacgggtaaaaccgttcggggaaccctacggttacccgtaaccgggttacccgtaagggttccctaaaccggtacccccgtaaaggtacccccctaaaaccccggttcgttacccggtaacccgtaccttccggtttaacccccgg

SEQ ID NO: 50159 - DNA, 592 bp, Homo sapiens
  misc_feature: GYAE6OF02F3RPW.51.6.A06.1.454.CMB.1.raw
tcagcgatcgtatacacgaccggtgctcgatttagatctactgacagggggtgggtccaggaggcagaactctgggtgtctcaccatggactggatccctctacttctccccctcctcactctctgcacaggctctgaggcctcctatgtgctgacacagccaccctcggtgtccgtgtccccaggacagacggccaggatcacctgctctggagatgcattcgccaaccacttattcttattcggtaccagcagaagccaggccagcccctgtgttgttgatatataaagacactgagaggccttacgagggactcccgtgaggcgtattctctggcctccacctcgagggactaagtcggtacactacttcgacctatcaggtacgagtccgaaggcgaaggaacgacgaggctagacttattctgtacaatctttcaagacatacgtaggtgttaactttagtgttaccgttacggtaacgtcgggaaccgtacggtccgaccggtttccgtaacggtcgtaacccggacccgaaaccgggtacccctaaccccgtactacggtaccctaccgttcccgtttacccccg

SEQ ID NO: 50160 - DNA, 540 bp, Homo sapiens
  misc_feature: GYAE6OF02FJIWI.51.6.A06.1.454.CMB.1.raw
  modified_base (335)..(335): a, c, t, g, unknown or other
  misc_feature (335)..(335): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggcttcagggattcctgagcgtattctctggctccncctcgagggacaagtggtcactattcgaccatcaggtggacgtccgaggcaagaagacggaggctgacttatttctgttacaattcttacacgacatctagttgttacttatgtcttacggaacgttcgggaacctaggtccaccgttccgtaggtccacgacccgaacggcccaaccccgtacgtcgtaccaccttcttacccg

SEQ ID NO: 50161 - DNA, 705 bp, Homo sapiens
  misc_feature: GYAE6OF02JUC1N.51.6.A06.1.454.CMB.1.raw
  modified_base (332)..(332): a, c, t, g, unknown or other
  misc_feature (332)..(332): n is a, c, g, or t
tcagcgatcgtatacacgaccggtgctcgatttagatctactgacagggggtgggtccgaggaggcagaactctgggtgtctcaccatggcctggatccctctacttctcccctcctcactctctgcacaggctctgaggcctcctatgtgctgacacagccaccctcggtgtcccgtgtcccccaggaccaggaccggccaggactcaaccctgcctctgggagacttgcattcggccaaaccccacttattccttattcggtaccctagcaagaagaccaggccaaggccccctgtgttcgttgacgtatataagacactgagagccttnacgggatccctgacgcgattctctggtctccgtacctcgagggacaaagtggtacacctattcggaacctataccaggttcgggaacttcccgaagggtaccaggaaacgacggtaacggctacgggtacttaagtttcgtacgtacgaaattccgttacaacggtactaacgttactaacgttacgggtaacttttaacgttcgttaccggtttaccggtaaaccgtttcggggaaacccttaacgggttacccgtttaacccggtacccggttaaacgggttaccctaacgggttaacccccgtaaaggtacccccgtaaaccccgggtacccttaccgggtaccctaacccttcccgtttaacccccggg

SEQ ID NO: 50162 - DNA, 534 bp, Homo sapiens
  misc_feature: GYAE6OF02G7Q9D.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggcctccacctcagggacaatggtcacattcgaccatcgagtggacgtccaggcaagaagacggaggctagacttatttcgtgtacaattcttcagacatcagtcgtattatgttcttacggtaacgtggaaccaggttcaccgttccgtacgtacgacgaccccgaaggacccaaccccgacttccgtacctaccgtccttcccg

SEQ ID NO: 50163 - DNA, 712 bp, Homo sapiens
  misc_feature: GYAE6OF02IZF5B.51.6.A06.1.454.CMB.1.raw
  modified_base (173)..(173): a, c, t, g, unknown or other
  misc_feature (173)..(173): n is a, c, g, or t
  modified_base (219)..(219): a, c, t, g, unknown or other
  misc_feature (219)..(219): n is a, c, g, or t
tcagcgatcgtatacacgaccggtgctcgatttagatctactgacagggggtgggtccgaggaggcgagaactctgggtgtctcaccatggcctggatccctctacttctcccctcctcactctctgcacaggctctgaggcctcctatgtgctgacacagccaccctcggtntccgtcgtccccaggacagcggccaggactcacctgctcgtggaantgcattcgccaacctctaattcttattggtaccagacagaacgcaggaccacggcccctgtcggttagttcgagtaactaataaacgacacgtagtagacggtccgttacgagggtactacccgtgaagtacggtacttccgtacttacggtcctacctacccgtcgaacgggaactaaagtcggtactaacagttaccgaccgtatacgtagtacggacgtcaagggacaaggaacgtacggacggtactagaacgttatttactgtacgtaaacttctttacgaacgtactaacgtacgtaggttacggttaactttaacggtttgttaaccggtttacggtaaaccggttcggggtaaaccccgtagggttaacccggtaaccccgttaccgggttaacgtacccggttaaacgacccgtaaacccgggtaaccccaaccccgttaacccggttaaccgtaacccgtacccgttcccgtttaaaccccgg

SEQ ID NO: 50164 - DNA, 862 bp, Homo sapiens
  misc_feature: GYAE6OF02HYYBO.51.6.A06.1.454.CMB.1.raw
tcagcgatcgtatacacgaccggtgctcgatttagatctactgacagggggtgggggtccagggaggccagaactcgtgggtgtctctaccatggcctggatccctctacttctcccctcctcactctctgcacagggtctctgaggcctcctattgtgctgactaacagccacctcggtgtccgtgtcccaggacaggacggccaggagtcacctggactcgtggggacatgctattcgacccaacccattattcttagttggtaccagtacaagaagccacggccacggccctggtgttgttgatataataaagacacgtggaggacggtccgttcggaacggggtacttaccccgtaggacggtacggtaacgtttcgtaccgttacgggtacccttaccccgtaacccgttaccgaaacggggggtaaacccctaaaaggttaccgggggtaacctaaaccgttaacgttttacccggaaaccccttaacgtttaccggtaaaggggttacggggtaaccggttacccggaaagggggttaacccgaaaaacggggtaaaaaccgggtaaacccgggttaacggggtacctttaacgggtaaaccttttaaaagtttttacccgttaggttaaccgttaaacttttacccgttaaaccgaaacggtaacgaacttacgtaaacggtttacggttaaaccttttagttaccgtttaaccgttttaacggaaaccgttacggggtaacccgttaacgggttaccctaaccggttaccggttacgggtacgtaaccggtaacccggaaccgggaacccctaacccgtaccgttaccggtacctacccgttaccttaccccg

SEQ ID NO: 50165 - DNA, 543 bp, Homo sapiens
  misc_feature: GYAE6OF02IXP1T.51.6.A06.1.454.CMB.1.raw
  modified_base (216)..(216): a, c, t, g, unknown or other
  misc_feature (216)..(216): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctgganatgcattgccaacccactattcttattggtaccagcagaagccaggccaggccccctgtgttgttgatatataaagacactgagaggccttcgaggatccctgagcgattctctggctccacctcgagggacaagtggtcactattcgacctatcagtggacgtaccaggcagaagacgaggctagacttatttctgtactattctacagacatcagtgttacttagtgttcgttacgtaacgtggaccacggttacacccggttctacggtacacggaccccgaacggccctaaacccctcgttaccgtacctaccttccttcccg

SEQ ID NO: 50166 - DNA, 499 bp, Homo sapiens
  misc_feature: GYAE6OF02HEMSE.51.6.A06.1.454.CMB.1.raw
  modified_base (485)..(485): a, c, t, g, unknown or other
  misc_feature (485)..(485): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaacgacgaggctgacttatttctgtcaatcttcagacatcagtgtacttatgtcttcggaactggaccaggtcaccgtctaggtcacgcccaaggcccaacccnctcgtcactctccg

SEQ ID NO: 50167 - DNA, 590 bp, Homo sapiens
  misc_feature: GYAE6OF02JL7QI.51.6.A06.1.454.CMB.1.raw
tcagcgatcgtatacacgaccggtgctcgatttagatctactgacagggcacgaccggtgctcgatttagatctactgacagggcacgaccggtgctcgatttagatctactgacagggggtggtccaggaggcagaactctgggtgtctcaccatggcctggatccctctacttctcccctcctcactctctgcacaggctctgagcctctatgtgctgacacacgcccacccttcggtcgtccgtacgtccccgaggacacggacggccacggactcacctgtctcgtaggagatcgactagttacgacccaaccctacttacttacttagttcggtaaccagacctagaaacgccgaggccgaccggcccctagtcggtttagtagtacttataagtaaacgaccgacgtacgagacggtcctacggaacgggtactcccgtaggacgcgtattccgtctggcctccgtactacgagggacagtcgtacatatcgacctatacgagtcggactacgaggaccaggacgacggtacggtctagtacttactttccgtgtaacctacgttcctacgtacgacgttaacg

SEQ ID NO: 50168 - DNA, 580 bp, Homo sapiens
  misc_feature: GYAE6OF02JOS9J.51.6.A06.1.454.CMB.1.raw
  modified_base (259)..(259): a, c, t, g, unknown or other
  misc_feature (259)..(259): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattcgaccaacccactattcttattggtaccagcagaanccaggccacggcccctgtgttgtgatataataagacactgaagaggcctttacgagggactcccgtgacgcgtattctcgtggcctaccacctcgagggacaatggtacagtattcgactatcgagtggacgtcgagcgtaagaagacgaaggctgtattagttactagtactaaattccttcgaagtacgtataccgtagtcgggttaacttcgttagtttccgttacggtaacgttagggaccctaggtcctaaccgggtcttacggtacgaccgtccgaaacggtccccaaccgctacgtccgaaccttccgtacccg

SEQ ID NO: 50169 - DNA, 553 bp, Homo sapiens
  misc_feature: GYAE6OF02H0N2Z.51.6.A06.1.454.CMB.1.raw
tcagcgatcgtatacacgaccggtgctcgatttagatctactgacaggggggagcctagctgtgctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgccaacccactattcttattggtaccagcagaagccaggccacggcccctgtgttgttgatatataaagacactgagaggccttcgagggactcccgtgacgcgattctctggctccacctcgaggactaagtggtcactattcgacctatcagtggacgtccgaggcaaggaagacggaggtctagacttatttctagtactaattcttacgagtactatcgagttcgttactttagtcgttcgttacggtaacgtcgggtacctaagggttcctacccggtccgttacggtaccgtacgaccccgtaaccgg

SEQ ID NO: 50170 - DNA, 547 bp, Homo sapiens
  misc_feature: GYAE6OF02IIWUP.51.6.A06.1.454.CMB.1.raw
  modified_base (418)..(418): a, c, t, g, unknown or other
  misc_feature (418)..(418): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaacccactattctattggaccagcagaagccaggccacggcccctgtgttgttgattatataaaagacactgagaggccttcgaggactcccgtgacgcgtattctctggcctccacctcagggacaagtggtacacacttgaccatcagtgacgtcaggcagagacgagctgactatttctgtacaattctanagtacatacctaggttagtactttatcgttacttacggaacgtcgggaacctaggtccctaaccggtccgtacggtcgaaccgacccgtaacggaccctaacccgactacggtaccacctacgttcccg

SEQ ID NO: 50171 - DNA, 534 bp, Homo sapiens
  misc_feature: GYAE6OF02GW1HC.51.6.A06.1.454.CMB.1.raw
tcagcgatcgtatacacgaccggtgctcgatttagatctactgacagggcgaccggtgctcgatttagatctactgacaggggtggggagcctagctgtgctgtgggtccaggaggcagaactctgggtgtctcaccatggcctggatccctctacttctccccctcctcactctctgcacaggctctgagcctcctatgtgctgacacacgcccaccctcggtcgtccgtcgtccccaggacagacggccaggatcacctgctctggagatgcattgccaacccactattcttattggtaccagcagaagccaggccacggcccctgtgttgttgattatataaagacactgagaggtccttcgagggactccctgacgcgtattcctcgtggcctaccaccttcgaaggaccaagttggtacaacgcttagacctaatcgaggtcggtacgtcgaggtcgaagtaacgacgaggctagacttattcgtgtactaattctactagactactcgaggtacgttacttattacgg

SEQ ID NO: 50172 - DNA, 525 bp, Homo sapiens
  misc_feature: GYAE6OF02FZXFG.51.6.A06.1.454.CMB.1.raw
  modified_base (402)..(402): a, c, t, g, unknown or other
  misc_feature (402)..(402): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattgccaaccactattcttattggtaccagcagaagccaggccaggccccctgtgttgttgatatataaagacactgagaggccttcagggatccctgagcgattctctggctccacctcagggacaagtggtcacattgaccatcagtgagtccaggcagaagacgaggctgactatttcngtcaatcttcagacatcagtggttacttatgttcttacggaacgtcgggaccaaggtcgaacccgttccgtaggtccacggacccaaggaccccaacccgactcggtaccaccgtctaccccg

SEQ ID NO: 50173 - DNA, 612 bp, Homo sapiens
  misc_feature: GYAE6OF02GSW91.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgcccaaacccactattcttattcggtaccagcagaagccaggccaggcccctgtgttgtgatatataaagacactgagaggccttcgagggatcccgtgacgcgtattctcgtggcctccacctcgacgggacaagtcggtacactagttcgacctatcgagtcggacgtccgaggcaaggaacgacggaggctacgacttatttcgtgtactattcttacagtacatacaggttgttacttagttcgtttacgttaccggtaacgtcgggaaccgtacgggttaccgtacccggttacccggttaaggttaccaaccggaccccgtaaaccgggaccccaaacccccgtacgttcccggtaaccctacccgttccgtttaacccccgg

SEQ ID NO: 50174 - DNA, 542 bp, Homo sapiens
  misc_feature: GYAE6OF02GB2KY.51.6.A06.1.454.CMB.1.raw
tcagcgatcgtatacacgaccggtgctcgatttagatctactgacaggggggagcctagctgtgctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcgagggactccctgagcgtatttctctggctccacctcgagggacagtgtcacattgaccatcagtggacgtccgagcagaagacgaggctgacttatttctgtacaattcttacagaactatacagttggttacttagtgttcgttacgggtaactcggggtaaccctaagggttccctaccggttacccgttagggtacctaccgacccgtaaacccgg

SEQ ID NO: 50175 - DNA, 604 bp, Homo sapiens
  misc_feature: GYAE6OF02GJYWJ.51.6.A06.1.454.CMB.1.raw
tcagcgatcgtatacacgaccggtgctcgatttagatctactgacagggggagcctagctgtgctgtgggtccaggaggcagaactctgggtgtctcaccatggcctggatccctctacttcctccccctctcactctctgcacaggctctgaggcctcctatgtgctgacacagccaccctcggtgtcccgtgtccccaggaccagacggccaggatcacctgcctctggagatgcattcgcccaacccactattcttattcggtaccagcagaagccaggccaggcccctgtcgttgttgatatataaagcactgagacggtccttacgacgggtactcccgtgaacgcgtatttctcgtcggtcctcccacctcgacgggaactaacgtcggtacacgtattacgaacctatacgagtacggtacgtaccgaggaccgaaggtaacgacggacggctagtaacttagtttcgtacgttacaacgttcttacgaagtacctataccgtagttacgttaccgtttagtcggttaccgttacggaacgtcgggaccctaaggtcccgtaccgttacccgtacgtaccgacgtaccccggaaccg

SEQ ID NO: 50176 - DNA, 856 bp, Homo sapiens
  misc_feature: GYAE6OF02F6KSI.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgaccaaccacttattcttattggtaccagcagaacgccaggccaggcccctgtgttgttgatataataaagacactgagaggccttcgagggactcccgtgacgtcgtattctcgtggtcctccacctcgacgggacaaagtcggtacactactttacggaacctactaccgtaggttacggaacggttacccgaagggtaccgaaagggtaaacggaaccgggtaacggggtacccgttaacggtaaaccgttttaacggtttttaccgtttacggtttaacccttaaaacgttttcccgtttaaccctaaacgggtaaaccttaaccgttaaccggttaacggtttttaaacggggtttaaaccctttttaaggtttaccgggttttaacccggttttaaaccggggtaaaacccgggttttaaccgggggtaaacccggtttaaacccgggtttacccggttaacccccgggttttaacccggtttaaacccggggtttaaccccgggtaaaccccgggttaacccccggtaaaacccgggtaaccccccccgtaaaacccccccgtttaacccggttaccccggttaaccccgttaaccccgtttaccccgtttttaaccccccccggg

SEQ ID NO: 50177 - DNA, 604 bp, Homo sapiens
  misc_feature: GYAE6OF02FYWSI.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgaccaacccacttattcttattcggtaccagcagaagccaggccacggcccctgtgttgttgatataataaagacactgagaggccttagagggtactcccgtgagcgtattctcgtggcctcccacctcgacgggacaagtggtacactattacgacctatcgaggtggacgtcgaggacaggaacgacggaggtactgactttattcgtagtactaattccgttacaagtactatacgtaggttcggtttaacttacgttcgttccgttaccgggaacgttacgggaacctagggtaccctaccggttcggtacggtaccgaccggtacccgaacggacccctaacccgtacgttcgtaccctaccgttccttaccccg

SEQ ID NO: 50178 - DNA, 562 bp, Homo sapiens
  misc_feature: GYAE6OF02G7NEC.51.6.A06.1.454.CMB.1.raw
  modified_base (364)..(364): a, c, t, g, unknown or other
  misc_feature (364)..(364): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctggagatgcattcgacccaaccctactattcttattcggtaccagcagaagccaggccacggcccctgtgttgttgatatataaagacactgagaggccttcgagggtatccctgagcgtattctctggcctccacctcagggacagtgtcanattcgacatcagtggatcagcagaacgacgagctgactatttctgtactacttcttacaagtactatacgtaggtacgttaactttagttacgtcgtttacggtaacgtcgggtaacctacggttccgaaccggtcgttacggactacgacccgaacggaccccgaacccctagtacctacctaccgttactccccgg

SEQ ID NO: 50179 - DNA, 551 bp, Homo sapiens
  misc_feature: GYAE6OF02FOA8G.51.6.A06.1.454.CMB.1.raw
tcagcgatcgtatacacgaccggtgctcgatttagatctactgacagggcacgaccggtgctcgatttagatctactgacagggcacgaccggtgctcgatttagatctactgacagggggtgggtccaggaggcagaactctgggtgtctcaccatggcctggatccctctacttctccccctcctcactctctgcacaggctctgaggcctcctatgtgctgacacagcccacccgtcggtgtccgtcgtccccaggacagaccggccaggatcacctgctcgtggagatggctattcgcccaacccacttatttcttattggtaccagcaagacgccaggccacggccctgtgttgttgatatataaagacactgagacgtccttacgaggtactcccgtggacgcgtattctcgtcggaccttccgaccttcgaacgggactaagtcggtacactagttcgaaccgtatacgaggttcggacgtacccgaggacgaggaacgacggacggctagtacttattcgttgtactaattctacgacgatcg

SEQ ID NO: 50180 - DNA, 545 bp, Homo sapiens
  misc_feature: GYAE6OF02JANES.51.6.A06.1.454.CMB.1.raw
  modified_base (305)..(305): a, c, t, g, unknown or other
  misc_feature (305)..(305): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgtgatatataaagacactgagaggccttnagggatccctgagcgattctctggctccacctcgagggacaagtcggtacactattcgaccatcagtggacgtccaggcagaagacgaggctagacttagtttctgtactaattcttacagactatctagtgttacttagtgttcgttacggaactgggtaccaggttccaaccggttcctaaggtccacggaccccgaaacggccccaacccgtcgtcgtacctaccttacgttcccgg

SEQ ID NO: 50181 - DNA, 589 bp, Homo sapiens
  misc_feature: GYAE6OF02HGOMM.51.6.A06.1.454.CMB.1.raw
  modified_base (432)..(432): a, c, t, g, unknown or other
  misc_feature (432)..(432): n is a, c, g, or t
  modified_base (445)..(445): a, c, t, g, unknown or other
  misc_feature (445)..(445): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagcccaccctcggtgtccgtgtccccaggacagacggccaggatcacctgctctggagatgcattcgacccaacccacttattcttattcggtaccagcaagaagccaggccaggcccctgttgttgttgatataataaacgacactgaagacggccttacgagggactcccgtgagcgtattctcgtcggctccacctcgaagggacaagtggtcaacattacgacctatcaggtgagtccaggcaaggaacgacgagctagacttagtttcngtacaattctacngaactatacgtagtagtacttagttacgttcgttacgggaacttcggggaacctaacggttcgtacccggtaccgtaacggtaccaaccggtacccgaaccggaccccaaacccgtccgttacgtccgtacctccgttaccccg

SEQ ID NO: 50182 - DNA, 718 bp, Homo sapiens
  misc_feature: GYAE6OF02JMSS7.51.6.A06.1.454.CMB.1.raw
tcagcgatcgtatacacgaccggtgctcgatttagatctactgacagggggagcctagctgtgctgtgggtccaggaggcagaactctgggtgtctcaccatggcctggatccctctacttctcccctctcactctctgcacaggctctgaggcctcctatgtgctgacacacgcccacccgtcggtgttcccgtcgtcccccgaaggaccgagaccggccaaggactaccacctgctccgtaggagactcggcacttcgacccaacctacttattccttagttcggtaccagcacgaacgccgacggccacggcccttgtgttcgtagacttagaactaaacgacactgagtacgtccgttacgacggactacccgtagacgcttacttctcgtcgtcctaccgtacctacggaggtaaccaagtcggtacaccgtagttaccgaactacgtacgtacggtaggtacgttaccggacggtacgtaaacgaacgggtacggaacgtaccgtacgtaaacgtttcgtttacgtaacggttacctaacgtttacccgttagaaccgttaactaaacgtaccggttaagttaccggttttacgtttaacgttcggttaccggtttaaccgggtaaccgttaaccggggtaacccgttaacggtacccgtttaccccggtaacggtttacggacccggttaccggaccccggtaaaccccgg

SEQ ID NO: 50183 - DNA, 652 bp, Homo sapiens
  misc_feature: GYAE6OF02JJU95.51.6.A06.1.454.CMB.1.raw
tcagcgatcgtatacacgaccggtgctcgatttagatctactgacagggggtggggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgcccaacccacttattcttattggtaccagcagaagccaggccaggcccctgtgttgtgatatataaagacactgagaggccttcgagggatccctgacgcgattctctggtctccactcgagggtacagtgtacacattcgaccatcagtggacgtccgaggtacaaggaacgacgagggtctacggaacttagtttctagtacgttaaacttcctttacgacgtaacctagttacccgtaaggttacggtttaacctttaaggtttacgtttccggttaacgggtaaaccgttacggggtaaacccgtaacgggttaacccgtaaccgggtttacccggttaacgggtaccgttaacccggacccgtaaaccggaccccaaacccccggtacgttacggttccctaacgttcccgtttacccccgg

SEQ ID NO: 50184 - DNA, 610 bp, Homo sapiens
  misc_feature: GYAE6OF02I5KP6.51.6.A06.1.454.CMB.1.raw
  modified_base (425)..(425): a, c, t, g, unknown or other
  misc_feature (425)..(425): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggactcacctgctctggagatgcattcgcccaacccatattcttattggtaccagcagaagccaggccacggcccctgtgttgttgatagtaataaagactactggaagtacggccttcgagggtaactccccgtgacgcgtattcgtctcggcctccaccgtcgaagggacagtcgactactattcgaccatcgaagtggaactccgaaggctaaacggagaggcgngtacgatttacttcgtgttaacagttcgtacaagtacatccgaggttcgtaactttagtcgttaccgtacggaacgttaccgggacctaagggttaccgtaccgttaccgttaggttaccctaaccgaaccccgtaaggtaccccaaacccgtaccgtcgttacctaccggttcccttaaccccg

SEQ ID NO: 50185 - DNA, 549 bp, Homo sapiens
  misc_feature: GYAE6OF02GR1ZD.51.6.A06.1.454.CMB.1.raw
  modified_base (216)..(216): a, c, t, g, unknown or other
  misc_feature (216)..(216): n is a, c, g, or t
  modified_base (233)..(233): a, c, t, g, unknown or other
  misc_feature (233)..(233): n is a, c, g, or t
  modified_base (397)..(397): a, c, t, g, unknown or other
  misc_feature (397)..(397): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtcccccaggacagacggccaggatcacctgctctgganatgcattgcccaacccnctattcttattggtaccagcagaagccaggccaggcccctgtgttgtgatatataaagacactgagaggccttcgagggtatccctgacgcgattctctcggctccacctcgagggacaagtggtcacattcgaccatcgagtggacgtcaggcaagaagacgngctgacttattcgtgtacattctcagactatccgtagtaggttacttagtcgttcgttacggaacgttcgggaacctaggtcctacccggtcgtaggtcccaagtacccgaacgccccgaaccccgtacgtcgtacctaccgtcttaccccg

SEQ ID NO: 50186 - DNA, 678 bp, Homo sapiens
  misc_feature: GYAE6OF02I4T6T.51.6.A06.1.454.CMB.1.raw
  modified_base (215)..(215): a, c, t, g, unknown or other
  misc_feature (215)..(215): n is a, c, g, or t
  modified_base (316)..(316): a, c, t, g, unknown or other
  misc_feature (316)..(316): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctgganatgcattcgacccaaccctactattcttattcggtaccagcagaagccaggccaggcccctgtgttgttgatatataaagacactgagaggcttcgagggntcccgtgacgcgtattctcgtgcctcctacctcgacgggacaagtcggtacactagttacgacctatacgaggtcgggaacgtccgaagggacgtaaggaaacggacgggaacgggtacttacggtacttaacgttttcgtcgttaactaacgttctttaccgtacgaactacttacgtacggttacggtttactttaacgttacggttccggtttacggtaaaccgggttacggggaacccgttaacgggttccccgtaacccggtttacccgtttaaccggggtaacctaaccggtaccccggaaccggaccccaacccccgttattacccggtacctaacccgtttcccgttaccccgg

SEQ ID NO: 50187 - DNA, 778 bp, Homo sapiens
  misc_feature: GYAE6OF02IFCXG.51.6.A06.1.454.CMB.1.raw
  modified_base (221)..(221): a, c, t, g, unknown or other
  misc_feature (221)..(221): n is a, c, g, or t
tcagcgatcgtatacacgaccggtgctcgatttagatctactgacagggggtgggtccaggaggcagaactctgggtgtctcaccatggcctggatccctctacttctccccctctcactctctgcacaggctctgaggcctcctatgtgctgacacagcccacccgtcggtcgtccgtcgtcccccgaggacagacggccaggactcacctgctctgganatcgctattcgacccaaaccctacttactttcttagttcggtaaccagtaccaaggaacgcccaaggcccgacgggtcccccttggttcggtttgttaggtattaaattaaagtaaaacggacctaacgttaggaacggacggtcctttacggacggggtacctaccccgtaggaacgtccgttacttccgtcgttcggtccctcccgaccttacggacggggtaactaacgttcggtacctaaaccgtacgttacgaacccgtaagttccgtaacgggtacgggtaccggtacccggaacgggaccggaaaggaacgggtaaccggagggacctttaacgggtaccttttacgttttcgttacggtacttaaacctttccgtacaacgtacttaacgttacggtagttacggtttaacttacggtttaccgtttccgttaaccgggtacgtaaccgggtacccgtaagttcccgtaccggttccgtaacgtcccgtaacgtaccccgaaccgtaccccaacccggtacttaccggtcttacccgtccgttaccccc

SEQ ID NO: 50188 - DNA, 627 bp, Homo sapiens
  misc_feature: GYAE6OF02IBEXV.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctctcactctctgcacaggctctgaggcctcctatgtgctgacacagccaccctcggtgtccgtgtccccaggacagacggccaggatcacctgctctggagatgcattgaccaacccatattcttattcggtaccagcagaagccaggccaggcccctgtgttgttgatataataaagactacgtagagacggtccttacgagggtacttcccgtagacgacggtattcctcgtcggtcctccaaccctgacgggtaacaagtcggtcaactagttacacctatccgagtcggacgtccgtaagggccaaggaaacggacggaacggtactagtaacttatttcgtacgtactaattcgtacacgtactaagtacgtacgtgttaactttagttcgttaccgttacggaacgttacgggtaccgtaacggttcccgtaccggtccgtaacggtccgaacccggacccaccggaacccgaacccgtaccgtacgtaccctaccgttccttacccg

SEQ ID NO: 50189 - DNA, 709 bp, Homo sapiens
  misc_feature: GYAE6OF02GEV8Z.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgcccaacccattattcttattcggtaccagcagaacgccaggccacggtcccctgtgttgttgatataataaagacacgtagagacggtccttcgaagggactcccgtagacgcgtattctcgtggcctaccaccgtcgaagggtaactaagtcggtacacgtatttacgaccaacgttcgacggtcgggtacgtccgaagggaccgtaaaggaaaggtacgggaggtaccgttacgtaaccgtttacttttcgtacgttacgtaactttccgttacgaaacgtactaacgttacgttacgggtttaacgtttaaccgtttagttcgggtttaaccgttacgggttaaaccggtacgggaaacccgttaacgggtcccgtaaacccgggttccggttaacgggtaccctaacccgggacccgtaaacccggtacccctaaaccccgtacgttacccgtaccgtacccgtttccggttaaccccccg

SEQ ID NO: 50190 - DNA, 802 bp, Homo sapiens
  misc_feature: GYAE6OF02F8A6C.51.6.A06.1.454.CMB.1.raw
  modified_base (233)..(233): a, c, t, g, unknown or other
  misc_feature (233)..(233): n is a, c, g, or t
tcagcgatcgtatacacgaccggtgctcgatttagatctactgacaggggggtgggtccaggacggcagaacgtctgggtgtctcaccgaatggcctgggacctccctctacttctcccctcgtcactctctgcacaggctcctggaggcctactatgtgctcgacacagcccacccgttcggtcgtcccgtcgtccccaggacagacggccaggactcacctgctctcgganattgccgacttcggacccaaacctacttaagttccttagttcggtaccaggtacagaagccaaggacccgaggacccctcgtagttcgttcgatatataaaagactacgtgacgtaggtccttagacggggacttccgtagaaggtccgattccgtcgtaggctacctacgttcggaaggactaagttcggtacactacgttacgaaccgtactacgacggttcggtacgtaccgaacggaccgtaaggaaacgggtacggtaacggttcgttaacgtaaccgttttaagttttaccgtacggttaactaaaccgtttacgtttaaccgtaaagttaacccgttaattaaccgggtaacgggttttaccggtttaaaccgtttaaacggttacggtttaaccggtttaaacgggtaaaccgtttaaccggggaaacccgttaagggttccgtaacccgggttaacccggttaggttaacccgaaccggttaccccgtaaaccgggtacccctaaaccccgttaccgttaacccggtttaacccgtttcccgtaccggtttacccccccg

SEQ ID NO: 50191 - DNA, 661 bp, Homo sapiens
  misc_feature: GYAE6OF02FQE44.51.6.A06.1.454.CMB.1.raw
  modified_base (147)..(147): a, c, t, g, unknown or other
  misc_feature (147)..(147): n is a, c, g, or t
  modified_base (243)..(243): a, c, t, g, unknown or other
  misc_feature (243)..(243): n is a, c, g, or t
tcagcgatcgtatacacgaccggtgctcgatttagatctactgacagggcacgaccggtgctcgatttagatctactgacagggcacgaccggtgctcgatttagatctactgacagggggtggtccaggaggcagaactctgggtntctcaccatggcctggactccctctacttcctccccctctcactctctgcacaggcctctgacgcctctatgtgctgacacagcccaccgtcggtntcccgtcgtccccaggacagaccggccaggactccacctgctctggagtatcgcagttcgacccaacccgtacttactttcttattacggtaaccaggtaccaagaacgccgacggacccaccgggtccccttggttcggtttacgttagtaattaagttaaacgtaaaggacctacgtacgaacgtacggtcctttacgacgggtactcccgtaggacgtacgtacttccgtacgtcggtaccttacccgacccgtcgaacgggaacctaacgtcgtacctaacgtagttacgaaccctagttaccgaacggttcggaaccgttaccgaacggacgtaacggaacggacggtaacggtaccgtacgtacgtttactttccgtacgttacttaaccgttcctacgtactaccgtaacg

SEQ ID NO: 50192 - DNA, 550 bp, Homo sapiens
  misc_feature: GYAE6OF02HBC1J.51.6.A06.1.454.CMB.1.raw
  modified_base (399)..(399): a, c, t, g, unknown or other
  misc_feature (399)..(399): n is a, c, g, or t
  modified_base (403)..(403): a, c, t, g, unknown or other
  misc_feature (403)..(403): n is a, c, g, or t
  modified_base (427)..(427): a, c, t, g, unknown or other
  misc_feature (427)..(427): n is a, c, g, or t
tcagcgatcgtatacacgaccggtgctcgatttagatctactgacagggggtgggtccaggaggcagaactctgggtgtctcaccatggcctggatccctctacttctccccctctcactctctgcacaggctctgaggcctcctatgtgctgacacagccaccctcggtgtccgtgtccccaggacagacggccaggatcacctgctcgtggagatgcattgcccaacccacttattcttatcggtaccagcagaagccaggccaggcccctgtcgttgtgatatataaagacactgagaggccttgaggggatcccgtgacgcgtattctctggctccacctcgaggacaagtcggtacactattgaccatcagtggagtccaggcagaagcgagcngatnttctgtacattctcaggactagtnagtgttacttatcgttcttcggaactgggtaaccgaggtccgaaccggtcgtaacggtccgtaacggaccccgaacggtacccaaccccgtagtaccgttaacgttcccgtacgttacccccg

SEQ ID NO: 50193 - DNA, 834 bp, Homo sapiens
  misc_feature: GYAE6OF02JIWRB.51.6.A06.1.454.CMB.1.raw
  modified_base (219)..(219): a, c, t, g, unknown or other
  misc_feature (219)..(219): n is a, c, g, or t
  modified_base (271)..(271): a, c, t, g, unknown or other
  misc_feature (271)..(271): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagcccacccgtcggtcgtccgtgtccccaggacagacggccaggactcacctgctcgtgganatgctattcgaccaaccctacttattcttagttcggtaccagtcaaggaacnccgaggccacggcccctgtggttcgttgacttataactaaaagacctactggaaggacggcctttacggaggggtacttcccgtggaacggtccgtaagtttccgttccgttcgggtcccttacccgtaacccttacggacgggggtaaacctaaggttacgggttaccaaacgtaacgtttaccggaacccgtaattaccgtaaggggttacggaacccggtttcccggaaacggggtacccaaaggggaaaacggtaaccgggtaaacgggtccgttaacggtaaacccgttttatttacccggtttaggttaaactaaccggttttacttaccgaacggtaccttaaacggttacctaagggttacgttttaacctttaaaggtttccgtttaccggtttaaccggtaaacccggtacggggtaacccgttaaccggggtacctaccccgggtttaacccgttacgggttaccgtaacccggtaaccccggaaccggtaaccccctaaccccggtacgtttaccggtaccccttaacccgtttcccggtttaccccccgg

SEQ ID NO: 50194 - DNA, 617 bp, Homo sapiens
  misc_feature: GYAE6OF02IPWZT.51.6.A06.1.454.CMB.1.raw
  modified_base (175)..(175): a, c, t, g, unknown or other
  misc_feature (175)..(175): n is a, c, g, or t
  modified_base (188)..(188): a, c, t, g, unknown or other
  misc_feature (188)..(188): n is a, c, g, or t
tcagcgatcgtatacacgaccggtgctcgatttagatctactgacagggggggagcctagctgtgctgtgggtccaggaggcagaactctgggtgtctcaccatggcctggatccctctacttctccccctctcactctctgcacaggctctgaggcctcctatgagctgacacngccaccctcggtntcagtcgtccccaggacagacggccaggatcacctgcctcgtggagaatcgcattacgaccaaaaccgatatcgtacttaagttcggtaccagacaaggaacggccgggaccacggccccgttgtggttggtgatagtaataaagacgtactagacgacggcccgtacgaggtactccgtaggacgtacgtatttcctcgtcgtaccgtaccgaggtacgaagggaaccgtaacgggtactaacgtaacgttggaccacgtagtaggtcggtacgtaccgacggacaaggaggaacgtaggtacgtgtaacttaagttaattacgtacaatacgaactacaacgacctaagttgttacttagtgttacgttcggaacctggacctacgtaacgtacccgtcgttcccgtggtacaccggaccgaaccgg

SEQ ID NO: 50195 - DNA, 798 bp, Homo sapiens
  misc_feature: GYAE6OF02ISS1D.51.6.A06.1.454.CMB.1.raw
  modified_base (220)..(220): a, c, t, g, unknown or other
  misc_feature (220)..(220): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacacgcccaccctcggtgtccgtcgtcccccaggacagacggccaggatcaccgtgctctgganatgctattcgacccaacccacttattcttagttacggtaccagacaagaacgccgaggccgacggcccctgtgttgttgatataataaagacactgagacggccttcgaggtactcccgtagacgacgtacttctcgtcggtcctaccctacctcgaaggtacaagtcggtaccacgtacttacggacctacttacgtacggttcggtacgtacccggaagggacccgtaaagggaaacggtaaaccgggtacgggtaccgttacggtaaacgttttacgttttaccgttacggttaaccttaaacgtttccgttaaccgtaaacgtaccgttaacgttaaccggttaacggtttaacggtttaaccgtttaacggtttaccggtttttaaccggttaaacccggggttaaccgtttaaccgggggtaaacccgttaacccgggttaccccgtaaccccggtttaaccggttaaccggttacccggtaacccggtaacccccggtaaaccggtaccccccgtaaaccccgtaccggttacccgttaccccgttaccgtttcccgtttaacccccccgg

SEQ ID NO: 50196 - DNA, 654 bp, Homo sapiens
  misc_feature: GYAE6OF02FKXTS.51.6.A06.1.454.CMB.1.raw
  modified_base (170)..(170): a, c, t, g, unknown or other
  misc_feature (170)..(170): n is a, c, g, or t
  modified_base (199)..(199): a, c, t, g, unknown or other
  misc_feature (199)..(199): n is a, c, g, or t
  modified_base (288)..(288): a, c, t, g, unknown or other
  misc_feature (288)..(288): n is a, c, g, or t
  modified_base (329)..(329): a, c, t, g, unknown or other
  misc_feature (329)..(329): n is a, c, g, or t
  modified_base (377)..(377): a, c, t, g, unknown or other
  misc_feature (377)..(377): n is a, c, g, or t
tcagcgatcgtatacacgaccggtgctcgatttagatctactgacagggcacgaccggtgctcgatttagatctactgacagggcacgaccggtgctcgatttagatctactgacagggggtggtccaggaggcagaactctgggtgtctcaccatggcctggatccctntacttctccccctctcactctctgccacnggctctgaggcctcctatgtgctgacacacgccacccttcggtcgtccgtcgtccccaggacagacggccaggactcactgctcgtganatgctattcgaccaaccgacttattcttagttcgtaccagnaacgacgccacggccacggtccctgtgttgttacgatataacgtaaanacacgtagacgacggtccttacgacggggtcctcccgtaggcgtacgttacgtttccgtacgtcggtcccttacccgaacccgtttacggaaaccgggaccgttaaagttccgggtactaaaccgttagtttacccgaaccctagtaccgttaacgggtacggtaacgttaccgaacgtaccgaagggaacgtaaccgggtaggtaccggttagtaaccttttacgtttacggttaccgttaacttaaacctttgtaacccgtacgacgttaaccgg

SEQ ID NO: 50197 - DNA, 657 bp, Homo sapiens
  misc_feature: GYAE6OF02H4S4T.51.6.A06.1.454.CMB.1.raw
  modified_base (266)..(266): a, c, t, g, unknown or other
  misc_feature (266)..(266): n is a, c, g, or t
  modified_base (286)..(286): a, c, t, g, unknown or other
  misc_feature (286)..(286): n is a, c, g, or t
  modified_base (368)..(368): a, c, t, g, unknown or other
  misc_feature (368)..(368): n is a, c, g, or t
  modified_base (510)..(510): a, c, t, g, unknown or other
  misc_feature (510)..(510): n is a, c, g, or t
  modified_base (629)..(629): a, c, t, g, unknown or other
  misc_feature (629)..(629): n is a, c, g, or t
tcagcgatcgtatacacgaccggtgctcgatttagatctactgacaggggtgggtccgaggaggcgagaactctgggtgtctcaccatggcctggatccctctacttcctccccctcctcactctctgcacaggctctgcggtccctaccttatcgtgcttaggacacagcccacccgtcggtgtcccgtcgacccccaggacaggaccggcctagggactccacctgccttctagggacgatgctagttcgacccaaaccctctnttacttacgttggtaacccnggacagagccaggtccacggccctagtgttcgtgatagtataaaagctacgtagagacggtccttcgaacgggtacttccgngacggcgtaagttctcgtggccttacccgacctagaccgggactaaggtcggtacatattcggaacccagttccgaaaggtggtacgttcgacgggtacaacggaagacgtaggacctaggtaacttacgttacgtacgtanacgttacttacacgactagtctacgttacgtacgtaacgttgtacgttcgtaaacgtcgggtaactacgggtactaccggttccgtacgtcgacccgtaccaacggacccttaacccgngttaccggtcctaccggtccttacccgg

SEQ ID NO: 50198 - DNA, 622 bp, Homo sapiens
  misc_feature: GYAE6OF02GSYWE.51.6.A06.1.454.CMB.1.raw
  modified_base (433)..(433): a, c, t, g, unknown or other
  misc_feature (433)..(433): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgacccaaacccactattcttattggtaccagcagaagccaggccacggcccctgtgttgttgatatataaagacactgagaggtccttcgagggactcccgtgagcgtattctctggcctccacctgagggacaagtggtacactattcgacctatcgaggtaggacgtaccgagggacgtagaaagacggaggctagacttatttcgtntacattcttacagtacacgtacaggtttacggttacttacgttcgttaccgtttacgggaaaccgttggggaacccgttacggttaccgtaacccggttcccgttaacgggttccaacccgggtacccaaacccgggtaccccctaaaccccgtacgttacccgtaccttacccgttccgttacccccg

SEQ ID NO: 50199 - DNA, 642 bp, Homo sapiens
  misc_feature: GYAE6OF02GTCU1.51.6.A06.1.454.CMB.1.raw
tcagcgatcgtatacacgaccggtgctcgatttagatctactgacagggcgaccggtgctcgattttagatctactgtacagggggtggggagcctagctgtcctgtggggtccagggaggcagaactcgtgggtgtctcaccatggcctggatccctctacttctccccctcctcactctctgcacaggctctgacggtcctcctatgtgctgacacagcccacccgtcggtcgtccgtcgtccccgaggacacggaccggccaaggactccaccgttgacctcgtggagtatcgctattcgacccctaacccgtatactttcttattcggtaaccagcgagaacgccgaacggccacggcccctagttcgttgttagattaataataaacgactacgtagaacggacgtccttacgagggtactacccgtaggacgtcgtacttcgtcgtcgtcctcccgacgtcgaacggactaagtcgtacatacgttacgacctatacgaggtaggtacggtcccgacggaccgaaggaccggaacggtacggtactacgtactttacgtttctacgtcgttaacttccgtacgaacgtaccttacgtacggttacgttccgtttaacgttcgttaccggttaccgg

SEQ ID NO: 50200 - DNA, 686 bp, Homo sapiens
  misc_feature: GYAE6OF02GPFNJ.51.6.A06.1.454.CMB.1.raw
  modified_base (170)..(170): a, c, t, g, unknown or other
  misc_feature (170)..(170): n is a, c, g, or t
tcagcgatcgtatacacgaccggtgctcgatttagatctactgacagggcacgaccggtgctcgatttagatctacttgacagggcacgaccggtgctcgatttagatctactgacagggggtggtccaggagcagaactctgggtgtctcaccatggcctggatccctntacttcctccccctctcactctctgcacaggcctctgagccctctatgtgctgacacgacgcccacccgtggtcgtccgtcgtaccccgaggaccagaccggaccaggtactccacctgcctacgtaggagtatcgactacgttaccgaccctaaccctacttactttacgttaagttcggtaaccctaggaccgtaacggaacgtcccgaacggacccgaccggtccccgttaggttcgtttaggttcgaattaattaaacgtaaacgtacctagtacgaacggtacgtcccttacggaggtacctcccgtagacgtacgtactttcgtacgtacggtccgttaccgaccgtcgaacgggtactagtcggtaaccgtactacgttaccgtaacctagtaccgtagtacggtaccgtaccgaacgggacaaggtaaacggccggtaacggtcccgttacgtaaccgtttacgtttcgaccgttacgtaacctttccgtaacgtacgtacttaacgg

SEQ ID NO: 50201 - DNA, 600 bp, Homo sapiens
  misc_feature: GYAE6OF02FM8HG.51.6.A06.1.454.CMB.1.raw
tcagcgatcgtatacacgaccggtgctcgatttagatctactgacaggggggagcctagctgtgctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatccacctgctctggagatgcattcgccaacccactattcttattgtaccagcagaacgccaggccacggcccctgtgttgttgatatataaagacactgagtacggccttcgagggactcccgtgacgcgatttcgtctggctcccacctacgagggaacctaagtcggtacactagttacgacctatacgagtggtacgtccgaggcaaggaaggacgaggactagtaacttacttttactgtactaattccttacaagtactactcgttagttacggttacttacgttcggtttacgttaccggtaacggttaccgggtaacccgttaaacggtccgtaacccggttaccgtacgggtaccgacgtacccccggaaacccgg

SEQ ID NO: 50202 - DNA, 771 bp, Homo sapiens
  misc_feature: GYAE6OF02JURSY.51.6.A06.1.454.CMB.1.raw
tcagcgatcgtatacacgaccggtgctcgatttagatctactgacagggggtgggtccgaggaggcagaactctgggtgtctcaccatggcctggatccctctacttctccccctcctcactctctgcacaggctctgagcctcctatgttgctgacacacgccctaccctcgggttctcccgtcggtacccccaggacacgacgggccaggactcacctgctcgtagtatgccgatttgacccaaacccctactaacttttaccgttaattttcggttaacccgaacggtaccaacggaaacggaccgaaccgggaccgaaccggtcccccgttcggttacgtttggtttaggtaattaattaacgtttaaaacggaacctaaccgtaaccgttaggaacggtccggggtttaccctaacgggagttaccccgtccggaatccggactttacgtccttcggacggttcccctaaccgttcctaacggtaccggtaaacttacggggtaccgtaacgtaaccttaggtaacccaacgttttccgaagggttccgggtaagggtaccgtacggaacggaacgaacggaacgtaacggtaccgtacggtactacgtttacttaacggttctaacgtacgttctaagtcgaattaccgtatacgttacgttacgtacggtacttacgggtactacgggtaccgaacggtactacgtaccgtacgtcccggtacaccgacccgacgtaccaccgtctcctacctctccctacccg

SEQ ID NO: 50203 - DNA, 599 bp, Homo sapiens
  misc_feature: GYAE6OF02GB98F.51.6.A06.1.454.CMB.1.raw
  modified_base (322)..(322): a, c, t, g, unknown or other
  misc_feature (322)..(322): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattcgaccaacccacttattcttattggtaccagcagaagccaggccacggcccctgtgttgtgatataataagacactagagaggccttacgaggactccgngacgcgtattctcgtcggctccacctcgaggactaagtggtactactatcgacctatcgaggtcggacgtccgaaggcgaaggaaggacggaggtacgtagtacttagtttcgtagttactaattccttacacgactatacgtagttacggttaacttcgttgttaccgttacggaacgttacgggaaccgtacggtcccgtaccggttaccgtacggtaccgaccgacccgaaccgaccccgaacccctactacgtacccttaccgtcgttccccg

SEQ ID NO: 50204 - DNA, 741 bp, Homo sapiens
  misc_feature: GYAE6OF02IAKFT.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacacgccaccctcggtgtccgtcgtccccgaggacaggaccggccaggatcacctgctctggagatgctattcgacccaaaccctattactttcttaagttcggtaaccagcaagaacgccacgggaccacggcccctgttcgttgttgtaatataataaagacacgtaggagacggtccttacgagggtactcccgtagagtcgtattctcgtcggccctccaccgtcgaacgggaactaacgtacggtaccaactagttacgaaacccgtagtaccgtagggttagggtaaccggtaccgaacgggtacgaaaacggttaaacgggaacggtaacgggacgtaacggtaaccgttttacttttaccgtacggttacttaaacgtttcccttaacgaacggtaacttacgtaccgtaagggtttacgttaacgtttagttacgtttccgttaacgggaaacggtttaccgggaccttaacgggtccgttaacccggtcccgttaacggtcccgtaacggaacccccgtaaacggacccctaaccccgaccggtttaccgaccttacccgttccgttacccccgg

SEQ ID NO: 50205 - DNA, 650 bp, Homo sapiens
  misc_feature: GYAE6OF02FUP1I.51.6.A06.1.454.CMB.1.raw
tcagcgatcgtatacacgaccggtgctcgatttagatctactgacaggggggagcctagctgtgctgtgggtccaggaggcagaactctgggtgtctcaccatggcctggatccctctacttcctccccctctcactctctgcacaggctctgaggcctcctatgtgctgacacacgcccacccgtcggtcgtccgtcgtccccaggacaggaccggccaggatccacctgctcgtggagatgctacgttcgacccaacccacttacttctttaagttcggtaaccagacaagaacgccgacggccacggccctggttcgttgttgataataagtaaagacactgagaggtccttgacgggtactcccgtagacgtcgtattctcgtcggcctaccaccgtacggacggtactaagtcggtacctaacgtattcgaactagtacgaggtcggacgtaccgaggacaaggaacgacggagctacgtacttacgtttcgtagttactaattccttagactactacgtacgtaggtttacggttacgttacgttcggttccggttaacggtaaccggttacgggtaaaccgtaacgggttacccgtaacccggttccgttaacggccgtaacccggtaccccgtaaaccccgg

SEQ ID NO: 50206 - DNA, 618 bp, Homo sapiens
  misc_feature: GYAE6OF02IAJ0H.51.6.A06.1.454.CMB.1.raw
tcagcgatcgtatacacgaccggtgctcgatttagatctactgacaggtggtgggtccaggaggcagaactctgggtgtctcaccatggcctggatccctctacttctccccctcctcactctctgcacaggctctgaggcctcctatgtgctgacacagccaccctcggtgtcccgtgtcccccaggacaggacggccaggatcacctgctctggagatgcattcgacccaaccctactattctttattcggtaccagcagaagccaggccacggcccctgtgttgttgatataataaagacacgtgagacggccctcgaagggtactcccgtgacgcgtattctcgtcggtctccgaggtacgacgggaactaacgggtcacgtagttcggccagtcgaggtggacgtccgagggcgaggaggacggaggacgtagtacttaattagttagtacaacgtacaacgagactaaccgtagtttacggttactttacgttacgttaccgttaccgtaacgtcgaccgaaccgtaacggtccgtacccggttccgtcgggttaccaccggacccgaacggcccctaaccccgtcgtaccgtcctacccgtcgttaccccg

SEQ ID NO: 50207 - DNA, 626 bp, Homo sapiens
  misc_feature: GYAE6OF02JYICG.51.6.A06.1.454.CMB.1.raw
  modified_base (219)..(219): a, c, t, g, unknown or other
  misc_feature (219)..(219): n is a, c, g, or t
  modified_base (222)..(222): a, c, t, g, unknown or other
  misc_feature (222)..(222): n is a, c, g, or t
  modified_base (232)..(232): a, c, t, g, unknown or other
  misc_feature (232)..(232): n is a, c, g, or t
  modified_base (249)..(249): a, c, t, g, unknown or other
  misc_feature (249)..(249): n is a, c, g, or t
  modified_base (289)..(289): a, c, t, g, unknown or other
  misc_feature (289)..(289): n is a, c, g, or t
  modified_base (565)..(565): a, c, t, g, unknown or other
  misc_feature (565)..(565): n is a, c, g, or t
tcagcgatcgtatacacgaccggtgctcgatttagatctactgacaggggtgggtccaggaggcagaactctgggtgtctcaccatggcctggatccctctacttctccccctcctcactctctgcacagctctgaggcctcctatgtgctgacacagccaccctcggtcgtccgtcgtcccccaggacacgaacggccaggatcacctgctctggagntgnatgccaaccnctattctatggtaccancagagccaggccacggccctgtgttgtgatatataacganacgtgaggtaggtaccttcgaagggtactccgtagtacgcgtacttctcgtcggtctcccacgttccaagggacctaaagtcggtacagtacgttcgaaccagtctaaggtgggtactacggaacgcgaaggaaacgacggtaagcttgaacttacgtttcgtctacgtactgttacaaggtctagtcgaagtttccggtaatttcgtacgtttacggttaccggtaaacgtcgggtaaacctaccgggtacctaacccggttccgtaaggttccncggttaccccaaacggtccccgtaaccctcgtacgttaccgtacccttcgttaacccccgg

SEQ ID NO: 50208 - DNA, 712 bp, Homo sapiens
  misc_feature: GYAE6OF02GZLFY.51.6.A06.1.454.CMB.1.raw
tcagcgatcgtatacacgaccggtgctcgatttagatctactgacagggcgaccggtgctcgatttagatctactgacaggggtgggagcctagctgtgctgtgggtccaggaggcagaactctgggtgtctcaccatggcctggactccctctacttcctccccctcctcactctctgcacaggctcgtgacgcctcctatgtgctgacacacgcccacccgtcggtcgtccgtcgtccccgaggaccaggaccgccaggactaccacctgccgttcgtagggacgtagtcgactacttaccgacccctaaaccctacttatttacgtttacgttacggaccctagaccaacggaacgacccgtacgggcccgtacggtccccgttggttcggtttagttagtaattaataaacgtaaacgaccgtacgtaggaacgtacggtcccttacggacgggtacctacccgtagacggtcgttacgtttcgtccggtcggtacccttacccgaccgtacggaacgggtactaaggttccggtaactaccgttagtaccgaacctagtaccggtacggtaggtaccgtaccggtaaggaccgtaaggaacggtacggacggttacgtacgtaacgtttccgtttacgtccggttaactacgttcctaacgtaacgtacgtaacttcggttaacgtttagttacctttagtaccggg

SEQ ID NO: 50209 - DNA, 747 bp, Homo sapiens
  misc_feature: GYAE6OF02GYKDX.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagtcaccctcggtgtccgtgtccccaggacagacggccaggatcacctgcttctgggagatgctattcgacccaacccacttattctttagttacggtaccagctaggaacgcctacggcccaggcccctggtgttgttgatatataaacgacaacgtgaggacgccttcgacgggtatccccgtagacgcgtacttcttctggtcctaccaccgtcgaacgggaactaagttcggtaccgactatttacggaacccctattaccgaggttgggtaacgtacccggaacgggaccgtaacgggaaacgaaccgggtaacggtccgtaacggtacccgttaagtttttacctacggttactaaacgtttcccgttacgtaacgtaaccgtacgttacgtaacgggttacgggtttaaccttttaagttccgtttacggtttaacccgggtaaacggtttccgggggaacccgttagggtacccgttacccggttaccggtttaaccgggttacgacccggtaacccccgaacccgggacccccgtaaccccgttaccgttaccgtcccgttacctccgttttacccccgg

SEQ ID NO: 50210 - DNA, 824 bp, Homo sapiens
  misc_feature: GYAE6OF02H072D.51.6.A06.1.454.CMB.1.raw
  modified_base (218)..(218): a, c, t, g, unknown or other
  misc_feature (218)..(218): n is a, c, g, or t
tcagcgatcgtatacacgaccggtgctcgatttagatctactgacagggggtgggtccaggaggcagaactctgggtgtctcaccatggcctggatccctctacttctccccctctcactctctgcacaggctctgaggcctctatgtgctgacacagcccacccgtcggtcgtccgtcgtccccaggacagacggccaggatcacctgctcgtgganatgctattcgacccaaaccccatttacttctttaagtttcgggtaacccagtacgaagaaacgcccgaacgggaccgacggtcccccgttggttcggtttaggttttagaagttaagttaacgttaaaacgacgtaacgttaggaaggtacggtacccgtttacgaacgggggtacttcccgttaggacggtaccgtactttccgtccgttcggtaccctcccgtaaccgttacgaacggggtaacctaaacgttcggggttacctaaccgtaacgtttaacggaccctaacgttaccggtagggttaacgggtacggttaacccggaacggggtacgaaagggaaacggaacgggtaacgggtacgtacggttaacgtttacgttttacccgttaggttaacctaactttccgttaacgaactaaccgtacgtacgttaggttacgtttaacgtttaagttcggttaccgtttacgggaaaccgttacgggtaaccgtacggtaccgtaccccgttaacgtacggttaccgaaccggtaccccgaaacccgggtacccctaaaccccgtaccgttaccggtaccctaccggttcccttacccccg

SEQ ID NO: 50211 - DNA, 752 bp, Homo sapiens
  misc_feature: GYAE6OF02JDQOM.51.6.A06.1.454.CMB.1.raw
  modified_base (116)..(116): a, c, t, g, unknown or other
  misc_feature (116)..(116): n is a, c, g, or t
  modified_base (221)..(221): a, c, t, g, unknown or other
  misc_feature (221)..(221): n is a, c, g, or t
  modified_base (240)..(240): a, c, t, g, unknown or other
  misc_feature (240)..(240): n is a, c, g, or t
  modified_base (245)..(245): a, c, t, g, unknown or other
  misc_feature (245)..(245): n is a, c, g, or t
  modified_base (335)..(335): a, c, t, g, unknown or other
  misc_feature (335)..(335): n is a, c, g, or t
  modified_base (363)..(363): a, c, t, g, unknown or other
  misc_feature (363)..(363): n is a, c, g, or t
tcagcgatcgtatacacgaccggtgctcgatttagatctactgacagggggagcctagctgtgctgtgggtccaggaggcagaactctgggtgtctcaccatggcctggatccctntacttctcccctctcactctctgcacaggctctgacggcctcctatgtgctgacacacgccaccctcggtcgtaccgtcgtccccaggacacggacggccaaggntccgacctgctcgtggacntgctnttcgccaaccactacttcttacgtcgttacagtaccagaacgacgacgtaccgcgacccttcgtcgtttcgttgactaataacaaagacnctagacgagtcctcgacgggactccggngtacgcgtactttcgtctggtacctccgtacccgtacgtaacgggtactaaacgtggtacctaacgtacgtttaacgacccgtaacttacggtaacggttacgggtaccggttacccggtaacggaaccgggtaacgtaaaaccggggtaacggaaccgggtacgtttaccggtaagttttaaccccgttttaggttttaacccggttacccggtttaaattaccccggggttttaacaaacgttaaccgtaacggttaccgttaggttaacgggttttacccttttaaggtttccgtaaccggtttaccggtaaccggtaccgggtaaccgttaacggtacccgttacgtaccggttaggtacccgtacccgtacccggtaaacccgg

SEQ ID NO: 50212 - DNA, 798 bp, Homo sapiens
  misc_feature: GYAE6OF02GKZV9.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccacctcggtcgtccgtcgtccccgaggacagacggccaggatccacctgctcgtggagactgactattcgaccaacctacttattacttattacggtaccacgcaacggaacgccgaacggacccgacggtccccttggttcgtttagttacggattaactaaactaaacgaccaacgtaggaacggtacggtccgtttacggaacgggtacctaccgtagacgacgtattccgtacgtcgtacctacccgtaccgtacgacgggtaacgtaagtcggtaccacgtacgttacgaacctacgtacgtaggtcggtaacgtccgaacggtacgaaacggtaaacggaccggtacggtacgttaacgtaacgtttactttacgttaccgttaactaaacttccgttaacgaacgtaaccgtaagttaccgttaacgggttacgttttaaccgtttaacgttcggtttaacccggttaacgggttaaaccggttacgggtaaacccggttacgggtttacccgttaaccccggttaaccgttaacggttacccggtaacccggtaaccccgtaacccggtaccccctaaacccggttacctaccggttacccgttaaccgttccccgtttaacccccggg

SEQ ID NO: 50213 - DNA, 605 bp, Homo sapiens
  misc_feature: GYAE6OF02GMUQS.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctctcactctctgcacaggctctgaggcctcctatgtgctgacacagccaccctggtgtccgtgtccccaggacagacggccaggatcacctgctctggagatgcattcgccaacccactattcttattggtaccagcagaagccgggccaggcccctgtcgtggtgatgtataaagacactgaggaggccctcgagggactccctggagcgtattctctggctccgaggtcgagggactaacggtcacgtattggaccagtcagtgggagtccgaggccgaaggacggacggacggctagaaccttatttattggttacaattacgaacagaccacgtagtttcggttaactttacgttgttactttacggtaacttcggaccgtaacccgaaggttcccgtaccgttaccgttcgggtcgaaccgtacccgaacggacccctaaccccgacgttactaccacccgtttcgttacccgttccccgtaccccc

SEQ ID NO: 50214 - DNA, 699 bp, Homo sapiens
  misc_feature: GYAE6OF02G79UB.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagcccaccctcggtgtccgtcgtccccaggacagacggccaggatcacctgctctggagatgcattcgacccaaccctacttactttcttagttcggtaaccagcaggaacgccaggccacggcccctgtgttgttgatatataaagacactgagagccttcgagggtactccctggacgcgtacttcgtcgtcgcctaccacctcgaacgggactaagtcgggtacactattcgacctactacgagggtaggacgtaccgaggaccgaaggtaaacggacggtagggacttacggtaactttacgtttacgtcgttacctaacgttcctttacgaacgtaacctacgtttacgaaggtttacgggtttaacttttacgtttccgtttaccggtttaaccggtaaccggttacggggtaacccttaagggttacccgttacccgggtttaccgttaaccggttaccgtacccggaccccgtaaaccggacccccgtaacccctacgttaccggttaccctacccgttacctttacccccgg

SEQ ID NO: 50215 - DNA, 898 bp, Homo sapiens
  misc_feature: GYAE6OF02GUN8S.51.6.A06.1.454.CMB.1.raw
tcagcgatcgtatacacgaccggtgctcgatttagatctactgacgagggggtggggtccaggaggcagaacctctgggtgtctcaccatggcctggatcccgtcctacttctcccctcctcacgtctctgcacaggctctgacggccttcctatgtgctgacacagccacccgtcggtcgtcccgttgtccccaggacaggaccggccaggatcacctgctctggagattcggcattcgacccaaacccgtacttaactttacctttaggtttacggttaaccaagtcaaggaacgaccgaaacggacccgaacggccccccgtaggttcgtttggttgaacttaattaagtaaaacgtaccgtaacgttacggaacggtaacggtccgtttacggaacgggggtaccttcccgttaggacggtaccgtaacgttttccgttccgttcgggtcccttacccgacccgttaccggaaacggggtaaaccgttaaacgttttacgggttacctaaccttaactttaaccgtaaacccgtacgtttaaccggtaacggttacggggtaaccgtttacccggaaacgggaccggtaaacgggaaaacgggtaaaccgggtaaacgggttcccgttaacggttaaaccttttaacgtttttacggtttaccgttaaccgttaaacgtttccgtttacgaaccggtaactaaccgtttaccgtaacgggttttcgtttaacgttttaacgtttcggggtttaccgtttaccgggtaaacgttacggggtaaccgttaacgggtaccctaaccgggttaaccggtacggttaccgaaccgtacccgaaccggtacccctaaccccgtacgttacccggtaccttaccgttaccgtttacccccg

SEQ ID NO: 50216 - DNA, 743 bp, Homo sapiens
  misc_feature: GYAE6OF02G9THK.51.6.A06.1.454.CMB.1.raw
  modified_base (204)..(204): a, c, t, g, unknown or other
  misc_feature (204)..(204): n is a, c, g, or t
tcagcgatcgtatacacgaccggtgctcgatttagatctactgacagggggtgggtccaggaggcagaactctgggtgtctcaccatggcctggatccctctacttcctccccctctcactctctgcacaggctctgaggcctcctatgtgctgacacacgcccacctcggtgtccgtcgtccccaggacacggacggccaggntccaccgtgctcgtggagatgctattcgacccaaccctattattactttagtcggtaaccagtacaagaacgccgacggacccacggtcccccgtaggttcgttaggttactaacttaagttaaacgttaaaacggaccaacgttaggtaacggacgggttacccttacggaacggggtacctacccgtgaacggtcgtagttcctacggtcggtcctccctacgtcgaacgggtacaagtcggtaacaagtactacgacctagtccgaggtacggtacggtaccgacgggactaacggaaaggacggagtccggttagtaccgttttagtaccttagaccttaacgttctctacgtaactacgtaccggtagtttcgttaatttacgtcgtttaaccggttacgtaacgggttaccggtaacgtaaccggttaccgtaccggtaacccgttaggtacccggacccggttaacccgaacccgggttaacccctaaccccgtaggttaccccgtacgttacccttacggtttaccccccg

SEQ ID NO: 50217 - DNA, 678 bp, Homo sapiens
  misc_feature: GYAE6OF02IPFA8.51.6.A06.1.454.CMB.1.raw
  modified_base (499)..(499): a, c, t, g, unknown or other
  misc_feature (499)..(499): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagcccaccctcggtgtccgtgtcccccaggacaggacggccaggatcacctgctctggagatgctattcgacccaacccacttatttacttattagggtacccagacagaaggccacggccacggcccctgtgttgttgatatataaagacactgagacggtccttacgacgggtactccctaggacgacggtaactttctccgtacggcctaccctaccttcgaacgggtactaacgtggtacctaacgtacttcgtaccagtcacgggtaggaccgtaccgaggacaaggaagacggaacggtctacggtaacttagtttactcgttaactacttctanaccgtaactacgtacgttacgttagttagtttacttcgttaacgtttaccggaacgtaccgggtaaccggtacggttcccgtaccggttacccggttaccggtccgtaaccggaccccgtaccgggttaccctaacccccgtacgttacccggtacgttacccctcgtttaacccccgg

SEQ ID NO: 50218 - DNA, 606 bp, Homo sapiens
  misc_feature: GYAE6OF02JWVX8.51.6.A06.1.454.CMB.1.raw
  modified_base (130)..(130): a, c, t, g, unknown or other
  misc_feature (130)..(130): n is a, c, g, or t
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (236)..(236): a, c, t, g, unknown or other
  misc_feature (236)..(236): n is a, c, g, or t
  modified_base (251)..(251): a, c, t, g, unknown or other
  misc_feature (251)..(251): n is a, c, g, or t
  modified_base (298)..(298): a, c, t, g, unknown or other
  misc_feature (298)..(298): n is a, c, g, or t
  modified_base (322)..(322): a, c, t, g, unknown or other
  misc_feature (322)..(322): n is a, c, g, or t
  modified_base (346)..(346): a, c, t, g, unknown or other
  misc_feature (346)..(346): n is a, c, g, or t
  modified_base (401)..(401): a, c, t, g, unknown or other
  misc_feature (401)..(401): n is a, c, g, or t
  modified_base (444)..(444): a, c, t, g, unknown or other
  misc_feature (444)..(444): n is a, c, g, or t
  modified_base (467)..(467): a, c, t, g, unknown or other
  misc_feature (467)..(467): n is a, c, g, or t
  modified_base (498)..(498): a, c, t, g, unknown or other
  misc_feature (498)..(498): n is a, c, g, or t
  modified_base (518)..(518): a, c, t, g, unknown or other
  misc_feature (518)..(518): n is a, c, g, or t
tcagcgatcgtatacacgaccggtgctcgatttagatctactgacagggcgaccggtgctcgatttagatctactgacgaggggtggggagcctagctgtgctgtgggtccaggagcagaactctgggtntctcaccatggcctggatccctctacttctccccctcctcacctctctgcacaggctctggcgccctctagtcgngcctagaccncacgccctaccccgtttcggntccgtcgtacccccngggtaccagccggccgaaggtctccaccgttcgctccttaggggacnttcgcaacttcacccgaaaccctntcttcttagttcgacagctagacncgagccacggtcccctgttcgttgtagtacttaactaacggtaaacgccttacgngacgtacggtcccttaacgcgggactcccgtaagcgctcttcncgtcgcctccactcgagacttcngtaccagcttcgaccctgtcctagtggaacncccgaagggaccaggaaacncggacggtttccagttactacttcgggttcaactaaacctctttacgggaactcgaacttccggtaaggtcgtaacctttgttcccgg

SEQ ID NO: 50219 - DNA, 687 bp, Homo sapiens
  misc_feature: GYAE6OF02IR3BO.51.6.A06.1.454.CMB.1.raw
tcagcgatcgtatacacgaccggtgctcgatttagatctactgacagggcacgaccggtgctcgatttagatctactgacagggcacgaccggtgctcgatttagatctactgacgagggggtggtccaggaggcagaactcgtcgggtgtctcaccatggcctggatccctctacttcctccccctctcactctctgcacgaggcctcgtcgacggcctctagtgtcgctgacacgcgccctaccgtggttcgtccgtcgtaccccgaggacgacggacggccaggactccaccttcggcttacgtggagtactgactacgttccgaccctaaccctactttactttcgtttacgttacggacctagacgaagaaccgccgacggcccacggtcccgttgttggtttacgtacgtagtaactaataaacgactacgtaggacggtcgtaccgttcggtaacggtcctcccgtaggacgtcgtacttccgtacgtcgtccttacccgtaccgtacggaacggtactaagtcgtaaccgtacgtagttacacctagtacggtacggtcggtacccgacggaacggtaccggaacggaacgggaccggtaacggtccgttaacggttaaccgtttacttttccggtaacggttaaccttaactttacggtaacgtacgtacttaaccgg

SEQ ID NO: 50220 - DNA, 723 bp, Homo sapiens
  misc_feature: GYAE6OF02JNGVW.51.6.A06.1.454.CMB.1.raw
  modified_base (218)..(218): a, c, t, g, unknown or other
  misc_feature (218)..(218): n is a, c, g, or t
  modified_base (411)..(411): a, c, t, g, unknown or other
  misc_feature (411)..(411): n is a, c, g, or t
tcagcgatcgtatacacgaccggtgctcgatttagatctactgacagggggtgggtccgaggaggcagaactctggtgtctcaccatggcctggatccctctactctccccctctcactctctgcacaggctctgaggcctcctatgtgctgacacagccaccctggtcgtccgtgtcccccaggacagaccggccaggactccacctgctctggagntcgctattcgacccaacccagttacttccttaattcggtaacccagccaagaacgccgaggccccgaacggtccccctggttcggtttcgtagtattataacgtaaagactaacgtagagacggtccctttacggagggtacctaccccgtagtacggaccgtattccgtcgttacggtcccttaccgtaccncggtaaggggaccctaaaagtccgggttacaaccgttagtttacgaaccctacgttaccgtaggtacgggtacgttacccgaagggacccgaaaggaaaccggtacggaacgggttaccttacgggaaccgtttacgtttacgtacggttaactaacgttccgttacacggtatacgtacctagggtttacgtacgtttatacggtcctttaaacggaacgtgggtaacctaacggtcctaaccgtccggtaacgtcgtacgaaccccgaagcccccaaaccgtctaccgtaacccgtcgtacccgttcccg

SEQ ID NO: 50221 - DNA, 621 bp, Homo sapiens
  misc_feature: GYAE6OF02F6FC7.51.6.A06.1.454.CMB.1.raw
  modified_base (213)..(213): a, c, t, g, unknown or other
  misc_feature (213)..(213): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacgccaggatcactgctctggantgcattgcccaacccacttattcttattcggtaccagcagagccaggccacggcccctgtgttgttgatatagtaaagacactgagaggtccttacgaggactcccgtggagcgtattcctcgtcggcctaccacctcgagggaactaagtcggtactaactacgttacgacctatacgaggtcggacgtcccgaggtaccgaagaaacggtacgacgggtactacggactttacgtttacgtgttacctaacgttcttaccgaagtaaccctagtaccgtaggttacgtttactttagttcgttacggttaacggtaacgtacgggaaccgttacggtaccgtaccggtccgtaggccaaccgcccgaacgcccctaacccgactccgtacctaccgtcgttcccgg

SEQ ID NO: 50222 - DNA, 742 bp, Homo sapiens
  misc_feature: GYAE6OF02GNTDI.51.6.A06.1.454.CMB.1.raw
  modified_base (296)..(296): a, c, t, g, unknown or other
  misc_feature (296)..(296): n is a, c, g, or t
tcagcgatcgtatacacgaccggtgctcgatttagatctactgacagggggtggtccaggaggcagaactctgggtgtctcacatggcctggatccctctacttctccccctctcactctctgcacaggctctgaggcctctatgtgctgacacagcctacctggtctccgtcgtccccaaggacaggacggccaggactcacctgctcgtggatatcgactatcgacccaaccattattcgttattcggaaccagacaagacgcgagccgacgccctgtcgttgtagattaatanaagactacgagacgtacggtccgttacgaggacttcccggtagacgtacgttagttcctacggtgtcctaccgacgtacgacggtaactaacgtacggtacaactaggtacgaacctatacggacggttaggacgtacgtaaagggtccaaaggaaacggttcggaacgggtcgttaaaccgtacgtttacgtttacggtacgttaaccgttaacctacgttaacaacggttactaaacgttacggtaacggttttacgggttaacctttacggtttcgtttaaacccggttacgggtaaaccggtacggtaaaccggtacgttacccgggtttaaccccgtaacgggttaaccggacccgtaacccgggtaaccgtaacccggtaaccccctaaccgttaaccggttacccgtaaccgttaccccgtttccggtttaacccccgg

SEQ ID NO: 50223 - DNA, 643 bp, Homo sapiens
  misc_feature: GYAE6OF02IPLUZ.51.6.A06.1.454.CMB.1.raw
  modified_base (183)..(183): a, c, t, g, unknown or other
  misc_feature (183)..(183): n is a, c, g, or t
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (311)..(311): a, c, t, g, unknown or other
  misc_feature (311)..(311): n is a, c, g, or t
  modified_base (477)..(477): a, c, t, g, unknown or other
  misc_feature (477)..(477): n is a, c, g, or t
  modified_base (506)..(506): a, c, t, g, unknown or other
  misc_feature (506)..(506): n is a, c, g, or t
  modified_base (593)..(593): a, c, t, g, unknown or other
  misc_feature (593)..(593): n is a, c, g, or t
tcagcgatcgtatacacgaccggtgctcgatttagatctactgacagggcacgaccggtgctcgatttagatctactgacagggcacgaccggtgctcgatttagatctactgacgagggggtggtccaggaggcagaactcgtgggtgtctcaccagtggccgtggactccctctacttccnccccctctcactcnctgcanggctcgtgacgcctctatgtcgcgtgacacgacgcctcccgtggtcgtccgtccgtacccgaggacgacggaccggcgaagactccacgtcgtctacggtaggaacgngttcgctacgtccgaacctaaccctacgttacttacgttaacgttcgacctaggactaacggaacgaccaccggctaccggtccgttagtttacggttcgtacgtaactaaagtaacgtaaaacgtctacgtagaacggtaccgtccgtaagacggtactacccgngtaacggtgtaccttagtccgtcgtaccnccgtacgacgtacggtaacagtacggtctaacgttagtaccaacgttacgtcgtaagcgtacgacgtacgagaagtaacggacggtnaggttccaactttacgttacgacgtaccgtaagttaccacgtacgaattg

SEQ ID NO: 50224 - DNA, 963 bp, Homo sapiens
  misc_feature: GYAE6OF02HQT01.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctctcactctctgcacaggctctgacggcctctatgtgctgacacgacgccctacccgtggtcgtccgtcgtaccccaggaccagaccggccaggactcgacctcgctacgtggatcgtacgctattccgaacccctaacctacttttactttacttacgtttacgggaacccacggacgtaacgaaccgaccggacggtacccgtaccggtccccgttaggttcgtttagttagtaacgttaagtaacgtaaaacgacctacgtaggtaacggtaccggtaccgtttacggacgggttacctacccggtagaccggtacgttacttccgtacgttaccggtaccctacccggtaccgtaccggtaacggtaacgtaacgttacgggtaacctaaccgttaacgttacggtaccctaagtacccggtagggtaacggtacccggtaccgtaaacgggaacgtaacgggtaaaacggtaccgggtaaacggtcccgtttaaacgtaccgttttaaacggttttaccgtttaaccgttaaacccggtttaacgttttaaccccgtttaacggtaaaccggtttaacgtaaaccggtttaacccggtttaaaggggtacccggtttttaaacgttaacggttttacccggttaccgggttttaaacccggggtaaacgttacccgggggttaaccgttaaccccgggttaccgttaaccccggggtttaaccggttaacccggggttaacccggaaaccccggtaaccccggttaacccggtaacccccgttaaacccggttaccggttaccccgtttaaaccccgttacccgtttaccccgtttaacccccgg

SEQ ID NO: 50225 - DNA, 634 bp, Homo sapiens
  misc_feature: GYAE6OF02G4SPV.51.6.A06.1.454.CMB.1.raw
  modified_base (218)..(218): a, c, t, g, unknown or other
  misc_feature (218)..(218): n is a, c, g, or t
  modified_base (284)..(284): a, c, t, g, unknown or other
  misc_feature (284)..(284): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagcccaccctcggtgtccgtcgtcccccaggacagacggccaggatcacctgctctgganatgcattcgcccaacccacttattcttattcggaccagcagaagccaggccagcccctgtgttgtnatatataaagcactgagaggtccttacgagggactcccgtggacgtcgtacttctccgtggccctcccgactcgaagggaactaagtcgtacactattcggacctatcgtaggtcgggtagtaccgagggacaacggaaacggacggaggacgtacgtacgttacgttttcgtacgtactaacttccgttacaagtacctaagtcgtaacggttacggttaactttagtcgtttaccgtacggtaaccgtcggggtaacctacgggtacctaccggtcgttaacggtccgaaccgacccgaaccggtaccccaacccgtcttaccgtaccgtacccttacgttacccccg

SEQ ID NO: 50226 - DNA, 676 bp, Homo sapiens
  misc_feature: GYAE6OF02G7D6H.51.6.A06.1.454.CMB.1.raw
  modified_base (613)..(613): a, c, t, g, unknown or other
  misc_feature (613)..(613): n is a, c, g, or t
tcagcgatcgtatacacgaccggtgctcgatttagatctactgacagggcgaccggtgctcgatttagatctactgacagggggtggggagcctagctgtgctgtgggtccaggaggcagaactcgtgggtgtctcaccatcggcctggactccctctacttcctccccctctcactctctgcacgaggctcgtaggacggtccttcctagtgtcgctagaaccacacgccctacccgtggtcgtccgtccgccccgaggaccgaggaccggaccgaggtactccgaccttcggtcttcggtagggacgtacgtcgacgtacttaccgaccctaaccctacttacgtttactttagttacggtacctacgacgaagacgaccgacgaccgacggtccccgttggttcgttcgttataagttaattaaagtaaacgacgtacgtaggaacggtcgtaccgttacggacggtactcccgtaggtacgaccgttattccgttacgtcggttaccctcccgtaccgtacggtaaccggacgtaaggttcgtacctagtactacgacctaatacgtaggtacggactaccggagacgaagaccggagtgacgtacgtnttacttcgttactactagttaccagtacgtaacgtctaacgtaggttcgttacttggttacgg

SEQ ID NO: 50227 - DNA, 572 bp, Homo sapiens
  misc_feature: GYAE6OF02F8Q45.51.6.A06.1.454.CMB.1.raw
  modified_base (216)..(216): a, c, t, g, unknown or other
  misc_feature (216)..(216): n is a, c, g, or t
  modified_base (419)..(419): a, c, t, g, unknown or other
  misc_feature (419)..(419): n is a, c, g, or t
tcagcgatcgtatacacgaccggtgctcgatttagatctactgacagggggtgggtccaggaggcagaactctgggtgtctcaccatgggcctggatcccgtctacttctccccctcctcactctctgcacaggctctgaggcctcctatgtgctgacacagccaccctggtgtccgtgtccccaggacagacggccaggatcacctgctctgganatgcattgaccaaccatattcttattggaccagcagagccaggcaggcccctgtgttgttgatatataaagacactgagacggccttacgacgggatccctaggacgcgtattcgtcgtcggcctaccaccttcgacgggtacaaagtcggtacacgattcgacctatcagtggagtcaggcagaagacgagctgactattcngtacattctacagactatactagtacgtacttagttacgtaccttacgggaactcgggtaacctagggtccaaccggttcgtaacgggtaccaacggtaaccccaacgggtacccctaaaccccgacgttacgtaccctactccgttacccgg

SEQ ID NO: 50228 - DNA, 605 bp, Homo sapiens
  misc_feature: GYAE6OF02F7Q8A.51.6.A06.1.454.CMB.1.raw
  modified_base (233)..(233): a, c, t, g, unknown or other
  misc_feature (233)..(233): n is a, c, g, or t
tcagcgatcgtatacacgaccggtgctcgatttagatctactgacaggggggagcctagctgtgctgtgggtccaggaggcagaactctgggtgtctcaccatggcctggatccctctacttctccccctctcactctctgcacaggctctgaggcctcctatgtgctgacacagccaccctcggtgtccgtcgtccccaggacagaccggccaggactcacctgctctgganatgctattcgacccaacccacttattcttattcggtaccagcagacgccgaggccacggcccctgtcgttgttgatataataaagacactgagtacgtcttcgagggtactcccgtaggagcgtattctcgtcggcctcccgactcggaggactaagtcggtacactattacgactactcgaggtggacgtccgaggacaaggaacgacggagctagtacttacgtttcgtagttactacttcttacgagtaacacttacgtagttacggtttacttaagttcggttacggttacggtaacggtaccgggtaaccgtaacggttaccgtaccgttaaccggtacggtaccgtaccgtacccgtaaaccccgg

SEQ ID NO: 50229 - DNA, 886 bp, Homo sapiens
  misc_feature: GYAE6OF02IKXQV.51.6.A06.1.454.CMB.1.raw
  modified_base (103)..(103): a, c, t, g, unknown or other
  misc_feature (103)..(103): n is a, c, g, or t
  modified_base (137)..(137): a, c, t, g, unknown or other
  misc_feature (137)..(137): n is a, c, g, or t
  modified_base (711)..(711): a, c, t, g, unknown or other
  misc_feature (711)..(711): n is a, c, g, or t
tcagcgatcgtatacacgaccggtgctcgatttagatctactgacagggggtggggtccaggaggcagtaactctgggtgtctcaccatggcctggatccctntacttctcccctctacactctctgccacaggctntgagtcctctatgtgctagacactacgcccaccttcgggtgtcccgtcgtaccccgaagggacacggaccggccgaagggacttccgaacctggtcctcgtcggaagtacttcggacctacgtttacgacccccaaaaccctacgtttactttacgttagttaccggtaccaacgacgtaacgaaccggacccgtaacgggaccccgtaccgggtacccccgtggtttacggtttacggttttaggaactttaaagttaaaacgtaaacgtaccgtaaacgttacggtaacgggtaccggtacccgtttaccggaacggggttaccttaccccgggtagtaacggttccgttaacccgttttcgttccgttaccgggcccgttaaccctaccggttacccggaagggttaaccctaacggttaccgtaccgtaactaacgttcgaaaccgttacgtaccgtaagggtacggtacgtaccggaacgtaacgaacgggaaaccggtacggtaacggtacccttaacggttacgtttacgttttacccgtacggtaacttaccgttaacccgttaanacgggttacctaagttaccgggttacgtttaacggtttactttaccgttacggtttaccgtaccgggttaacgttaccgggtaccgtacgtacctaccgttccggtaggtaaccggtccgtacccgaaccgtaccctaccgtacgttacccgtaccttacccggtcttcccccgg

SEQ ID NO: 50230 - DNA, 704 bp, Homo sapiens
  misc_feature: GYAE6OF02G39YM.51.6.A06.1.454.CMB.1.raw
  modified_base (178)..(178): a, c, t, g, unknown or other
  misc_feature (178)..(178): n is a, c, g, or t
  modified_base (201)..(201): a, c, t, g, unknown or other
  misc_feature (201)..(201): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacactagccaccctggtgtccgtntccccaggacagaccggccaggntccaccgtgctctgggacatgtcagttcgccctaacccattattccttaagttcggaaccagcaagaacgccaggccacggccccttgtgttgttgattactaagtaaacgacctaactggaaggacggtccttacggacgggtacttcccgtgacgtcctattcgtctcggacctccaccgtcgacgggactaagtcggtaccatacttcggaacctatcgaggttcggacgtcccgaagtcaaggaaagtaccggacggtactacgtaacttactttcgtacgttaactaaacttcgtacgacctactaacgttaccgtaggttacggttaactttacggttcttaaccggtttaccggtaacgggtaccggtaacccgtagggtccctaacccgggtttccgtaacggtttaccggaacccgaacccccggtaaccggtacccccctaaacccgttaccggttaccgttaaccctaccgttccccgttttaccccccggg

SEQ ID NO: 50231 - DNA, 893 bp, Homo sapiens
  misc_feature: GYAE6OF02JHPSU.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctctcactctctgcacaggctctggacggcctcctatgtcgctgacacagcccacccgttggtcgtccgtcgtccccgaggacctaggccggcctaggactccgaccgtgccgttcgtcgggagtactcggcctattccggaccccaaaccctacttactttccgttagttacggtaaccgacgaccgtaacggaaccggacccgtacgggaccccgtaccggtcccccgtttagggttcggttttacggtttacggtaaactttaacggttaaacgttaaaacgggtaacctaccggtttaagggaaccggggtaaccgggtcccttttaaccgggaaggggtttaacccgttaccccggtcgggtaaacggtcccggtttaactttccggtttcccggtacggtacccccttaccccggtaaccgttacccgggaaacggggaacccgtttaacggttacgggtaccttaaccgttaaacgttaccgttaaaccggtactttaccggtaggggttacggtaacccggtacgtaacggggaacccgtaagggtaaacgggacgggtacggtccgttaacggtaacttttcgttacttacgggtaactaccgttacgttaccaacggttactacgtaccggttaaggttcgttaacttttaggtccgtttacgttaccgggtaacttccgggaacgttcggtacctacccggttacgtacggtaccgaccgtaccggaaccgtacccgaccgtacttcgacccttaccgttcgttcccccg

SEQ ID NO: 50232 - DNA, 892 bp, Homo sapiens
  misc_feature: GYAE6OF02I9D5Y.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacacgccaccctcggtgtcccgtgtccccaggacagacggccaggatcacctgctctggagatgctattcgacccaacccctattacttctttaagttcggtaaccagcaagaacgaccaggaccaacgggtcccctggttggtttgttagaagttaataataaacgacctacgtaggacggaggtccttacgacgggtacctcccgtggacggtcgtacttccgtacgtcggtaccctaccgtaaccgtccgaacggggtaacgtaacgtcgggtacctaacgttacgttaccggaaacctaacgttaccggtaagggttacggggtacggtacccgtaagggtaacccgaaaggtaaacgggtaaccgggacgggttaccgtaaggttaacctttaacgtttttacccggtacgttaaccttaacgttttacccgtaacctaaacgggtaaccctaggttacccgttaaacggggttttaaccggtttaaacgttttacggtttaccgttttaaccgggttaacccgggttaaaccggttacgggggtaaaaccccgttacggggttaaccccgttaacccccgggtttaaccgggttaacgggttaacccgtaaacccgggttaaccccccggaaaccgggtaccccccccttaaaaaccccggttacccgggttacccggtttaacccccggtttaaacccccggtttcccccccggttttaacccccccgg

SEQ ID NO: 50233 - DNA, 747 bp, Homo sapiens
  misc_feature: GYAE6OF02F9082.51.6.A06.1.454.CMB.1.raw
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccacctcggtgtccgtgtccccaggacagacggccaggatcacctgctcgtggagatcgcattcgcccaaaccctactagtttcttattcggtaccagcagaacgccaggccacggcccctgtgttgtgattataataaagacacgtgacggagtccttagacgggtactcccgtagacgtacgtagttcctcgtcggtccctcccgaaccgttcgaacgggtaacaacgttcgggtacctaacgtacgttacgaacccgtatttacgaacgggttcgggaccgttaccggaacgggaccgaaagggaaacggtaacgggtaacggtacgttacgggtacctttaacgtttttcggtaccgtttactaaacgtttacccttacggaacgtaaccttagttacgtaggtttacggtttaacgtttagttcgtttaccggttaacgggtaacggttaccggggtaaccgtacgggttacccgtacccggtttaaccggtaacggttacccgaacccggtaccccggtaaaccggtacccctaacccgtaccgttaccgtacccgttacccgttaccggttttacccccgg

SEQ ID NO: 50234 - DNA, 924 bp, Homo sapiens
  misc_feature: GYAE6OF02GTH3E.51.6.A06.1.454.CMB.1.raw
tcagcgatcgtatacacgaccggtgctcgatttagatctactgacagggggtgggtccaggaggcagaactctgggtgtctcaccatggcctggactccctctacttcctccccctcctcactctctgcacaggctctgacggcctcctatgtgctgacacacgccctaccgtcggtcgttccgtcgtacccccgaaggaccacggtaccggccaggactccaccgtgctcgtggaagtactgtactacgttccgaacccctaaacctactttaacttactttaacgttcggtacccagtacgaacggaacgacccgacggacccgtaccggtaccccttggttacgttacgttagtaacgttaactaacgtaaacgtaccgtacgttacggaacggtaccggtaccgtacggtaacggttaccgtaccggttagacggtacgttaccgttcgtacgtacggacctacccgtaaccgtcggaacggtacaacgtcggtacctacgtataccgtaccgtacgtacgtacggtacggtacgtaccgtaacgggaaccgtaaacgggaacggtaaaccggtaccgggtaacgttaccggttaaacgtttagtttaacccgttagtaaccgtttaaaccgtttcgtaaacccgttaaacggtaccggtttacttaaaccggtttaacggttttacccggttaaaccgtttttacggttaacccggttttaaccggttaacccggtttaaacggggttaaccccgggtttaaccggttaacccggtttaacccggtaccccggtttaaccggggtaaaccccgttacccgggtaaccccggttaaaccccggtaacccggtaacccccgttaaccccgtaacccggtttaccgtaacccgtttcccccgttacccgtttacccccccgg

SEQ ID NO: 50235 - DNA, 865 bp, Homo sapiens
  misc_feature: GYAE6OF02FZKW6.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacacgcccacccgtcggtgtccgtcgtccccaggacaggaccggccaggactcacctgctcgtggacgagtcgactagttcgacccaaccctacttactttaccttagttacggtaccagtacaggaacgccgaacggcccacggtcccccttaggttcggttgggtagtacgttagttaaagtaaacgacctacgttacggaacggaaccggtccccgtacggaacgggtaccttcccgtaggtacgtaccgtaactttccgtccgttcggacccttccggtacgggtaccggtaaacggggtaacccgtaaacggtacctaacgtacgtttccggacccgtagttaccgtaagggttcgggtaaccgtccgaacgggacgaagggtacgggacgtacgggtcctaagtaacctttagtttagttaccggaactaacttaccgaaacgtacgtaacccgtaccgttaagtttaacggttaaccttttacgttacgttttaccgttaacgggttaacccgtacggtaaccccggtaaaccgggttaaccgggttaccccttacccgggttacccgggtttaacggggtacccgtaaccccggaccccggttaaaacccgggtaacccccctaaaccccgggttacccgtttaacccggttaacccctttaccccggtttacccgtttacccccgtttaaccccccccgg

SEQ ID NO: 50236 - DNA, 830 bp, Homo sapiens
  misc_feature: GYAE6OF02IF0Y4.51.6.A06.1.454.CMB.1.raw
  modified_base (275)..(275): a, c, t, g, unknown or other
  misc_feature (275)..(275): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacacgcccaccctcggtgtcccgtcgtcccccaggacagaccggccaggactccacctgctcgtggagatgctattccgacccaaccctacttatttcttagtcggtaccagcaagacnccgacggccaccggtccccttggttgtttacggttagacttaataaacgtaaaagtactaacgtggaacggtaccggtccttacggacgggtcctcccgtaggacgtaccgtattcctcgtcgtccgtaccctacccgtgacggaactagtaccgtactacgtattacgacctagtacgtaggtacgggtacgtaccggaaggtacgaaaggtaacggaacggtacgggcctaacgttaccgtttaacttttaccgtacgtttaactaaccgttacccgtttaacgaaccgttaacttaacttaccgggtttaaggtttaacggttttaacctttaacggtttcccggtttaaccggtttaaaccgggtaaaccgggttaccggggtaaaccccgtttaacggggttaaccccggttaacccccgggtttaccggttaacccgggttacccggaaccccgggaaaccccgttaaacccggttaaccccccccgaaacccggtaccccgtttacgttaacccccgtttacccgtacccggttttaccccccccggg

SEQ ID NO: 50237 - DNA, 610 bp, Homo sapiens
  misc_feature: GYAE6OF02JLP02.51.6.A06.1.454.CMB.1.raw
  modified_base (215)..(215): a, c, t, g, unknown or other
  misc_feature (215)..(215): n is a, c, g, or t
  modified_base (399)..(399): a, c, t, g, unknown or other
  misc_feature (399)..(399): n is a, c, g, or t
tcagcgatcgtatacacgaccggtgctcgatttagatctactgacagggggtgggtccgaggaggcagaactctgggtgtctcaccgatggcctggatccctctacttctcccctcctcactctctgcacaggctctgaggcctcctatgtgctgacacagccacctcggtgtccgtgtccccaggacagacggccaggatcacctgctctggantgcattcgcccaaccattattcgttattcggtaccagctagaagccaggccacggcccctgtcgtttagtgattaataattaaacgacacgttagagaacggcctttacgagggtactccccgtaggacgcgtacttctcgtcggctcccactcgagggactatcggtacactattcggaaccngttacgaaggttcggacgttccgaaggtccaaggaaacgcgaaggtcctaggtaaccttgttcctaggtactaacgttcttacgaacgatacgttcaggtttgttaacttgtcgtttactacggaacgtcgggaactcggtactcccggtcgttaagtcaaccgtccgaaacgtccccaaccgtcgtacgtacccgtactcgttaccccgg

SEQ ID NO: 50238 - DNA, 868 bp, Homo sapiens
  misc_feature: GYAE6OF02GMUEC.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagcccaccctcggtgtccgtgtccccaggacaggaccggccaggatccgacctgcctcgtggagatcgcattcgacccaaaccctattactttacttagttcggtacctacgcaagaacgccgaacggcccgaacggtccccttaggttcgtttggttagtaacttaagtaataaacgactaccgtaggacgtagggtccttacggacgggtacctacccgtggacggtaccgttacttccgtaccgttcggtcccttacccgtaaccgttccgaaggggtaacctaacgtttcggacctaacttacgttaccgtacccgtaacgtacgtacgggttaacggtacccggttacccggaagggtaacctaaacgggtaaacgggtaaccgggtaccgggttaaccgttaacgggttaaaccttttacgggtttacccgtttaacttaaccgttaaccgtttaccgtaaaccgtaacggttaaccttaaccgggttaacttaccggggtttaacgttttaccgttaacgttttcgttaaaccgggtttacccggtaacgggttaacccgggtaaccgtttaacccgggtaccgtttaacccccgggttaccgggttaaccggttacccgtaacccgggaaccccgtaaccccggtaccccgtaaccccgtaccgttacccgtcccgttacccgttcccgtttaaccccccgg

SEQ ID NO: 50239 - DNA, 650 bp, Homo sapiens
  misc_feature: GYAE6OF02JKEDM.51.6.A06.1.454.CMB.1.raw
  modified_base (463)..(463): a, c, t, g, unknown or other
  misc_feature (463)..(463): n is a, c, g, or t
  modified_base (613)..(613): a, c, t, g, unknown or other
  misc_feature (613)..(613): n is a, c, g, or t
tcagcgatcgtatacacgaccggtgctcgatttagatctactgacagggggtgggtccaggaggcagaactctgggtgtctcaccatggcctggatccctctacttctccccctctcactctctgcacaggctctgaggcctcctatgtgctgacacagcccaccctgggtcgtccgttcgtcccccgaggaccagaccggccaggacttcacctgctcgtggagtatcgctagttccgaccccaaaccctcttactttaccgttagtttacggtacccaacgaccgtaacggaacgacccgtacggaacccaccgggtccccccttggttcggtttcggttaggtaattaacgttaaacgtaaaacggactaccggtagaggtacggtccttacggaacggtactcccgtgacgtactacgttctcgtcgtcctccgacctacgaggtacagtgtcatactnacctatcgacgtgggtacgcggtacgagacgaaacgtcgacggtcgtatacgtttattcgtagttactacttctacctagactagtgtacgttagtacttagttcgtacgttcggacgtacgtaccgtagtcctacggtaccgtagaccncgaaccgaccgacctacctcgttctacctctcgtccc

SEQ ID NO: 50240 - DNA, 778 bp, Homo sapiens
  misc_feature: GYAE6OF02GKE7D.51.6.A06.1.454.CMB.1.raw
  modified_base (117)..(117): a, c, t, g, unknown or other
  misc_feature (117)..(117): n is a, c, g, or t
  modified_base (370)..(370): a, c, t, g, unknown or other
  misc_feature (370)..(370): n is a, c, g, or t
tcagcgatcgtatacacgaccggtgctcgatttagatctactgacagggggagcctagctgtgctgtgggtccaggaggcagaactctgggtgtctcaccatggcctggactccctntacttctccccctctcactctctgcacaggctactggacgcctctatgtcgctagactacgacgcccaccgtcgggttcgtaccgtcgtaccccgaggacagaccggccaaggtactccacgttagcctcgtaggacgtatgaccacgtttccgaccaaccctacttacgttctttacgttacgtaccagcaacggacgccgaacgtccgacggtccccttaggttgtttacgttggtaacttaacgttaaanaaacggtacctagttaggaaggtacgttccgttacggacggtaccttccgtagacggtacgttactttcgtcgtaccgtactacccaccgtacgaacggactaaggtccgtacaacgttacgttaccgaccgtagtacgtacgggtcggtaaccggtccgtaacgacggtaacggaacgtacggaacgttccgtaacgttacgtttacctttacgtaccggttactaacgttaccgttcgaacgtaacgttacgtacggttaacgttacggtttaacgtagtttaccgggtttaccggttaaccgggtaccgggttaaacccgggttaaccggaaccggtttacccggtaacccgtttaccgggtaaccgttaacccgggaacccggtaaccccggttaaaccccggg

SEQ ID NO: 50241 - DNA, 801 bp, Homo sapiens
  misc_feature: GYAE6OF02JLXMI.51.6.A06.1.454.CMB.1.raw
  modified_base (129)..(129): a, c, t, g, unknown or other
  misc_feature (129)..(129): n is a, c, g, or t
  modified_base (519)..(519): a, c, t, g, unknown or other
  misc_feature (519)..(519): n is a, c, g, or t
  modified_base (663)..(663): a, c, t, g, unknown or other
  misc_feature (663)..(663): n is a, c, g, or t
  modified_base (674)..(674): a, c, t, g, unknown or other
  misc_feature (674)..(674): n is a, c, g, or t
tcagcgatcgtatacacgaccggtgctcgatttagatctactgacagggggtgggtccaggaggcagaactctgggtgtctcaccatcggcctggatccctctacttctcccctctcactctctgcacnggctctgagcctctatgtgctgacacaggccaccctggtcgttccgtcggtccccaggaaccacggaccggccaggtactcgacctggcctcgtaggagtctaggcctagttccgacccaaccctattcgttaccttagttacggtacccagccgtaaggaaccgtccgaacggtacccaccgggtccccttggttcgtttacgggtttagaacgttacgtaaagttaaaaacggcgttaccgtaggtaacggaaccggttcccgttttacggacggggttaaccgtaccccgggttgaacgggtaccgttaacgttccctcggttacgggtacccctacccgttacccgtaccgggtaaggaactttaaacgtcgggtacttaaaccgnttaacggacctaacgttcgaaaggtttcggacttaaacggacgggtactaaacgggaaacgggtccgtaacgggtcgttttaaccgaacggtttactttcggtactacgttaacgtcgttacaagacctatcggttagtacgtnttaaccggttntccggtaacgtacggtcgggtaacgtacgtcccgtaaccggttcgtaaacggtccgttaaaccgcccggttaaacccggtccccgaaaccggttacgttccgtacccgttacgttcccctttaacgg

SEQ ID NO: 50242 - DNA, 824 bp, Homo sapiens
  misc_feature: GYAE6OF02I0RIS.51.6.A06.1.454.CMB.1.raw
  modified_base (241)..(241): a, c, t, g, unknown or other
  misc_feature (241)..(241): n is a, c, g, or t
tcagcgatcgtatacacgaccggtgctcgatttagatctactgacagggggggagcctagctgtgctgtgggtccaggaggcagaactctgggtgtctcaccatggcctggatccctctacttcctccccctctcactctctgcacaggctctgacggccctctatgtgctgacacacgcccaccgtcggtcgtcccgtctccccgaggaccaggaccggcaggactccgacctgcttcgnggactatcgacacttacgaccctaacctacttacttcttacgttcggtaacccgagtacgaagaacgccgaacggccgaccggtccccgtgttcggttgttacgtataacgtaactaaacgtacgtactaggacgtacggttccgttacggaacggtccgttccgtaagtacggtacgttacgtttcgtaccgtcggtaccctacccgtacgtaacggtacggtaacgtaacgttccggtacgtaacgttacgttaccgtaaccgtcgttaacgtacgggttacggtaccgtaaccggtacgaaccggttaaggaaaccgggtaccggtaacgtacgttaaccgttaaaccgtttgtttccgtaccgttaaccgttaaacctttacggtaccgtaaggttacctaaggtttaaccggttaacgggttttaccggttacccgttttaagggttaccggtttaaccggttaacgggtaaacccggggttaccggttaaaccccgggttaaccggttccccgtttaaccggtttaaaccgggtaccggtttaaccggaaccccggtaaccccgttaaacccccggg

SEQ ID NO: 50243 - DNA, 819 bp, Homo sapiens
  misc_feature: GYAE6OF02HEMMH.51.6.A06.1.454.CMB.1.raw
  modified_base (266)..(266): a, c, t, g, unknown or other
  misc_feature (266)..(266): n is a, c, g, or t
  modified_base (791)..(791): a, c, t, g, unknown or other
  misc_feature (791)..(791): n is a, c, g, or t
tcagcgatcgtatacacgaccggtgctcgatttagatctactgacaggggggtgggtccaggaggcagaactctgggtgtctcaccatggcctggatccctctacttcctccccctcctcactctctgcacaggctctggaggtcctcctatgtgctcgacacacgcccaccctcggtcgtccgtcgtccccgaaggaccaggaccggcctaaggacttcaaccgttcgcttcgtaggaagatcgactattacgaccaaacccctnttaactttcgttaagttacggtaccgagacaacggaacgccgaggcccgaccgtccccgtggttcggttcggtagacgttagtaataaaggtaccacgtaggaacggaccggtccgtacggtagggtacctcccgtaaggtaccgacggttaccgtttccgtccggtggtaccctaccggtaacgggttaccggaaacggggttaaaccggaaccggttaacgaacgttaacggtttcccgggaaccttactacgggtaaacgggtttcgggaaaccggtcccgaaagggtacgaaccggggaacgggacgggtaacgtacggttacgtaaactttaaggtttagttaaccggtaataacctaaacgaaacgtaaaccgacgttaaccgttaacggtttacggttaaactttcggttaccgttacgtttaaccgggattaccggacgtaaaccgttacgtaccgtaccgttccggtaagggaccctaccggtaacccgtaaccggaccccaacccgttacgtccncctacccgttttcgacccccgtttcccg

SEQ ID NO: 50244 - DNA, 746 bp, Homo sapiens
  misc_feature: GYAE6OF02J0I7X.51.6.A06.1.454.CMB.1.raw
  modified_base (232)..(232): a, c, t, g, unknown or other
  misc_feature (232)..(232): n is a, c, g, or t
  modified_base (240)..(240): a, c, t, g, unknown or other
  misc_feature (240)..(240): n is a, c, g, or t
tcagcgatcgtatacacgaccggtgctcgatttagatctactgacagggggtgggtccaggaggcagaactctgggtgtctcaccatcggcctggatccctctacttctccccctctcactctctgcacaggctctggacggcctctatgtgctgacacacgcccacccgttcggttcgtccgtcgtacccccgagggaccaggaccggccaggactccacctggccttcgngggaagtntcgactagtccgaaccctaaccctaacttcgttactttaaggttccggtaaccacgactaacggaaacgccgaacgggtccccgacggtccccgttggttgttttaggttacgaacttaacggttaaactaaaacggaccctaggtagtaacgggtaccggtacccgtttaggaaacggggtcttacccggaggtacgtaccgtacttccgttagccggttccctaccttacggacggaacgtactaacggttcgtcaaggtacttacgaccgtatacgaggtacgacgtacgacggacgaaggacgtacgacgtacgtcggtacttagtttccgattactacttacgtatacgactacgttagtacggttagttacttagttcgttaccgtacggtaacgtcgggtaaacgtcgggtacctaccggttccgtaacggtcgaacccggtacccgtaaccgaccccgtaaccgtcgttaccccaacggttcccttccggttaacccc

SEQ ID NO: 50245 - DNA, 722 bp, Homo sapiens
  misc_feature: GYAE6OF02JW9T1.51.6.A06.1.454.CMB.1.raw
  modified_base (129)..(129): a, c, t, g, unknown or other
  misc_feature (129)..(129): n is a, c, g, or t
  modified_base (134)..(134): a, c, t, g, unknown or other
  misc_feature (134)..(134): n is a, c, g, or t
  modified_base (149)..(149): a, c, t, g, unknown or other
  misc_feature (149)..(149): n is a, c, g, or t
  modified_base (158)..(158): a, c, t, g, unknown or other
  misc_feature (158)..(158): n is a, c, g, or t
  modified_base (280)..(280): a, c, t, g, unknown or other
  misc_feature (280)..(280): n is a, c, g, or t
  modified_base (405)..(405): a, c, t, g, unknown or other
  misc_feature (405)..(405): n is a, c, g, or t
  modified_base (495)..(495): a, c, t, g, unknown or other
  misc_feature (495)..(495): n is a, c, g, or t
  modified_base (593)..(593): a, c, t, g, unknown or other
  misc_feature (593)..(593): n is a, c, g, or t
tcagcgatcgtatacacgaccggtgctcgatttagatctactgacagggggtggtccaggaggcagaactctgggtgtctcaccatggcctggatccctctacttcctccccctctcactctctgcacngctcngacggcctctatgtnctagaaccncgactccccctacccgtggttccgttccgtaccgtcccccgaaggacacggtaccggccgaagtcttcccgacctcggtactcgtgggaatgtccgactattccgaccctaaccctaatttntttaccgtttagttaccggaccaatcgaaggaacgccgacggaccgacgtccccgttgtcgtttgttagatagtaaactaaacggtctaacgtaggaagtacgtccgttagaccggtactaccgngtccgtatccgttcgtccgcgacctccgtacgtacgaacggacgttacgcgttactagttctacgtagtaacgtacgtggtacggtaccnccggaacggacgtaaacggacgtacgtaacggtgacccgtttaagttcgtaactttcggaacttaaccgtttcgacgtaacgtactagtttaaccggnggttttaactacgttttgaccgtttaccgtaggtaaaccgttcgaacgtacgtaccgttcggtacggtacgtacccgtaaccgaccgtacccgtaccgacctccgttacgaccttcgtacccgttcccg

SEQ ID NO: 50246 - DNA, 674 bp, Homo sapiens
  misc_feature: GYAE6OF02JXKAH.51.6.A06.1.454.CMB.1.raw
  modified_base (268)..(268): a, c, t, g, unknown or other
  misc_feature (268)..(268): n is a, c, g, or t
  modified_base (644)..(644): a, c, t, g, unknown or other
  misc_feature (644)..(644): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacacgccaccctggtcgtccggtgtacccccaggacaggaccggccgaggtatccaccgtgcctctaggagattgactattcgcccaaccctacttatttcttatcggtaccncgacagacgccacggcctacgtcccctgtgttcgttgattataataagactactagagaggtaccttggacggactcccgtgacggtctacttcgtctacggccttaccacctacggtaacggacgtaacgtcggtacgtactacgttacgacctacgtacgaggttacggacgtccggaaggtacgaacggaacgacggacgtacgtacgacttaacgtttctacgttataaccttacgttaccgaagacctagtacgttaaccggttagttacgttaagtttaccgttccgttacggtaacgtcggaaccgtaacgtccgtaacccgtccggtaacgtacgtaacccggccgaaaccggttccccgaaacccgngttaccgtaccgtacccttaccgttacccg

SEQ ID NO: 50247 - DNA, 727 bp, Homo sapiens
  misc_feature: GYAE6OF02GVMCZ.51.6.A06.1.454.CMB.1.raw
  modified_base (215)..(215): a, c, t, g, unknown or other
  misc_feature (215)..(215): n is a, c, g, or t
  modified_base (254)..(254): a, c, t, g, unknown or other
  misc_feature (254)..(254): n is a, c, g, or t
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctcgtgganatgcattcgaccaaccactattcttatggtacagcaganccaggcaggccctgtgttgttgatataataaacgacactagagacggtccttacgagggtactccctgacgacgtattcgtacgtcggcctacctacctcgaagggactaaagttcggtacaactaagttcgaacctagttacgtaggttaggtaccgttaccgaacgggtacgaacggtaaaggaacggtaacgggtacctaacggtaacctttaagttttaccgttaaggttaacctaaacttttccttaacgtaacgtaacgttaacgttaaccgtaaagggtttacggtttaacctttaagtttccggtttaaccgtttaaccgggaaaccgtttacggggtaaacccgttaacgggttacctaaccccgggtttacccgttaaacgggttaccgaaccggtaaccccgaaaccggtacccccgaacccgttacgttaccggtacccgtaccgttcccgtttaccccgg

SEQ ID NO: 50248 - DNA, 819 bp, Homo sapiens
  misc_feature: GYAE6OF02FV7YW.51.6.A06.1.454.CMB.1.raw
  modified_base (304)..(304): a, c, t, g, unknown or other
  misc_feature (304)..(304): n is a, c, g, or t
tcagcgatcgtatacacgaccggtgctcgatttagatctactgacaggggggtgggtccaggaggcagaactctgggtgtctcaccatggcctggatccctctacttctccccctcctcactctctgcacaggctctgaggcctcctatgtgctgacacacgccaccctcggtgtccgtgtccccaggacagacggccaggactcacctgctctggagatgctattcacccaaccgacttattccttattcggtaccagctagaacgcacggccacggcccctgttgttgttgatatagtaaanacacgtgagacggccgttacgagggtaactcccgtagacggtcgtacttacgtcgtcggtacctccctacccgttaccggaacggggtaactaacggttcggtaccgtaacttagtttaccggaaccctacgttacggtaacgggttacggtaacggttaccgaacgggtacgaaacggtaaacgggtaaccgggaacggttaccgtaaccggttaacgtttaacgttttacgttacggtttaaccttaacgttacccgtttacgtaaacgttaacccgttaagttaacgttacgggtttaaccggttttaccgtttaagttttccgtttaaccgggtttaaccgggtaaccgttaaccggggtaacccgttaacggggttacccgtaacccgggtttaacccggttaacggggttaacccgtaaccgggtaaccccgtaaaccccgggtaacccccgttaaaccccgtacccggtttacctacccggttaccccttccggtttaacccccccgg

SEQ ID NO: 50249 - DNA, 801 bp, Homo sapiens
  misc_feature: GYAE6OF02JZHQ9.51.6.A06.1.454.CMB.1.raw
tcagcgatcgtatacacgaccggtgctcgatttagatctactgacagggggtgggtccaggaggcagaactctgggtgtctcaccatggcctggatccctctacttcctccccctctcactctctgcagagctctggaggccttcctatgtgctcaccacacgccctacccgtcggttcgtccggtacgccccgaagggacgaacggaccggtccgaaggtactaccgccgtcgtccttacggtaggacgtacttcggactacggttaccgacccctaaacccttaactttactttaccgtttagttaaccggtaaccacggaccgtaaacggaaccgaaccgtaccgggtacccgaccggtaccccgttggtttacggttaggttaacggtaacttaaacgtaaacgtaaaacgtaccgtaacggtacggtaacggttaccggtaccggtttacgggaaccggttaccgtacccgtaggaccggttagtacgtttcccgtacggtccggtaccctacccgacggtacggaacggttacggtaacgttcggtactaacgtaggttcccgtaaactagtaccggtaggtacggttaacggcgtaacgggaagtacgggaaagtacggtacgtacttaggttaactttcgttagtacgtacttccgttactactacgaatacttaggtcgttacgttatacgttacgacgttacggaacgttcggtaacctacggtacctacggtcccggtataccggactaccgaccctaccgtaactccgtactacctcgttacctacccg

SEQ ID NO: 50250 - DNA, 748 bp, Homo sapiens
  misc_feature: GYAE6OF02GLZI9.51.6.A06.1.454.CMB.1.raw
  modified_base (231)..(231): a, c, t, g, unknown or other
  misc_feature (231)..(231): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacacgccacccgttcgggtcgtccggtcgtacccccaaggacaggccggccaggtactccaccgtgctcgtgganatgctagttcgacccaaccgtacttacgtttacttagttcggtaccagacgaagaacgccgacggccgacggccccgtgttcgtttgttagataataagtaaacgactacgtaggacgtacggtccgttacggacggtaccgtcccgtaggacgtcgtactttccgtcgtcggacctacccgactaccggaacgggtaactagtacgtactaactacgttaccgaaacctacgtacgtaacggtacgggtaccgaccggtaacgggacgaaacggtaaacggacgggtaacgggtaccgtaacgttactttacgttttcggttaaccgttaccttaacttaccgttagtaaccgtactaacgttaacgtacggttaacggtttacttaacgtttccggttacgttaccggaaccgttacgggtaaccgtacggttacccgtaccggtaccggttacgaccggtaacgaaccccgaaccgaccctaccgttccgacgttacccacgttccttaccccg

SEQ ID NO: 50251 - DNA, 876 bp, Homo sapiens
  misc_feature: GYAE6OF02HDXH4.51.6.A06.1.454.CMB.1.raw
tcagcgatcgtatacacgaccggtgctcgatttagatctactgacagggcacgaccggtgctcgatttagatctactgacagggcacgaccggtgctacgatttagatacgtacctagacgaggggtcggtccaggagtcagtaactcgtcgggtagtcctcgacctagtcggtacctaggacctccctcgttaccgtttcccgtcccccccctagtacctctcgtagccgacgtacggtccttacgtcggaaccggtcccgttactacgttaggtcggaccgtacggacctaaccgaccgccccgtacccggttcgggtccgttcccgtacggtaccccgaaggtaaccgaccggacccggtaaccgttaacggaccttaccgttaccgtacgttaccgttccgggtaggaacgttacggtacgtacgttaccggttacccaaccccgttaaacccgtcgttttaagtttccgtttaacggttaccggtaacccgtaaggaccgtaacggaccttacccggtaaccggtacccgttaccgggtcccgttagggttttacgttacgtttaacgaagtttaaacttaaacgaacgtcgtaacggttacgacggttacccggtacgttacgggtaccgggtactccgtaaggtaccggtaccgttacgttccgtacggtaccgtacccgttaccggtaaaccggttacgaacgggttaacgaccgttacgtaaccgaccttaaggtacctaacgtcgtaacgtacggttacgttaccgacgttaccgagtaacggacgtaaccggtacgtcgttaacgttacttcggttaccttacggtacttacgttaccgtacgtaacgtacccgttagttaccgg

SEQ ID NO: 50252 - DNA, 757 bp, Homo sapiens
  misc_feature: GYAE6OF02GO5RG.51.6.A06.1.454.CMB.1.raw
  modified_base (122)..(122): a, c, t, g, unknown or other
  misc_feature (122)..(122): n is a, c, g, or t
  modified_base (268)..(268): a, c, t, g, unknown or other
  misc_feature (268)..(268): n is a, c, g, or t
  modified_base (745)..(745): a, c, t, g, unknown or other
  misc_feature (745)..(745): n is a, c, g, or t
tcagcgatcgtatacacgaccggtgctcgatttagatctactgacagggggtggggtccaggaggcagaactctgggtgtctcacatggcctggatcctctacttctcccctcctcactctntgcacaggctctgaggccctcctatgtgctgacacagccaccctcggtgtccgtgtcccccaggacagacggccaggatccactgctctggagtatgctagttcgcccaaacctacttattcttaattcgggtaccaagcagaacnccgacggccacggccccttgttggttgttcgattataagtaaagtacactagagtacggccttagaggggtactccctaggacgtacgtacttctctggcctccctaccgtacgagggaataacgttggtactacgacgtttacgacctaagtacgtaaggtcggtacgtcccgtaagggaccgaacggtaaacggacggtaacgggtccgttaaggtacctttaaccgttttacgttaccgttaaccgtaaacgtttaccctttacgtaaacgtaacgttaccgtaacgttaaccgggttaacggtttttaacgttaaacgttttccggtttacggtttaccggtaaacccgggtttacgggaacccggttaggtacccgtttaccggttacccggttaacgggttacccgtaccgaccccggtaaacccggtaccccgtaaacccccgtaccggttacggtacccttacccggtnttaaccccccgg

SEQ ID NO: 50253 - DNA, 802 bp, Homo sapiens
  misc_feature: GYAE6OF02GM3K3.51.6.A06.1.454.CMB.1.raw
  modified_base (129)..(129): a, c, t, g, unknown or other
  misc_feature (129)..(129): n is a, c, g, or t
  modified_base (208)..(208): a, c, t, g, unknown or other
  misc_feature (208)..(208): n is a, c, g, or t
tcagcgatcgtatacacgaccggtgctcgatttagatctactgacagggcgaccggtgctcgatttagatctactgacaggggtggagagcctagctgtgctgtggtccaggaggcagaactctgggtntctcaccatcggcctggactccctctacttcctccccctctcactctcgtgcacaggctcgtggacgcctctagtgtcncgtcgacacacgcccacccgtcggtcgtccgtacgtaccccgaaggaccacggaccggaccgaacggtactaccgtaccgtcggtaccgttcgtacggagtacgtgtaccttacgttaccgaacccctaaacccgttactttaacctttaccgtttaagttaccggtaaccgaacgaccgtaaagaaccgaccgtacggacccgtaaccggttcccttaggtttacggtttagttaacgtaaattaacgttaaaacgtaaacgtaccgttaacgagggtaaccgtaccggttacccgttacggaacgggtaccgttcccgtaggtaaccgtccgtttaacgttccgtccggtaccgtaccctacccgtaaccggtaacggacggtaaacgttacggtacggttaaccaacgttaccgtagtaaccctagttacggaacggtttacggaccgtaaccgggaagtaaccaaggtaaaccggaagtaccgggttaccgttacgtaaccgttttacgttacggtaacgttaacctaagtttaaccgttaacgacttacggttaacgtaccgtttaaggtttaccgttacgtttaacgg

SEQ ID NO: 50254 - DNA, 607 bp, Homo sapiens
  misc_feature: GYAE6OF02FNHI2.51.6.A06.1.454.CMB.1.raw
  modified_base (310)..(310): a, c, t, g, unknown or other
  misc_feature (310)..(310): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctggtgtccgtgtcccccaggacaggacggccaggatcacctgctctggagatgcattcgccaaacccacttattcttagttcggtaaccagcgagaagccaggccgacggcccctgtgttcgttgatatataaagacactgagnggccttcgaggactcctgacgctattctcgtcggtcctccgtacctcgaacgggtacaagttcgggtacacgacgtttgacctatcgagtggacgtaccgagggactaaggaacgacggaggctagacttattatacgttacaacgtctaaacgagtaactacctaagtttacggtactttagtcgttacgttacggtaaactcggtacgtaaccgtaaggtccctaccggtccgtagggtaccaaccgtacccgtaacggaccctaaccccggattacgacctacgttcctacccg

SEQ ID NO: 50255 - DNA, 680 bp, Homo sapiens
  misc_feature: GYAE6OF02GBSD9.51.6.A06.1.454.CMB.1.raw
  modified_base (320)..(320): a, c, t, g, unknown or other
  misc_feature (320)..(320): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacacgccacccgtggtgtccgtcgtccccaggacagacggccaggactcaccgtgccttcgtggagatgactattccgacccaaacctacttattaccgttagttcggtaaccagacaagaacgtaccgacggccgaccggtccccgttggttcgttaggttanaacttaataagtaaaacgactacgtaggaaggtacggtccgtttacggacgggtacctcccgtaggacgtcgtacttctccgtggaccctccacctacggacggactagtcggtactaacgttactacgactagtcgtaggtcggacgtacgacggacaagggaacggacgtacggtctacgtaacgtttagttagttactaacgtaactacgtaaactacgaacctacgttagtttacgttacttagtcgtttacgtacgacgttaccgcgtaaccggacgtaccgtaccggtcggtcggtaccaccgtacccggaaccgtacccaccctagtaccgtaccctacgttccgtcccccgg

SEQ ID NO: 50256 - DNA, 928 bp, Homo sapiens
  misc_feature: GYAE6OF02ID9LD.51.6.A06.1.454.CMB.1.raw
tcagcgatcgtatacacgaccggtgctcgatttagatctactgacagggggtgggtccaggaggcagaactctgggtgtctcaccatggcctggatccctctacttctccccctctcactctctgcacaggctctgacggcctcctatgtgctgacacacgcctaccctcggtgtccgtcgtccccaggacacgacggcccaggactccgacctgctcgtggacatcgctagttccggaccccaaacccctattacgtttacttacgttcggtaacccaggtaccgaaggtaacgacccggaacggcccaaccgggtcccccgttgggttgtttaggtttacgaatttaactaaacgttaaaacggacctaacggttggaaacggtccggtaccgtttacggaacgggttactcccgttaggaacgtacgtagttttcctcggttacgtaccctaccctaacccgttacggaacgggtaaccgtaagttccgggttaactaaccgttaacgttaccgggtaaccctaacggttccgtaacgggttacgggtaacccgttccggtaaacgggtaacgaaaggggtaaacccgtaacggggaacggttaccgtacgttaaccggtttaaaccttttcggtacccgtttaaacttaacgttaacgttttacccggaaacgttaccttaacgttaaccggttaaggtttaacgtttaaacctttacgttccgggtttaaaccggtttaccggtaaaaccggggttgggtaaaccccgttaggggttaacccccggttaccgggtttaacccggtaaccgggttaccccgttaaaccgggaacccccccgtaaacggggtaaccccccctaaaacccggttccggttaacccggtttaccccgtaacccgttttccccggtttaaccccccgg

SEQ ID NO: 50257 - DNA, 732 bp, Homo sapiens
  misc_feature: GYAE6OF02JKO2G.51.6.A06.1.454.CMB.1.raw
  modified_base (239)..(239): a, c, t, g, unknown or other
  misc_feature (239)..(239): n is a, c, g, or t
  modified_base (463)..(463): a, c, t, g, unknown or other
  misc_feature (463)..(463): n is a, c, g, or t
tcagcgatcgtatacacgaccggtgctcgatttagatctactgacagggggtgggtccaggaggcagaactctgggtgtctcaccatggcctggatccctctacttcctccccctctcactctctgcacaggctctggacggcccttcctagtgtgctgacacacgcccacccgtcggtcgtccgtcgtccccgaggacacggaccggccaggtactccaccgttcgctcgtggaagtntgcgtatccgacccaacccctattactttacgtttagttaccggaaccagtacaacgaccgaccgacggcccgaccggtccctggttagtttggttagtataattaacgaaaacgactacgtcggacggtacgtccgttacgagggttacctcccgtaggcgtaacgttcttccgtcgtcgcccttccgccgtacgaggtacctagtcgtactactctagaccngtacgaggtcgaacgtcgacgtgaaacgtaacggacggacggtactacgttaacttgttccttaagtctaacgttcctttaacgacgtaaccttacgttacgttacgggtattttacgtttacgtcggtttaaccgtcggttaaacggacgggtaacctaccgggtaccgtttacccgtaaccgggttcgacccgtaacccgggtacccgaaacccggtaccccgttaaccctcggttaacccggccttaccggttccgttaacccccg

SEQ ID NO: 50258 - DNA, 837 bp, Homo sapiens
  misc_feature: GYAE6OF02JAMY9.51.6.A06.1.454.CMB.1.raw
tcagcgatcgtatacacgaccggtgctcgatttagatctactgacagggggtgggtccaggaggcagaactctgggtgtctcaccatggcctggatccctctacttctcccccctctcactctctgcacaggctctggcgcctctatcgtgctgacacacgtcccacccgtcggtgtcccgtgtcccccgaggtaccaggaccggcctagggactccgaccttggccttacgtagggagagttcgcctaagttccgaaccccaaaccccgtactttactttcgtttacttaccggaaccgacgtaccaaggaaccggcccgaacgggccccgtaacggtcccccgtggttcgttaggttcgtaatagtaaactaacgacacgtggacggtacggtcccgtacgacgggtactccctaggtacgacgtacttcgtaccgttcggtaccctaccgaccgttacgaacgggactaacggttcggtacctaactaggtttaccgacgttaactccggagtacggacgtaccgaggtacgtaacggaacggtacgggacgtacgtaccgttaacgttccttttacgggcttaccgttaaacttccccttaaggaacccgtacttaacgttacggttaacggtttacgtttaaccgttacgtttaaccggtttcccggtaagggttttaaacccggcgggggtttaaaccgaccggggtttaaccccgttaccccggtaacggtttaacccgggtccgtaaaccccggttacccggaaccgttaaacccccgtaccccgtacggttacccggtacccgttacccgttccccgttaacccccgg

SEQ ID NO: 50259 - DNA, 712 bp, Homo sapiens
  misc_feature: GYAE6OF02GD55W.51.6.A06.1.454.CMB.1.raw
tcagcgatcgtatacacgaccggtgctcgatttagatctactgacagggggtgggtccaggaggcagaactctgggtgtctcaccatggcctggatccctctacttctcccctcctcactctctgcacaggctctgaggcctcctatgtgctgacacacgccacccgtcggtgtccgtcgtccccaggacagaccggccaggactcactgctcgtggagatgctattcgacccaaccacttacttcttagttcggtaaccaggcacgaacgcccgaggacccacggtcccccttggttcgttagtttaggaacttataacgtaaaacgacctacgtaggacggacggtacccgtttggaacggggtaccttcccgtggacgtcgtatttccgtcgtcggccctaccgaccgtcgaacgggtactaacgttcggtacactacgttacgtacctacgtaccagggttacggaacgttccgaaggacgaaggaaacggtacggaggtaccgtacgtaactttacgtttctacgttactactttacctacgtaacgtactaagtaccgtaacggttcggttaaccgtttagttacgttaccgttacgggtaacgtacgggtaccgtacggttcccgtaaccggttcgaaccggttcaaccggtacccgaaccggacccgtaccctacggtcctaccgttaccttccgttaccccgg

SEQ ID NO: 50260 - DNA, 565 bp, Homo sapiens
  misc_feature: GYAE6OF02GL2ED.51.6.A06.1.454.CMB.1.raw
  modified_base (288)..(288): a, c, t, g, unknown or other
  misc_feature (288)..(288): n is a, c, g, or t
  modified_base (295)..(295): a, c, t, g, unknown or other
  misc_feature (295)..(295): n is a, c, g, or t
  modified_base (395)..(395): a, c, t, g, unknown or other
  misc_feature (395)..(395): n is a, c, g, or t
  modified_base (451)..(451): a, c, t, g, unknown or other
  misc_feature (451)..(451): n is a, c, g, or t
  modified_base (549)..(549): a, c, t, g, unknown or other
  misc_feature (549)..(549): n is a, c, g, or t
tcagcgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgctattcgacccaaccctactattacttattggtaccagcagaagccgaggccacggcccctgtgttggtnatgtaanaaagacactggagacggccctgacgggactccccgtgaggtcgtattcctcgtcggcctaccagggtcgaaggggaccaacggtcaactacgttgcctancagtggactccgagcaggacggagagcgtagacttattatgtacaactacaacganaccactattagtactttatcgttcgttacgaacgtcggaccaaccgaagttccgaccgtcggtgaccacgacccaacggacccaacccgcttacgacnccttctcccgttcccc

SEQ ID NO: 50261 - DNA, 542 bp, Homo sapiens
  misc_feature: GYAE6OF01C9M3L.52.36.D03.1.454.CMB.1.raw
  modified_base (226)..(226): a, c, t, g, unknown or other
  misc_feature (226)..(226): n is a, c, g, or t
tcagcgcagtacgacacgaccggtgctcgatttagctgcgtcacgatctctcttgggggctgtgggctcaggaggcagagctgtgggtgtctcaccatggcgtgggccacactcctgctcccactcctcaacctatacgcaggctctgttgcctcctatgagctgacacagcttccctcggtgtcagtgtccccaggacagacagccaggatcacctgctctgganatgtactaggggaaaaattatgctgactggtaccagcagaagccaggccaagccctgacgtggtgatatacgaaaatagtgagcgctacccgtggactccccgtgaccgattctcgtgggtccaccgtcagggaacgacgaccacctgaccatcaacagggtaccgatgaagacgaggctgactatactgtacgttgtcgtgggatgaaggacactgttggtgttcgggcggaagggaccaagccgtcggaccgttcccgtacggtccaacgtccccaaagggtccctacggccccccgtcggtccacgttccccg

SEQ ID NO: 50262 - DNA, 668 bp, Homo sapiens
  misc_feature: GYAE6OF01A1S7G.52.36.D03.1.454.CMB.1.raw
  modified_base (226)..(226): a, c, t, g, unknown or other
  misc_feature (226)..(226): n is a, c, g, or t
  modified_base (259)..(259): a, c, t, g, unknown or other
  misc_feature (259)..(259): n is a, c, g, or t
tcagcgcagtacgacacgaccggtgctcgatttagctgcgtcacgatctctcttgggggctgtgggctcaggaggcagagctgtgggtgtctcaccatggcgtgggccacactcctgctcccactcctcaacctctacgcaggctctgttgcctctatgagctgacacagcttccctcggtgtcagtcgtccccaggacagacagccaggatcacctgctctgganatgtactaggggaaaaattatgctgactgtacngcagaagcaggccaagccctgagttggtgatataacgaaaatagtagagcgtacgtacccgtggactccgtagaccgtaattctcgttcgggtccaccgtcgaagggtaacgaccgaaccaccctacgacctaactaccgaaccgacggggtccggaacgtaggaaacggaacggacggtcgtacggaaccttaagtttacctaggtactttcgggtaccggttggggtaagttacgggaacggtacctaacgtaggtttggggttacgggtttcgggaccggggtaacggggaacccgtaaaggtccgttacgggtaacccgttcccggttaaccggtccggaaccggtaccccgaaacgggtcccgtacccggtacccccccgttcgggtccctaaccgttccccgg

SEQ ID NO: 50263 - DNA, 799 bp, Homo sapiens
  misc_feature: GYAE6OF01CU6X8.52.36.D03.1.454.CMB.1.raw
  modified_base (236)..(236): a, c, t, g, unknown or other
  misc_feature (236)..(236): n is a, c, g, or t
tcagcgcagtacgacacgaccggtgctcgatttagctgcgtcacgatctctcttgggggctgtgggctcaggaggcagagctgtgggtgtctcaccatggcgtgggccacactcctgcctccactcctcaacctctacgcaggctctgttcgcctcctatgagctgacacagtccttcccgtcggtgtcagtcgtccccgaggacagacagccgaggactcacctgctcgtggaanataggtaacggtaagggtaaaaattgtgacgtagtacgttaggtaaccagacgaaggaacgccgaacggacccgaacggtccccgttaggtaggttacggtagtaacgttaaagtaaacgtaaaaagtcggtagaacggtaccggtacccttaaccggtacgggtaccctcccggtacgtaacccgttctttaccggtaccggtccgggtaccctaaccgtaccggaaagggaaaccgaacccgtaaaccccgtacccgttacgaacccgtaacgtaaccgaaaccgggtaccggggttaacccgaacgtaacggaaacgggaaccgacggtccttagtaaccgttacttaacgttcggtcgtttggtaaccgggtgggtaacgtaggaaccggttaacgtacggttacggtttgggttaccgggttacggggaacggggtaacccgggaaaccgtacgggtacccgttaaccgggtacccgttaccggtaacccgtacggacccggtacccggtaaccggtcccgtacccggtcccccgtagtccccgtaaccgtttccccg

SEQ ID NO: 50264 - DNA, 601 bp, Homo sapiens
  misc_feature: GYAE6OF01A715P.52.36.D03.1.454.CMB.1.raw
  modified_base (298)..(298): a, c, t, g, unknown or other
  misc_feature (298)..(298): n is a, c, g, or t
  modified_base (309)..(309): a, c, t, g, unknown or other
  misc_feature (309)..(309): n is a, c, g, or t
tcagcgcagtacgacacgaccggtgctcgatttagctgcgtcacgatctctcttgggggctgtgggctcaggaggcagagctgtgggtgtctcaccatggcgtgggccacactcctgctcccactcctcaacctctacgcaggctctgttgcctcctatgagctgacacagcttccctcggtgtcagtcgtccccaggacagacagccaggatcacctgctctggagatgtacgtaggggaaaaattatgctgactggtaccagcagaagccaggccaacgccctgagttggtgatanaacgaaatagngagcgctacccgtgggactccgtagaccgtattctccgtgggtaccaccgtacgaacgggtaacgaccgacccaccctacgaacccataccgaacgacggggtaccgacgtacggaacgacggaggctacgtacttacttacgtgtcgtttagtccggtggggtataggacggtactacgtagttgggtcggttacgggacgggacgggaacgaacgtccgtacggtacccgttcgtaccgcgaccggacccgaacggtccgtccggacccccgttcggtcctcgttccccg

SEQ ID NO: 50265 - DNA, 526 bp, Homo sapiens
  misc_feature: GYAE6OF02GABJ3.52.36.D03.1.454.CMB.1.raw
  modified_base (435)..(435): a, c, t, g, unknown or other
  misc_feature (435)..(435): n is a, c, g, or t
  modified_base (448)..(448): a, c, t, g, unknown or other
  misc_feature (448)..(448): n is a, c, g, or t
tcagcgcagtacgacacgaccggtgctcgatttagctgcgtcacgatctctcttgggggctgtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaaattatgctgactggtaccagcagaagccaggccaagcccctgagttggtgatatacgaaaatagtgagcgctaccctgggatccctgaccgattctctgggtccactcagggaacgacgaccaccctgaccatcaacagggtccgatgaagacgaggctgaactattactgcttgtcgtggggatggaggacanagttggtgtcggnggaggggtaccaggtctaggacccgttacctacggtcacggacccgaagggcctccggcccccgtggtccacttcccg

SEQ ID NO: 50266 - DNA, 707 bp, Homo sapiens
  misc_feature: GYAE6OF02H6GGT.52.36.D03.1.454.CMB.1.raw
tcagcgcagtacgacacgaccggtgctcgatttagctgcgtcacgatctctcttgggggctgtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactaggggaaaaattatgctgactggtaccagcagagccagccaacgccctgagtggtgatatacgaaaatagtgagcgctaccgtgggactcccgtgaccgattctacgtcgggtcccaccgtacgaggggaacgaccgacccgacccgttagacccaatacccgaaacgacggggtaccccggaacgttacggaaaggaaccggagggtacccgttaggaacctttaaacgtttaaccgttaggtccgttttaggttaccggttagggggggtaactttagggaacgggtaaccgtaacgttaagggtttttggggttaacgggttttccgggggaaccgggtaacggggtaacccgtaacggtcccgttaacgggacccccggtttaccgttaacccggttacccgaacggtacccccgaaagggtccccgtaccggtacccccccgttcggggttacccaccgtttcccccgg

SEQ ID NO: 50267 - DNA, 649 bp, Homo sapiens
  misc_feature: GYAE6OF02HZ8WQ.52.36.D03.1.454.CMB.1.raw
  modified_base (227)..(227): a, c, t, g, unknown or other
  misc_feature (227)..(227): n is a, c, g, or t
  modified_base (248)..(248): a, c, t, g, unknown or other
  misc_feature (248)..(248): n is a, c, g, or t
tcagcgcagtacgacacgaccggtgctcgatttagctgcgtcacgatctctcttgggggctgtgggctcaggaggcagagctgtgggtgtctcaccatggcgtgggccacactcctgctcccactcctcaacctctacgcaggctctgttgcctcctatgagctgacacagcttccctcggtgtcagtcgtccccaggacagacagccaggatcacctgctctgganctgtacgtagggaaaaattgngctgactggtaccagacagaacgccgaggcccaacgccctagagttggagatagtaacgtaaatagtagagcaccgtaccgtggactcccgtgaccgtattccgtcgtcggtaccctaccgtcgaagggaacgaccgaacctacccgacgaaccactaccaacggacggggtaccgactaacgggaacgacggacggtactaggaacctttattacgtcgtcttaggtcggtaggggtactaggaacggacctaacgttacggtttagggtcggttcgggaacgggttaacgggaaccgacgtaccggtacggaaccccggttaccgttaccggaccgtaccgacccggtaacggtcccgttacccggaccccccggttggtacccgttaccgttccccgg

SEQ ID NO: 50268 - DNA, 600 bp, Homo sapiens
  misc_feature: GYAE6OF02FIG9Y.52.36.D03.1.454.CMB.1.raw
  modified_base (294)..(294): a, c, t, g, unknown or other
  misc_feature (294)..(294): n is a, c, g, or t
tcagcgcagtacgacacgaccggtgctcgatttagctgcgtcacgatctctcttgggggctgtgggctcaggaggcagagctgtgggtgtctcaccatggcgtgggccacactcctgctcccactcctcaacctctacgcaggctctgttgcctcctatgagctgacacagcttccctcggtgtcagtcgtccccaggacagacagccaggatcacctgctcgtggagatgtacgtaggggaaaattatgctgactggtaccagcagacgccaggccaacgcccctgagttggngatataacgaaaatagtgagcgactaccgtgggactcccgtgaccgtattctcgtcggtccaccgtacgaagggtaacgaccgacccaccctcgaacctataccaacgacgggtaccggacgtacggaacgaccgacggctacgtacttaacttacgtcgtcttggtcgtaggggtataggacggacacgtagtttggtcgtttacgggacggacgggtaaccgacgacgtacgtacccggtaccgtaccggtcaccggacccgaacggcccgtacccggtcccccgtacggtaccaccgttcccg

SEQ ID NO: 50269 - DNA, 682 bp, Homo sapiens
  misc_feature: GYAE6OF02G8P2I.52.36.D03.1.454.CMB.1.raw
  modified_base (251)..(251): a, c, t, g, unknown or other
  misc_feature (251)..(251): n is a, c, g, or t
  modified_base (517)..(517): a, c, t, g, unknown or other
  misc_feature (517)..(517): n is a, c, g, or t
  modified_base (543)..(543): a, c, t, g, unknown or other
  misc_feature (543)..(543): n is a, c, g, or t
tcagcgcagtacgacacgaccggtgctcgatttagctgcgtcacgatctctcttgggggctgtgggctcaggaggcagagctgtgggtgtctcaccatggcgtgggccacactcctgctcccactcctcaacctctacgcaggctctgttgcctcctatgagctgacacagccttccctcggtgtcagtcgtccccaggacagacagccaggatccacctgctctggagatgtacgtaggggtaaaaattntagctgacgtggtaaccagcaagacgaccgaggacccaacgccccctaggtacggttggtagaagttaagtaacgtaaaaagtaggtacgaggtaccgtacccttaacccgtggggtaacttccccgtacggaccgtattaccgttcgtacgggtaccctaccgtcgaacgggaacgacccggacccaacccgtacgacctaacgtaccgaaacgcgggtacccggacgtaaggaacgacggacggactacgtaacttacttacgngttccgttaggttacggtaggggtanagggacggtaaccgagttaggtttgggttacggttccgggaacgggacggtaccgaggtccgtacggtacccggttaccacggtcccgacgacccggaagtccggtacccgtcccccggtacggtccaccgtttccccg

SEQ ID NO: 50270 - DNA, 536 bp, Homo sapiens
  misc_feature: GYAE6OF02FV0T7.52.36.D03.1.454.CMB.1.raw
  modified_base (290)..(290): a, c, t, g, unknown or other
  misc_feature (290)..(290): n is a, c, g, or t
  modified_base (426)..(426): a, c, t, g, unknown or other
  misc_feature (426)..(426): n is a, c, g, or t
tcagcgcagtacgacacgaccggtgctcgatttagctgcgtcacgatctctcttgggggctgtgggctcaggaggcagagctgtgggtgtctcaccatggcgtgggccacactcctgctcccactcctcaacctctacgcaggctctgttgcctcctatgagctgacacagcttccctcggtgtcagtgtcccccaggacagacagccaggatcacctgctctggagatgtactggggaaaaattatgctgactggtaccagcagagccaggccaagcccctgagttggngatatacgaaatagtgagcgctacctgggactcccgtgaccgattctcgtggtccacctcgagggaacgaccgaccaccctagaccataccaacgacgggtacccggactaggaacgacgaggctagactattacngacttgtctggggatggaggcatagtttggtgttcgggcggagggaccagcgtcggaccgtcctacgtccgacgcccgaagccgtccgccccctcggtaccacgttcccg

SEQ ID NO: 50271 - DNA, 235 bp, Homo sapiens
  misc_feature: GYAE6OF01BZX5U.39.48.E04.1.454.CMB.1.raw
  modified_base (232)..(235): a, c, t, g, unknown or other
  misc_feature (232)..(235): n is a, c, g, or t
tcagtcgcactagtcacgaccggtgctcgatttagagagcgtcacagagagaagggtgccaggggaagaccgatgaaccctggtcaccgtctcctcagcctccaccaagggcccatcggtcttcccctggcaccctcctccaagagcacctctgggggcacagcggccctgggctgcctggtcaaggactacttccactagtgcgactgagcgggctggcaaggcgcatagnnnn

SEQ ID NO: 50272 - DNA, 233 bp, Homo sapiens
  misc_feature: GYAE6OF01CY7C8.39.48.E04.1.454.CMB.1.raw
  modified_base (231)..(233): a, c, t, g, unknown or other
  misc_feature (231)..(233): n is a, c, g, or t
tcagtcgcactagtcacgaccggtgctcgatttagagagcgtcacagagagaagggtgccaggggaagaccgatgaaccctggtcaccgtctcctcagcctccaccaagggcccatcggtcttcccctggcaccctcctccaagagcacctctggggcacagcggccctgggctgcctggtcaaggactacttccactagtgcgactgagcgggctggcaaggcgcatagnnn

SEQ ID NO: 50273 - DNA, 237 bp, Homo sapiens
  misc_feature: GYAE6OF01DXUT3.39.48.E04.1.454.CMB.1.raw
  modified_base (233)..(237): a, c, t, g, unknown or other
  misc_feature (233)..(237): n is a, c, g, or t
tcagtcgcactagtcacgaccggtgctcgatttagagagcgtcacagagagaagggtgccagggggaagaccgatgaaccctggtcaccgtctcctcagcctccaccaagggcccatcggtcttcccctggcaccctcctccaagagcacctctgggggcacagcggccctgggctgcctggtcaaggactacttccactagtgcgactgagcgggctggcaaggcgcatagnnnnn

SEQ ID NO: 50274 - DNA, 233 bp, Homo sapiens
  misc_feature: GYAE6OF01ES35T.39.48.E04.1.454.CMB.1.raw
  modified_base (232)..(233): a, c, t, g, unknown or other
  misc_feature (232)..(233): n is a, c, g, or t
tcagtcgcactagtcacgaccggtgctcgatttagagagcgtcacagagagaagggtgccaggggaagaccgatgaaccctggtcaccgtctcctcagcctccaccaagggcccatcggtcttcccctggcaccctcctccaagagcacctctgggggcacagcggccctgggctgcctggtcaaggactacttccactagtgcgactgagcgggctggcaaggcgcatagnn

SEQ ID NO: 50275 - DNA, 861 bp, Homo sapiens
  misc_feature: GYAE6OF01EFHUJ.18.12.B01.1.454.CMB.1.raw
tcagtacgagtatgcacgaccggtgctcgatttagtagtgtagattcggacggggggggcacaaaggaacgatgagacacctggtggttcttcctcctcctgggtggcgacgtctccctagtactcgggtcccttcgtctctcgtggcagttggcgtggacgtacgggcccaggacctgggtgaacgccgttccggggaccctcgtccgtctcaccgtggccgcgtgtctttaactcgaacctccactcgaagtacgtacgtcgaacgtgggtgggacttcggggtccgacctaacggttccccggtaagggtaaaaggggtctagggaagttgggtacgttacgggggtaaacttcctacgtccgtaacgggtccgggggaccaaaccgaaaccgtaaccccaaaacgttcccggtacccttacggtaaaacggtttccggtaacctacctaacctactaaccttccctaacgaacctaaaccttaccgtaaaacggtaacctaacttttccgtcccttacgacctaagttcgtaacttccgttcttacggtacggaaccccggcccggaccggtaacccgtaaccgggtaccttaattttacgtttaacgttcggtcggtacgaacgtacgtaacgtaccgttacgttacggacttacggtaacttaagttttacttaagtttacgtacgggtacgttacggggttaacctacggtaacggtcgtacggtaccgtcgtcgggaccggtaaccggggtcccgtacgtacccggtcgtaccgtaccgacggtccctacccgaaccgtaacggggcccctaacggttcccggtacccgttccccggtcggtcccggtccccg

SEQ ID NO: 50276 - DNA, 789 bp, Homo sapiens
  misc_feature: GYAE6OF01EF5QB.18.12.B01.1.454.CMB.1.raw
  modified_base (202)..(202): a, c, t, g, unknown or other
  misc_feature (202)..(202): n is a, c, g, or t
tcagtacgagtatgcacgaccggtgctcgatttagtagtgtagattcggcggggggcacaagaacatgagacacctgtggttcttcctcctcctggtggcagctcccagatgggtcctgtctctcgtgcagttgcgtgagtcgggccaggactggtagaagccgttcggggaccctgtcgctcacctgcgctgttctttaangtacctccatcagtagtagtcacgtggtgtacgttgggtcccgaccacgtccccgaagggaaacgggctgggagtggtagttaggggaaattcgtctaccgtaggtacggggacccaaccgaactacaacgttcccgtacccgtaacgaaacgttccgacctaccaaccaatacctaccctaacgaacctaaacctaccaaaacgtaacctactttcctacccctagtacctaattgaacttctacgtcggtacgacccggccggacggaaccgaccggtaccttaagttttactttaagtttggacgaccggtaactacgtaacttctaccgtttacggattacggtaacttacgtttactttaattacggtacggttacggtacgggttaacctaacgggttaccgtacgtacgggtacgttaccgggtacgggtacccgggtaaaccgggtaccccgtaccggttacccgtcccttacccgtaccgtacccgtacccccgtacccggaaacccggtacccgggtaccccgttacggttccccggttacccccgttcccccggtccggtaccccggttcccccgg

SEQ ID NO: 50277 - DNA, 701 bp, Homo sapiens
  misc_feature: GYAE6OF01CBBWE.18.12.B01.1.454.CMB.1.raw
  modified_base (227)..(227): a, c, t, g, unknown or other
  misc_feature (227)..(227): n is a, c, g, or t
  modified_base (242)..(242): a, c, t, g, unknown or other
  misc_feature (242)..(242): n is a, c, g, or t
  modified_base (385)..(385): a, c, t, g, unknown or other
  misc_feature (385)..(385): n is a, c, g, or t
  modified_base (399)..(399): a, c, t, g, unknown or other
  misc_feature (399)..(399): n is a, c, g, or t
tcagtacgagtatgcacgaccggtgctcgatttagtagtgtagattcggcgggggcacaagaacatgagacacctgtggttcttcctcctcctggtggcagctcccagatgggtcctgtctctcgtgcagttgcgtgagtccgggcccaggactggtagaagccgttcggggacctgtcgctcacctgcgctgtcttaatcgactcatcgagtagtagtcacgtggngtacgttcgggtccnccacggtacccgaagggaagggctagggagtggagtagggaatctcgtcgtaggtcgggaccaacaactacaactcccgtacctagaacgtcgactacacctatactaccctaagaaccaactacaaacgaacctactttccncctagactaagttnactctcgtcgtacgaccgccggtacggaccaccgtacttaagtttattaacgttggacggacaaggtactacgttaccttacgttacgacgttagtaacgttgttttacttaagtacgtagggtaaccgttacggggttaacctaccggttacggtcgtacgggtacgtacgggtaccgggaccgtaaccggggtacccctagtaccccgtcgtacccgtacgacccgtacccgttacccgaaaccggaccggtcccgtaacgttcccggttaccccttccccggtcggccccgttccccgg

SEQ ID NO: 50278 - DNA, 884 bp, Homo sapiens
  misc_feature: GYAE6OF01A3WFC.18.12.B01.1.454.CMB.1.raw
tcagtacgagtatgcacgaccggtgctcgatttagtagtgtagattcggcgggggcacaaagaacatgagacacctgtggttcttcctcctcctggtggcagctcccagatgggtcctgtctctcgtgcagttgcgtggagtcgggccaggactggtgaacgtccgttcggggaccctgtcgctccacctgcgtctgtttacttaagtcgacctacctatacgtagttagtacgtactacggttgggtacggtacgttccgggtcccgaccgtaccggtaccccggaaagggggaaacggggtcgtaggggtaggtagggtaacgggttaggggtaaacttccgtaccgttacggttacgggtaccggggaaccctaaacctaaccgttaaccgtaaccgttccccggttaacccgtaacggtaaacgtccgaacctccaacctacttaccctaccgtaacgaacctaacctaaccgaaacgtaaccttacgtttaccctacccgtagtaacttaacgttcgtactttccttcgtacggaaccgtaccccggccggaccggtaacgaccgttactttaactttagttacgttcggacgtacggtactacttaacgtcgtttaacgtacgtaacttacgtactttagtttacgtttagtacggttacgggttaaccggttacgggtttaacccttaccggttacgggtccggttacggggtaccgttaccggggtaccgggtaacccgggaaccgggtcccccgttcgtaccccgttaccgtacccgaccggtacccgttaccccacccgggtaacccggtaacccgggtccctacccggtttcccccggttcccccgtcccggtacccggtcccggttaccccg

SEQ ID NO: 50279 - DNA, 783 bp, Homo sapiens
  misc_feature: GYAE6OF02IX0FH.18.12.B01.1.454.CMB.1.raw
  modified_base (49)..(49): a, c, t, g, unknown or other
  misc_feature (49)..(49): n is a, c, g, or t
tcagtacgagtatgccacgaccggtgctcgatttagtagtgtagattcncgggggcacgaagaaccatgagacaacctggtgggttctttcctccttccgtggtggcagctcccagatgggtcctggtctctcgtgcgagtttggcgtgaagtcggggttcccaggtactggttgttaaggccgtttcgggggtacccctggtcgctacacctgacgcgtggtctttaattgggacgtccgagttccagtacgttaggtcgactcggtggacttcgggtccgtcctaggttcccccgaggaaaggggcctggaggttcggactttggggaaattcgtcttcccgtagtacggggcccaccaacgtacgaactcccgtaccctccgaaaggtcgaacgtctaccgagtagtccgtagacctaacgttccaagtaccagttcgtcctagctaattagtagttctctgtgtaccgccgtcggaacgacccgggtactactttaacttaatttcgttcgacggagtaccacttcctacgtttaccgaattacgtaacttagttttccttaactttagtacgggtacttacggggttaaccttacgttacgggtcgttacgggtacgggttcgttacggggacccttaaaacgggggccccgttaccggacccgggttacggtaccccgtcgtacgggtacccgttacccgaacccgttaaacggggtcccccttaagttcccggggttacccgtttccccccgggttacggacccgggttcccccgg

SEQ ID NO: 50280 - DNA, 575 bp, Homo sapiens
  misc_feature: GYAE6OF02H6J0F.51.39.D06.1.454.CMB.1.raw
  modified_base (223)..(223): a, c, t, g, unknown or other
  misc_feature (223)..(223): n is a, c, g, or t
  modified_base (436)..(436): a, c, t, g, unknown or other
  misc_feature (436)..(436): n is a, c, g, or t
  modified_base (440)..(440): a, c, t, g, unknown or other
  misc_feature (440)..(440): n is a, c, g, or t
tcagcgatcgtatacacgaccggtgctcgatttagtgacatctcgcagttctttgggggtgggtccaggaggcagaactctgggtgtctcaccatggcctggatccctctacttctccccctcctcactctctgcacaggctctgaggccctcctattgtgctgacaacagcccaccctcggtgtccgtgtccccaggaccaggacggccagggatcacctgntcgtggagatgcattgacccaacctactattcttattgtacaacagaagcagcctagccctgtgtgttgatataataaagacagtagagaggccttcgagggatcccaggtagacgtatactctcggctccacctacagggacactggtcacattgacccgatacgagtgaacgtccaggacagaaagacgaggctagaactattattcgtanaatnaaaccagaaccacaattacggtaattaacgtgtcttaaccgggaactacgaccgtaaccgtaaggtcccaccggtaaccgtcgggtacccacggtacccaaccggaccctaacccctacctacggtcttaacccg

SEQ ID NO: 50281 - DNA, 329 bp, Homo sapiens
  misc_feature: GYAE6OF02GWYKU.51.39.D06.1.454.CMB.1.raw
  modified_base (322)..(329): a, c, t, g, unknown or other
  misc_feature (322)..(329): n is a, c, g, or t
tcagcgatcgtatacacgaccggtgctcgatttagtgacatctcgcagttctttgggacttccactgctcaggggtcaggctgcggtagctgctagctgcgtacttgttgttgctttgtttggaaggtgtggtggtctccactccagccttgacggggctcgagtctgctttccaagccactgtcacggctccggggtagaagtcactgatgagacacaccagtgtggccttgttggcttgaagctcctcaggaggagggtagggaacagagtgaacgctgccctttcctgtagcactctgagcggctggcaggcgcatagnnnnnnnn

SEQ ID NO: 50282 - DNA, 258 bp, Homo sapiens
  misc_feature: GYAE6OF01BGLW1.37.83.H06.1.454.CMB.1.raw
  modified_base (255)..(258): a, c, t, g, unknown or other
  misc_feature (255)..(258): n is a, c, g, or t
tcagtagtgtagatcacgaccggtgctcgatttagatcacgtgcgtcggcgggtctgggacagatttcactctcaccatcagcagcctgcggctgaagatgtggcggtttattactgtcagcagtattatgttactcctcacagttttggccaggggaccaagctggagatcgcacgaactgtggctgcaccatctgtcttcatcttcccgccatctgaatctacactactgagcgggctggcaaggcgcatagnnnn

SEQ ID NO: 50283 - DNA, 253 bp, Homo sapiens
  misc_feature: GYAE6OF01BFUP3.37.83.H06.1.454.CMB.1.raw
  modified_base (251)..(253): a, c, t, g, unknown or other
  misc_feature (251)..(253): n is a, c, g, or t
tcagtagtgtagatcacgaccggtgctcgatttagatcacgtgcgcgcgggtctgggacagatttcactctcaccatcagcagcctgcggctgaagatgtggcggtttattactgtcagcagtattatgttactcctcacagttttggccaggggaccaagctggagatcgcacgaactgtggctgcaccatctgtcttcatcttccgcatctgaatctacactactgagcgggctggcaaggcgcatagnnn

SEQ ID NO: 50284 - DNA, 268 bp, Homo sapiens
  misc_feature: GYAE6OF01DGL5D.37.83.H06.1.454.CMB.1.raw
  modified_base (254)..(255): a, c, t, g, unknown or other
  misc_feature (254)..(255): n is a, c, g, or t
  modified_base (257)..(268): a, c, t, g, unknown or other
  misc_feature (257)..(268): n is a, c, g, or t
tcagtagtgtagatcacgaccggtgctcgatttagatcacgtgcgtcggcgggtctgggacagatttcactctcaccatcagcagcctgcggctgaagatgtggcggtttattactgtcagcagtattatgttactcctcacagttttggccaggggaccaagctggagatcgcacgaactgtggctgcaccatctgtcttcatcttccgcatctagaatctacactactgagcgggctggcaaggcgcatagnncnnnnnnnnnnnn

SEQ ID NO: 50285 - DNA, 255 bp, Homo sapiens
  misc_feature: GYAE6OF01B45CD.37.83.H06.1.454.CMB.1.raw
  modified_base (253)..(255): a, c, t, g, unknown or other
  misc_feature (253)..(255): n is a, c, g, or t
tcagtagtgtagatcacgaccggtgctcgatttagatcacgtgcgcgcgggtctgggacagatttcactctcaccatcagcagcctgcggctgaagatgtggcggtttattactgtcagcagtattatgttactcctcacagttttggccaggggaccaagctggagatcgcacgaactgtggctgcaccatctgtcttcatcttcccgccatctgaatctacactactgagcgggctggcaaggcgcatagnnn

SEQ ID NO: 50286 - DNA, 259 bp, Homo sapiens
  misc_feature: GYAE6OF01D3EHE.37.83.H06.1.454.CMB.1.raw
  modified_base (253)..(259): a, c, t, g, unknown or other
  misc_feature (253)..(259): n is a, c, g, or t
tcagtagtgtagatcacgaccggtgctcgatttagatcacgtgcgcgcgggtctgggacagatttcactctcaccatcagcagcctgcggctgaagatgtggcggtttattactgtcagcagtattataatactcctccgacgttcggccaagggaccaaggtggaaatcaaacgaactgtggctgcaccatctgtcttcatcttcccgccatctgaatctacactactgagcgggctggcaaggcgcatagnnnnnnn

SEQ ID NO: 50287 - DNA, 524 bp, Homo sapiens
  misc_feature: GYAE6OF01EQTK6.37.83.H06.1.454.CMB.1.raw
  modified_base (172)..(172): a, c, t, g, unknown or other
  misc_feature (172)..(172): n is a, c, g, or t
  modified_base (380)..(380): a, c, t, g, unknown or other
  misc_feature (380)..(380): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtgtgtttctaggtggctatttaaaggngtcagtgtgaggtgcagctgctggagtctgggggaggcttggtacagccggggggtccctgagactctcctgtgaagcctctggattcacctttgacaagtgtgccatgacctgggtccgccaggctccagggaaggggctggagtgggtctcagttatagtggtagtggtatagcacagattacgcagactccgtgaaggccggttnaccatctccagagacaattccaacagcacgctgtatttgcacatgacagcctgagagccgagacgacggcatatattattgtgcgtaacttacctttgtactggttattattacccttacgtagacacgtgggtccgaaccggg

SEQ ID NO: 50288 - DNA, 256 bp, Homo sapiens
  misc_feature: GYAE6OF01B7J0L.37.83.H06.1.454.CMB.1.raw
  modified_base (253)..(256): a, c, t, g, unknown or other
  misc_feature (253)..(256): n is a, c, g, or t
tcagtagtgtagatcacgaccggtgctcgatttagatcacgtgcgcgcgggtctgggacagatttcactctcaccatcagcagcctgcggctgaagatgtggcggtttattactgtcagcagtattatgttactcctcacagttttggccaggggaccaagctggagatcgcacgaactgtggctgcaccatctgtcttcatcttccgccatctgaatctacactactgagcgggctggcaaggcgcaatagnnnn

SEQ ID NO: 50289 - DNA, 544 bp, Homo sapiens
  misc_feature: GYAE6OF01CII5T.37.83.H06.1.454.CMB.1.raw
  modified_base (238)..(238): a, c, t, g, unknown or other
  misc_feature (238)..(238): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggagtgtttanacaactcaagaataagagttcttagcttggtaccagcaagaaaccacgacagcctcctaagctgcctcgtttactgggccctcgtacccgggaatcccggggtcctgaacgattcaggtggcggcgggtctgggacagtactttcactctcaccatcagcacgccgtcggcggcgtagaagagtggtggtcggtttagttacttgtcagactagttaattattcgttaccttcctctactagtttacggtccgagggacccccgaagcgtaggagtagtcgcacgacgtgtcggctagcacgctcg

SEQ ID NO: 50290 - DNA, 253 bp, Homo sapiens
  misc_feature: GYAE6OF01B0GF5.37.83.H06.1.454.CMB.1.raw
  modified_base (250)..(253): a, c, t, g, unknown or other
  misc_feature (250)..(253): n is a, c, g, or t
tcagtagtgtagatcacgaccggtgctcgatttagatcacgtgcgcgcgggtctgggacagatttcactctcaccatcagcagcctgcggctgaagatgtggcggtttattactgtcagcagtattatgttactcctcacagttttggccagggaccaagctggagatcgcacgaactgtggctgcaccatctgtcttcatcttccgccatctgaatctacactactgagcggctggcaaggcgcatagnnnn

SEQ ID NO: 50291 - DNA, 255 bp, Homo sapiens; identical to SEQ ID NO: 50285
  misc_feature: GYAE6OF01ERLPT.37.83.H06.1.454.CMB.1.raw
  modified_base (253)..(255): a, c, t, g, unknown or other
  misc_feature (253)..(255): n is a, c, g, or t

SEQ ID NO: 50292 - DNA, 629 bp, Homo sapiens
  misc_feature: GYAE6OF01CUUB0.37.83.H06.1.454.CMB.1.raw
  modified_base (174)..(174): a, c, t, g, unknown or other
  misc_feature (174)..(174): n is a, c, g, or t
  modified_base (214)..(214): a, c, t, g, unknown or other
  misc_feature (214)..(214): n is a, c, g, or t
  modified_base (263)..(263): a, c, t, g, unknown or other
  misc_feature (263)..(263): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcggtgtgtttctaggtggctatttaaaaggngtcagtgtgagtgcagctgctggagtctggggaggctgtnagcgggggcccgtgagactctcctgtgaagctctggatcacctttgaanagtgtgcatgacgtcggtccgcgacgcgtcgagggagggcgtggaggtggtcgtcgtagttagttagtaggtaggtaggtagtagacgacgagtagtacgtacgacgtacgtacggtacggtacgggtaccggttaccgtaccgtactacgtaccgaacgaacgtaacgtaacgttaaccgtaaccgaacgacgtacgtacgtacgttacgttacgtacacacgtacgaacgacgtacgtagaacgacgaccggacgacgacgacgtactatattagttagtacgtacgtaacgttacgtttacgttacgttcgtttacgttaccgttaccgtacgtacgtaccgtacggtacggtaccggtacgg

SEQ ID NO: 50293 - DNA, 590 bp, Homo sapiens
  misc_feature: GYAE6OF01CXW6N.37.83.H06.1.454.CMB.1.raw
  modified_base (148)..(148): a, c, t, g, unknown or other
  misc_feature (148)..(148): n is a, c, g, or t
  modified_base (257)..(257): a, c, t, g, unknown or other
  misc_feature (257)..(257): n is a, c, g, or t
  modified_base (296)..(296): a, c, t, g, unknown or other
  misc_feature (296)..(296): n is a, c, g, or t
  modified_base (329)..(329): a, c, t, g, unknown or other
  misc_feature (329)..(329): n is a, c, g, or t
  modified_base (356)..(356): a, c, t, g, unknown or other
  misc_feature (356)..(356): n is a, c, g, or t
  modified_base (376)..(376): a, c, t, g, unknown or other
  misc_feature (376)..(376): n is a, c, g, or t
  modified_base (396)..(396): a, c, t, g, unknown or other
  misc_feature (396)..(396): n is a, c, g, or t
  modified_base (412)..(412): a, c, t, g, unknown or other
  misc_feature (412)..(412): n is a, c, g, or t
  modified_base (443)..(443): a, c, t, g, unknown or other
  misc_feature (443)..(443): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtgngttttctggtgctatttaaaaggtgtccagtgtgaggtgcagctgctggagtcgtgggggaggcttggtacaggccgggggggtccctgaagctctcctgtgaagcctntggattcacctttgacaagtgtgccatgacctgggtccnccaggctccgagggaagggctggagtgggtctnagtttataggtggtagtgggtatacgnacagattacgcaagctccgngacggcgtcacatcgcaganactaattcccaagacncacgtctgtattgtcacatagaacacgaccngagagcgacgacgacggaccaatatattattagtacgtacgtaaacctttaccgttttagttaccgtttaggtttaactttaaccgttaccccgttaccggttacgtaacccgtaccggtccggggttacccgggtaaaccccgggg

SEQ ID NO: 50294 - DNA, 539 bp, Homo sapiens
  misc_feature: GYAE6OF01DL4V1.37.83.H06.1.454.CMB.1.raw
  modified_base (314)..(314): a, c, t, g, unknown or other
  misc_feature (314)..(314): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgaggagggccacgatcaactgcaagtccagccggtagtgtttatacaactccaagaataagagttcttagcttggtaccagcaagaaaccacgacagcctacctaagctgctcgttacnggcctcgtaccggaatccgggtcctgaacgattcgagtggcggtcggtcgtgggacaggtactttcgactctacaccatcacgcacgccgtggcggcgtacgaagtagtggtacggtacggtttacttacgtgtcagctagtattatcgttactcctactacgtagtttcggaccgtagggacagcgtaggtacgatacgcacgtacgtgtcgctcgcactgtcg

SEQ ID NO: 50295 - DNA, 256 bp, Homo sapiens
  misc_feature: GYAE6OF01ESX2M.37.83.H06.1.454.CMB.1.raw
tcagtagtgtagatcacgaccggtgctcgatttagatcacgtgcgtcggcgggtctgggacagatttcactctcaccatcagcagcctgcgggctgaagatgtggcggtttattactgtcagcagtattatgttactcctccgacgttcggccaagggaccaaggtggaaatcaaaacgaactgtggctgcaccatctgtcttcatcttcccgccatctgaatctacactactgagcgggctggcaaggcgcatag

SEQ ID NO: 50296 - DNA, 652 bp, Homo sapiens
  misc_feature: GYAE6OF01EBGTC.37.83.H06.1.454.CMB.1.raw
  modified_base (421)..(421): a, c, t, g, unknown or other
  misc_feature (421)..(421): n is a, c, g, or t
  modified_base (463)..(463): a, c, t, g, unknown or other
  misc_feature (463)..(463): n is a, c, g, or t
  modified_base (470)..(470): a, c, t, g, unknown or other
  misc_feature (470)..(470): n is a, c, g, or t
  modified_base (490)..(490): a, c, t, g, unknown or other
  misc_feature (490)..(490): n is a, c, g, or t
tcagtagtgtagatcacgaccggtgctcgatttagatcacgtgcgtcgcggggacaacgaggcgaggcgagggcagacaagagtggtgttgcacgacccaggtcttctatttctctgttgctcgtggatctcttgttactacgaggtcgccgtacgggacatcgtgatcgacccagtcctccagacctcccgtggctgtgtctcgtgggacgaggacgggccacgatacaacgtgacaacgtccacggccggtagtttgttttaacaaccaacctaccgaaaagtaaagtaaagtacgttttactttagtcgtttacggtaaccagacaacgaaaccacgacacgtccctactaagctgcctttacgtttacgtcggtcccttaccgtacccgggaacgttccccggggtcctagaacgtntcgaggtcgggcggtcgggtcgtagggacagtcttcgactcnccaactntacgagcacgccgtggcggntagaagtgtggtggttcgtttattctgtcacgctagttattattacgttactcctactaacgttggtttacggaccggtaacgggaacccaaggtaccgtagggtaacgtacgtccggaccgaacgtacgttcgggtcggactacgaccctaccgtgttccg

SEQ ID NO: 50297 - DNA, 254 bp, Homo sapiens
  misc_feature: GYAE6OF01BB7FA.37.83.H06.1.454.CMB.1.raw
  modified_base (254)..(254): a, c, t, g, unknown or other
  misc_feature (254)..(254): n is a, c, g, or t
tcagtagtgtagatcacgaccggtgctcgatttagatcacgtgcgcgcgggtctgggacagatttcactctcaccatcagcagcctgcgggctgaagatgtggcggtttattactgtcagcagtattatgttactcctcacagttttggccaggggaccaagctggagatcgcacgaactgtggctgcaccatctgtcttcatcttcccgccatctgaatctacactactgagcgggctggcaaggcgcatagn

SEQ ID NO: 50298 - DNA, 292 bp, Homo sapiens
  misc_feature: GYAE6OF01C3M4X.37.83.H06.1.454.CMB.1.raw
  modified_base (260)..(292): a, c, t, g, unknown or other
  misc_feature (260)..(292): n is a, c, g, or t
tcagtagtgtagatcacgaccggtgctcgatttagatcacgtgcgtcgggcgggtctgggacaggatttcactctcaccatcagcagcctgcggcttgaagatgtggcggttttattactgtcagcagtattatgttactcctcacagttttggccaggggaccaagctggagatcgcacgaactgtggctgcaccatcctgtcttcatccttcccgccatctgaatctacactactgagcggctggcaaggcgcatagnnnnnnnnnnnnnnnnnnnnnnnnnnnnnnnnn

SEQ ID NO: 50299 - DNA, 265 bp, Homo sapiens
  misc_feature: GYAE6OF01DO833.37.83.H06.1.454.CMB.1.raw
  modified_base (255)..(265): a, c, t, g, unknown or other
  misc_feature (255)..(265): n is a, c, g, or t
tcagtagtgtagatcacgaccggtgctcgatttagatcacgtgcgcgcggttctgggacagatttcactctcaccatcagcagcctgcgggctgaagatgtggcggtttattactgtcagcagtattatgttactcctcacagttttggccaggggaccaagctggagatcgcacgaactgtggctgcaccatctgtcttcatcttcccgccatctgaatctacactactgagcgggctggccaaggcgcatagnnnnnnnnnnn

SEQ ID NO: 50300 - DNA, 524 bp, Homo sapiens
  misc_feature: GYAE6OF01BEH1X.37.83.H06.1.454.CMB.1.raw
  modified_base (238)..(238): a, c, t, g, unknown or other
  misc_feature (238)..(238): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccagactgttttanacagctccaacaataagaactacttagcttggtatcagcagaaaccagggcagcctacctaaactgctcatttactgggcatctacccgggagtccgggtccctgaccgattcaggtggcgaggcgggtctgggaccagtactttcacttctaccactatcaacagcctgcaggctggagatgtggctatttatctgtcagtcagttattataatctctcgtacgttcggaccgaacggacaagggtgaaactaccaaacgtacgttagtacggcttgcctaaccg

SEQ ID NO: 50301 - DNA, 529 bp, Homo sapiens
  misc_feature: GYAE6OF01BIIA0.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggcttttcttgtggctatttaaaaggtgtccagtgtgaggtgcagctgctggagtctgggggaggcttggtacagccgggggggtccctgagactctcctgtgaagcctctggattcacctttgacaagtgtgccatgacctgggtccgccaggctccgagggaaggggctgggagtgggtctcagttattagtggtagtggtagtagcacagattacgcagactccgtgaagggccgttcaccatctcagagacaattccaacagcacgctgtatttgcacatgaacagcctgagagccgagacacggccatatattattgtgacgtaaacttcctttagacttggttattactcccctagtcaccactggggccgtaacggg

SEQ ID NO: 50302 - DNA, 557 bp, Homo sapiens
  misc_feature: GYAE6OF01DKW6T.37.83.H06.1.454.CMB.1.raw
  modified_base (174)..(174): a, c, t, g, unknown or other
  misc_feature (174)..(174): n is a, c, g, or t
  modified_base (251)..(251): a, c, t, g, unknown or other
  misc_feature (251)..(251): n is a, c, g, or t
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (308)..(308): a, c, t, g, unknown or other
  misc_feature (308)..(308): n is a, c, g, or t
  modified_base (335)..(335): a, c, t, g, unknown or other
  misc_feature (335)..(335): n is a, c, g, or t
  modified_base (337)..(337): a, c, t, g, unknown or other
  misc_feature (337)..(337): n is a, c, g, or t
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
  modified_base (401)..(401): a, c, t, g, unknown or other
  misc_feature (401)..(401): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcggtgtgtttctaggtggctaatttaaaggngtcagtgtgaggtgcagctgctggagtcgtggggagcttggtacaggccggggggtcctgagctctctgtgagcctntgattcacctttgacagtgtgccatgacctggccncaggcncgagggagggctgggngtggtcagtagttatagtggaatggtnanaccatatacacgcaagactcgagacggtccgttcaactntcncgaaggactaacttccgaaaanacctatacttcgtctacgtagactaatacgaacacgtacgagagacgtacgacgacgtacgtacgttattacttacgtgtagtagtacgtacgtacgtaccgtaccgttacgtacgtcgacgcgtcgtcgttcgttagttacgttcgtcggtacgg

SEQ ID NO: 50303 - DNA, 555 bp, Homo sapiens
  misc_feature: GYAE6OF01ENY09.37.83.H06.1.454.CMB.1.raw
  modified_base (293)..(293): a, c, t, g, unknown or other
  misc_feature (293)..(293): n is a, c, g, or t
  modified_base (370)..(370): a, c, t, g, unknown or other
  misc_feature (370)..(370): n is a, c, g, or t
  modified_base (407)..(407): a, c, t, g, unknown or other
  misc_feature (407)..(407): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcggtgtgtttctaggtggctaatttaaaggtgtcagtgtgaggtgcagctgctggagtcgtgggggaggcttggtacaggccggggggtccctgagactctcctgtgaagcctctggattcacctttgacaagtgtgcatgactggtccncaggctccgagggaggggctggagtgggtctgagttattagtggtagtggtagagcacagattacgcaagcttccgngaaacgggccgttacacatctccagagacaatccaanagcacgctgtacttgcacatacgaacacgcctggaacgaggaccgagggacaccggtcaagtatattattgtacgacgttaaacctttccgtttagtacttggtttaacttactccccgtagttacacctagtcggggcaaaccgggg

SEQ ID NO: 50304 - DNA, 263 bp, Homo sapiens
  misc_feature: GYAE6OF01BWTPE.37.83.H06.1.454.CMB.1.raw
  modified_base (248)..(248): a, c, t, g, unknown or other
  misc_feature (248)..(248): n is a, c, g, or t
  modified_base (254)..(263): a, c, t, g, unknown or other
  misc_feature (254)..(263): n is a, c, g, or t
tcagtagtgtagatcacgaccggtgctcgatttagatcacgtgcgcgcgggtctgggacagatttcactctcaccatcagcagcctgcgggctgaagatgtggcggtttattactgtcagcagttattatgttactcctcacagttttggccaggggaccaagctggagatcgcacgaactgtggctgcaccatctgtcttcatcttcccgccatctgaatctacactactgagcggctggcaaggcncatagnnnnnnnnnn

SEQ ID NO: 50305 - DNA, 519 bp, Homo sapiens
  misc_feature: GYAE6OF01A34A2.37.83.H06.1.454.CMB.1.raw
  modified_base (237)..(237): a, c, t, g, unknown or other
  misc_feature (237)..(237): n is a, c, g, or t
  modified_base (408)..(408): a, c, t, g, unknown or other
  misc_feature (408)..(408): n is a, c, g, or t
  modified_base (516)..(516): a, c, t, g, unknown or other
  misc_feature (516)..(516): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttcttagcttggtaccagcagaaaccacgacagcctcctaagctgctcgtttactgggcctctacccgggaatccggggtccctgaacgattcagtggcggcgggtctgggacaggatttcactctcaccatcagcagcctgcggctgaagntgtggtcggtttattacgtgtcagcagttattatgttactcctactactgtttggccgagggaccaagcgtaggagtagtcgcacgaacgttggtggctggcaccgtntcg

SEQ ID NO: 50306 - DNA, 253 bp, Homo sapiens
  misc_feature: GYAE6OF01DJLUH.37.83.H06.1.454.CMB.1.raw
  modified_base (253)..(253): a, c, t, g, unknown or other
  misc_feature (253)..(253): n is a, c, g, or t
tcagtagtgtagatacacgaccggtgctcgatttagatcacgtgcgcgcgggtctgggacagatttcactctcaccatcagcagcctgcggctgaagatgtggcggtttattactgtcagcagtattataatactcctccgacgttcggccaagggaccaaggtggaaatcaaacgaactgtggctgcaccatctgtcttcatcttcccgcatctgaatctacactactgagcgggctggcaaggcgcatagn

SEQ ID NO: 50307 - DNA, 256 bp, Homo sapiens
  misc_feature: GYAE6OF01CRA77.37.83.H06.1.454.CMB.1.raw
  modified_base (254)..(256): a, c, t, g, unknown or other
  misc_feature (254)..(256): n is a, c, g, or t
tcagtagtgtagatcacgaccggtgctcgatttagatcacgtgcgcgcgggtctgggacagatttcactctcaccatcagcagcctgcgggctgaagatgtggcggtttattactgtcagcagtattatgttactcctcacagttttggccaggggaccaagctggagatcgcacgaactgtggctgcaccatctgtcttcatcttcccgccatctgaatctacactactgagcgggctggcaaggcgcatagnnn

SEQ ID NO: 50308 - DNA, 585 bp, Homo sapiens
  misc_feature: GYAE6OF01DBSG0.37.83.H06.1.454.CMB.1.raw
  modified_base (240)..(240): a, c, t, g, unknown or other
  misc_feature (240)..(240): n is a, c, g, or t
  modified_base (316)..(316): a, c, t, g, unknown or other
  misc_feature (316)..(316): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagacctccctggctgtgtctcgtgggcgagagggccacgatcaactgcaagtccaggccggagtgtttanacaactcaagaataagagttctttagcttggtaccagacagaaaccacgacagcctacctaagctgctcgtttacngggcctcgtacccgggaatcccggggtcctgaacgattcaggtggcggcgggtctggggacaggtacttttcgaactctaccaacctatacacgaccacgtcccgtcggcgggtcctggaaagtagtggttggtcggtttagttacgtgtacagtctagttatttattcgtttactccttactactagttttcggccgtaacgggaccaacggtcgaggtacgtatcgacgaaccggtaactcggtacggacgtgcacccgtagttccg

SEQ ID NO: 50309 - DNA, 509 bp, Homo sapiens
  misc_feature: GYAE6OF01AI0XH.37.83.H06.1.454.CMB.1.raw
  modified_base (498)..(498): a, c, t, g, unknown or other
  misc_feature (498)..(498): n is a, c, g, or t
  modified_base (504)..(504): a, c, t, g, unknown or other
  misc_feature (504)..(504): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttatacaactccaagaataagagttctttagcttggtaccagcagaaaccacgacagcctcctaaactgctcatttactgggcatctacccgggagtccggggtccctgaccgattcagtggcagcgggtctgggacagatttcactctcaccatcaacagcctgcaggcctgaggatggtggcgatttattactgtcagcagtattataatactcctcgacgttcggccaagggaccaaggtgaaatcaaacgactgtggtcngacacntctcg

SEQ ID NO: 50310 - DNA, 502 bp, Homo sapiens
  misc_feature: GYAE6OF01CDH8X.37.83.H06.1.454.CMB.1.raw
  modified_base (238)..(238): a, c, t, g, unknown or other
  misc_feature (238)..(238): n is a, c, g, or t
  modified_base (497)..(497): a, c, t, g, unknown or other
  misc_feature (497)..(497): n is a, c, g, or t
  modified_base (499)..(499): a, c, t, g, unknown or other
  misc_feature (499)..(499): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttcttagcttggtaccagcagaaaccacgacagcctcctaagctgctcgtttactggcctctacccgggaatccggggtccctgaacgattcgagtggcggcggtcgtgggacagatttcactctcaccatcagcagcctgcggctgaagatgtggcgtttattactgtcagcagtattatgttactcctcactagtttggcctagggaccaagctggagatcgcacgaactgtgctgcncntcg

SEQ ID NO: 50311 - DNA, 714 bp, Homo sapiens
  misc_feature: GYAE6OF01EJFTQ.37.83.H06.1.454.CMB.1.raw
  modified_base (175)..(175): a, c, t, g, unknown or other
  misc_feature (175)..(175): n is a, c, g, or t
  modified_base (212)..(212): a, c, t, g, unknown or other
  misc_feature (212)..(212): n is a, c, g, or t
  modified_base (257)..(257): a, c, t, g, unknown or other
  misc_feature (257)..(257): n is a, c, g, or t
  modified_base (278)..(278): a, c, t, g, unknown or other
  misc_feature (278)..(278): n is a, c, g, or t
  modified_base (292)..(292): a, c, t, g, unknown or other
  misc_feature (292)..(292): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcggtgtgtttctaggtcggctaatttaaaggntcagtgtgaggtgcagctgctggagtcgtgggggagnttggtacaggccgggggggtccctgagactctcctgtgaagcctntggattcacctttgacaagtntgcatgctgggccncgagctcggagggacggcgtggagtggtctgtagttagtaggtggtagtggtacgtagacacgagtactacgacagtaccgtacggtagggtaaccgggtccgttacaaccgtactaccgtaccgaagtaacgtaacctaacttaacccgaaacgacgacgtacgtacgttacgttacgtttacgtactaacgtaacgtaacgtaacgtaacgtaccgtacggaacggaaccggaaccggaacggtaaccggtaaccggtaaccgtaacgttaacgttaacgtttaacgttacggttacggttaaccgtttaaaccgttttaccgttttacggtttaacggtttacggtttaacgtttaaccgttacccgttaaccggttaccggtaaccggtaaccggtaccgggtacccgggtaaccggg

SEQ ID NO: 50312 - DNA, 552 bp, Homo sapiens
  misc_feature: GYAE6OF01C3S8L.37.83.H06.1.454.CMB.1.raw
  modified_base (240)..(240): a, c, t, g, unknown or other
  misc_feature (240)..(240): n is a, c, g, or t
  modified_base (428)..(428): a, c, t, g, unknown or other
  misc_feature (428)..(428): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgacaagtccagccggagttgtttanacaactccaaagaataagagttctttagcttggtaccagacaacgaaacacgacacgcctactaagctgcctcgtttactgggcctcgtacccgggaactccggggtccctgaacgtattcgaggtggcggtcgggtcgtgggactaggtctttcactctcacctatcatcagcctggcggctgaagntggtgtcgtttatctgtcagtctagttattattcgttactctactactagtttggaccgtagggaccaggtcgtaggtacgtaagttcgccgaacgtaacttggtcggactgacccactgttcg

SEQ ID NO: 50313 - DNA, 573 bp, Homo sapiens
  misc_feature: GYAE6OF01BGDUN.37.83.H06.1.454.CMB.1.raw
  modified_base (238)..(238): a, c, t, g, unknown or other
  misc_feature (238)..(238): n is a, c, g, or t
  modified_base (396)..(396): a, c, t, g, unknown or other
  misc_feature (396)..(396): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggcctccatcaactgcaagtccagccagactgttttanacagctccaacaataagaactacttagcttggtatcagcagaaaccagggcagcctcctaaactgctcatttactgggcatctacccgggagtccgggtccctgaccgattcagtggcagcgggtctgggacagtacttcactcaccactatacaacncgtctgacgaggcgtaggaggtagttggtggtacgttaatttacttacgtcgttacgacgtacgtagttaattaactaacttacctcccgtaccggtaccgttacggaaccggtaacgggtaaccggtaaggtaacggtaaactaacgaaacgtacgtacggtagtctgacctaacg

SEQ ID NO: 50314 - DNA, 550 bp, Homo sapiens
  misc_feature: GYAE6OF01CSZBQ.37.83.H06.1.454.CMB.1.raw
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
  modified_base (442)..(442): a, c, t, g, unknown or other
  misc_feature (442)..(442): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtcgtgggggaggcttggtacgaggccgggggggtccctgagactctcctgtgaagcctctggattcacctttgacaagtgtgccatgacctgggtccgccaggctccgaggggaagggctggagtgggtctcagttatagtggtagtggtagtagcanagattacgnagactcgtgaacgggccgttacaccatctacagagacaatccaaacagcaacgctagtatttgacacatgaacngcctgaagagccgaggaccacggacatagtattattgtagactaaactttccctttagacttggttacttactacccctagtacgacccacgtggggccctaacgggg

SEQ ID NO: 50315 - DNA, 654 bp, Homo sapiens
  misc_feature: GYAE6OF01D1IT7.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtgtcgttttctaggtggctaattttaaaaggtgtcagtgtgaggtgcagctgctggagtcgtgggggagcgttggtacaggccgggggggtccctggagactctcctgtgaagcctctggattcacctttgacaagtgtgccatgacctgggtcccgccaggcctccgaggggaggggcgtgggagtggtctcgtagtttattaggtggtagtggtagtagctacgagtattacgcaagactccggtagaacgggtccgttacacctatcctaccaagaacgaactaacttacccgaaacacgacaacgtcttagttatttgaccactagttacgaacacgaccgtaggaacggacgacccggaaggaccgaaccgggaccctaagttattaattacgtttggtacgtaaccgttaaaactttttccgttttagtacgtttaggtttaactttaccttacccccgttaggtaccgaacccgtacggtaccggggcccgtaaacccgggg

SEQ ID NO: 50316 - DNA, 260 bp, Homo sapiens
  misc_feature: GYAE6OF01CKDH8.37.83.H06.1.454.CMB.1.raw
  modified_base (252)..(252): a, c, t, g, unknown or other
  misc_feature (252)..(252): n is a, c, g, or t
  modified_base (256)..(260): a, c, t, g, unknown or other
  misc_feature (256)..(260): n is a, c, g, or t
tcagtagtgtagatcacgaccggtgctcgatttagatcacgtgcgcggcgggtctgggacagatttcactctcaccatcagcagcctgcgggctgaacgatgtggcggtttattactgtcagcagtattatgttactcctcacagttttggccaggggaccaagctggagatcgcacgaactgtggctgcaaccatctgtcttcatcttcccgccatctgaatctacactactgagcggctggcaaggcganatgnnnnn

SEQ ID NO: 50317 - DNA, 538 bp, Homo sapiens
  misc_feature: GYAE6OF01EGAGD.37.83.H06.1.454.CMB.1.raw
  modified_base (522)..(522): a, c, t, g, unknown or other
  misc_feature (522)..(522): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtctgggggaggcttggtacaggccgggggggtccctgagactctcctgtgaagcctctggattcacctttgacaagtgtgccatgacctgggtccgccaggctccgaggggaaggggctgggagtgggtctcagttattagtggtagtggtagtagcacagattacgcagactccgtgaacgggccggttcaccatctccagagacaattccaacagcacgctgtatttgcacatgaacagcctgagagccgaggacacggcatatatattgtgtactaaactttcctttagacttggttacttactacccctagtcaccncgtgggcctaacgggg

SEQ ID NO: 50318 - DNA, 570 bp, Homo sapiens
  misc_feature: GYAE6OF01CG2CQ.37.83.H06.1.454.CMB.1.raw
  modified_base (242)..(242): a, c, t, g, unknown or other
  misc_feature (242)..(242): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacagtcgtgatgacccagtctccagacctccctggctgtgtctcgtgggcgagacgggccacgatcaactgcaagtccagccggagttgtttanacaactcaagaataagagttcttagcttaggaccagacaagaaccacgacacgcctactaagctgctcgtttacgcgggcctcgtacccgggatccgggtacctagaacgtacttacgaggtcgggacggcgggtctcgggaactagtactttcacgtctacacctatcgacgcacgaccgtggacggactaggaagtgttggtggtacgtttatacgtgtacagtactagtaattatcgttactctactacttaggtttcgacgtacgggaccaggtcgtaggacgtatacgctacgtacgtcgtacggctagacctacgtgttccg

SEQ ID NO: 50319 - DNA, 537 bp, Homo sapiens
  misc_feature: GYAE6OF01BHEAW.37.83.H06.1.454.CMB.1.raw
  modified_base (236)..(236): a, c, t, g, unknown or other
  misc_feature (236)..(236): n is a, c, g, or t
  modified_base (310)..(310): a, c, t, g, unknown or other
  misc_feature (310)..(310): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggatgtttanacaactccaagaataagagttcttagcttggtaccagcagaaaccacgacagcctcctaagctgctcgtttacngggcctctacccgggaatccggggtcctgaacgattcgagtggcggcgggtctgggacagatttcactctcacatcagcagcctgcggctagaagatgtggtcggtttattacgtgtcagctagttattatcgttactcctactactagtttcggccgtacgggtaccaaggtcgtagggacgtagtcggacaaccggtaactcggtggctagacctaccgattccg

SEQ ID NO: 50320 - DNA, 573 bp, Homo sapiens
  misc_feature: GYAE6OF01CZU8Z.37.83.H06.1.454.CMB.1.raw
  modified_base (301)..(301): a, c, t, g, unknown or other
  misc_feature (301)..(301): n is a, c, g, or t
  modified_base (414)..(414): a, c, t, g, unknown or other
  misc_feature (414)..(414): n is a, c, g, or t
tcagtagtgtagatcacgaccggtgctcgatttagatcacgtgcgtcgcgggggagagaggagcccagccctgggattttcaggtgtttcatttggtgatcaggactgaacagagagaactcaccatggagtttgggctgagctggtcttttcttgtggctattttaaaaggtgtccagtgtgaggtgcagctgctggagtcgtggggggaggcttgggtacaggccgggggggtccctggagactctcctgtgaagcctctggattcacctttgacaagtgtgccatgacctgggtcccnccaggctccgagggaagggctggagtggtctcagttatagtggtagtggtatagcacagattacgcagactccgtagacgggcgttacacatctcagagacaactaccaacancacgctgtattgcacatgaacagcctagaagacgaccggaaggacacggaccaatactaatttattggtacgtacgtaaaacctttccttttagacgtttggtttaacttacttccccgttaagttacgaccctaacggtcggggcccgtaaaccgggg

SEQ ID NO: 50321 - DNA, 662 bp, Homo sapiens
  misc_feature: GYAE6OF01BK580.37.83.H06.1.454.CMB.1.raw
  modified_base (437)..(437): a, c, t, g, unknown or other
  misc_feature (437)..(437): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgaggagggccacgatacaactgacaacgtccaggccggtagttgtttaacacaactaccaaagaataagtagtttacttagcttagggtaaccagacaacgaaacccacggaacctacggtaccctaccgtaaagccttacgtacctttacggttttacgccgggtaccctaccggtaaccccggggaacgttccccggggtacctaggaaccgtacttcgagggtcggcgggtcggtcgngggactgtactttcactcaccactatacacgcacgccgtggcggactaggaacgtgtggttacggtacgttttatacgtgtactaggtacttaagttacttacgttacgttacctacccttcgtacgttacgtttcgggaccgtacggggtactaacgtcggtaaggactacggacggtaccaacggtacgtcggtacggtctacggtcccaacgttcgttaccg

SEQ ID NO: 50322 - DNA, 284 bp, Homo sapiens
  misc_feature: GYAE6OF01EWHZR.37.83.H06.1.454.CMB.1.raw
  modified_base (261)..(284): a, c, t, g, unknown or other
  misc_feature (261)..(284): n is a, c, g, or t
tcagtagtgtagatcacgaccggtgctcgatttagatcacgtgcgtcgggcggggtctgggacagatttcactctcaccatcagcagcctgcgggctgaagatgtggcggttttattactgtcagcagttattatgttactcctctacagttttggccaggggtaccaagctggagatcgcacgactgtggctgcaccatctgtcttcatcttcccgcatctgaactctacactactgagcggctgggcaaggcgcatagnnnnnnnnnnnnnnnnnnnnnnnn

SEQ ID NO: 50323 - DNA, 654 bp, Homo sapiens
  misc_feature: GYAE6OF01D0F0L.37.83.H06.1.454.CMB.1.raw
  modified_base (243)..(243): a, c, t, g, unknown or other
  misc_feature (243)..(243): n is a, c, g, or t
  modified_base (371)..(371): a, c, t, g, unknown or other
  misc_feature (371)..(371): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagacctccctggctgtgtctcgtgggcgaggacgggccacgatcaactgacaagtccagccggagttgtttanacaactcaagaataagtagttacttagcttaggtaccagacaagaaccacgaacacgcctactaagcctgtacttcgtttacgcggtacctacgtaacccgggagtcccggggtacctaggaaccgtnttcgaggtcgggccggtcgggtcgtacgggactaggtactttaccgacttccgtaccaacctagtacgacgtacgacgtccgtcggacggtacgtagaagtacgttggttacggttacggtttacgttacgtcgtacgtacgtacgtagttaacgttaagttcgtttaccttccgttacgtacgttacgggttttaccggaccggtaacgggtaaccgtacgtacggtaggacgtacgtacggacgaacgtacgtggtacggtcgtacgactacgtagttccg

SEQ ID NO: 50324 - DNA, 514 bp, Homo sapiens
  misc_feature: GYAE6OF01EFHEX.37.83.H06.1.454.CMB.1.raw
  modified_base (238)..(238): a, c, t, g, unknown or other
  misc_feature (238)..(238): n is a, c, g, or t
  modified_base (507)..(507): a, c, t, g, unknown or other
  misc_feature (507)..(507): n is a, c, g, or t
  modified_base (510)..(510): a, c, t, g, unknown or other
  misc_feature (510)..(510): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttctttagcttggtaccagcagaaaccacgacagcctcctaagctgctcgtttactgggcctctacccgggaatccggggtccctgaacgattcagtggcggcgggtctgggacagatttcactctcaccatcagcagcctgcgggctgaagatgtggtcggtttattactgtcagcagtattatgttactccttcactagtttcggccgaggggaccaaggctggagtatcgcacgactggtggctgcnccntccg

SEQ ID NO: 50325 - DNA, 531 bp, Homo sapiens
  misc_feature: GYAE6OF01B5E4E.37.83.H06.1.454.CMB.1.raw
  modified_base (300)..(300): a, c, t, g, unknown or other
  misc_feature (300)..(300): n is a, c, g, or t
  modified_base (330)..(330): a, c, t, g, unknown or other
  misc_feature (330)..(330): n is a, c, g, or t
  modified_base (395)..(395): a, c, t, g, unknown or other
  misc_feature (395)..(395): n is a, c, g, or t
  modified_base (414)..(414): a, c, t, g, unknown or other
  misc_feature (414)..(414): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtggctttttcttgtggctattttaaaaggtgtccagtgtgaggtgcagctgctggagtcgtgggggaggcttggtacaggccgggggggtccctgagacctctcctgtgaagcctctggattcacctttgacaagtgtgccatgacctgggtccncaggctccgagggagggctggagtgggtcnctagttatagtggtagtggtagtagcacagattacgcagactccgtgaagggccgttcaccatcnccagagacaattccaacancacgctgtatttgcacatcgaacagcctgagagccgaggacgacggcatatatatgtgacgtaacttctttgacgttgttattacttcccctagtcgaccacgtgggccgtaacggg

SEQ ID NO: 50326 - DNA, 516 bp, Homo sapiens
  misc_feature: GYAE6OF01A5LVZ.37.83.H06.1.454.CMB.1.raw
  modified_base (237)..(237): a, c, t, g, unknown or other
  misc_feature (237)..(237): n is a, c, g, or t
  modified_base (512)..(512): a, c, t, g, unknown or other
  misc_feature (512)..(512): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttctttagcttggtaccagcagaaaccacgacagcctcctaagctgctcgtttactggcctctacccgggaatccggggtccctgaacgattcagtggcggcggtctgggacagatttcactctcaccatcagcacgcctgcggctgaagatgtggtcgtttattactgtcagcagtattatgttactccttactactagttttcggccgtagggaccaagcgtaggagatcgcacgaacgtgtggctgctccgtntccg

SEQ ID NO: 50327 - DNA, 670 bp, Homo sapiens
  misc_feature: GYAE6OF01D7HI6.37.83.H06.1.454.CMB.1.raw
  modified_base (244)..(244): a, c, t, g, unknown or other
  misc_feature (244)..(244): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgccgtacggggacatcgtgatgacccagtctccagacctccctggctgtgtctcgtgggcgaggacgggccacgatcaactgacaagtccagccggtagtgtttanacaactacaaagaataagtagttcttagcttggtaccagacaacgaaaccacgacagccctaccgtaagcctgtccttcgtttacgtcgggtcccttaccgtaaccccgggtaacgtcccggggtaccctaggaaaccgtacttcgaggtcgggcggtacgggtcgtagggactaggtacttcgaactcgtacaccatcgagtccacgtccgtcgggcggtactaggaagtagttggtacgggttacgttttaacgttacgtcggtacacgtacgtaagttaagtttacgtacgtttacctaccttaccgtacgttacggtttccggaccggtaacggggtaacctaacggtcgtagggtaaccgtagtaccggaccgtaaccggtaacgttcgggtacggtccgtacgaccctaccgtgttaccg

SEQ ID NO: 50328 - DNA, 574 bp, Homo sapiens
  misc_feature: GYAE6OF01EJK96.37.83.H06.1.454.CMB.1.raw
  modified_base (380)..(380): a, c, t, g, unknown or other
  misc_feature (380)..(380): n is a, c, g, or t
  modified_base (406)..(406): a, c, t, g, unknown or other
  misc_feature (406)..(406): n is a, c, g, or t
  modified_base (418)..(418): a, c, t, g, unknown or other
  misc_feature (418)..(418): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggtctttttcttgtggcttaattttaaaaggtgtccagtgtgaggtgcagctgctggagtcgtgggggaggcttggtacaggccgggggggtccctgagactctcctgtgagcctctggattcacctttgacaagtgtgccatgacctggtcccgcaggctccgagggaggggctggagtgggtctcgagtttattaggtggtagtggtagtagcacgagattacgcagactcgnggaacgggccgttcacatcctcaganacaattccaacngcacgctagtattgacacatagaacagcctagacgagccgagaccacggactatatattattgtacgacgtaaactttccgttttagacgtttggttaactttacgtacccccgttaagtaccgtaaccctacggtcggggcccgtaaacccgggg

SEQ ID NO: 50329 - DNA, 507 bp, Homo sapiens
  misc_feature: GYAE6OF01EP7IY.37.83.H06.1.454.CMB.1.raw
  modified_base (478)..(478): a, c, t, g, unknown or other
  misc_feature (478)..(478): n is a, c, g, or t
  modified_base (502)..(502): a, c, t, g, unknown or other
  misc_feature (502)..(502): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttatacaactccaagaataagagttctttagcttggtaccagcagaaaccacgacagcctcctaaagctgctcgtttactgggcctctacccgggaatccggggtcctgaacgattcagtggcggcggtctgggacagatttcactctcaccatcagcagcctgcggctgaagatgtggtcggtttattactgtcagcagtattatgttactcctcactagtttgccgagggaccaagctgganatcgcacgaactgtggctgcaccnttccg

SEQ ID NO: 50330 - DNA, 725 bp, Homo sapiens
  misc_feature: GYAE6OF01ESWDH.37.83.H06.1.454.CMB.1.raw
  modified_base (173)..(173): a, c, t, g, unknown or other
  misc_feature (173)..(173): n is a, c, g, or t
  modified_base (278)..(278): a, c, t, g, unknown or other
  misc_feature (278)..(278): n is a, c, g, or t
  modified_base (484)..(484): a, c, t, g, unknown or other
  misc_feature (484)..(484): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcggtgtgtttctaggtggctatttaaaggngtcagtgtgaggtgcagctgcgtggagtgtgggggacgcttggacaggccgggggtcctgagctctctgtgagctctggtattctacctttgacctaagttggtnaccagttcgaccgttcggggtcccaccgtaggtcctaccggaagggggtaaggggccgttggggaacggttggggtacccttcgtaagttttaagttacgggttgggttaaggttgggtttaaaggtaccggcctaacgagggttaacttaaccggcttaggaacccgttcggttacggaaacgggggtcccgtttacaaaccctnttaccctacgaaacggacaaccctttaagtaccccaaacgtcgaccggttaactccgggtttacgttaattttccggacaaaccttacggtaacgtaacgtacgacgtacgacgacgacggacgacgacgacgtagtagttagttagttacgttacgtacgttaaccgtttacgtttacgttacgttacttacgttaccttaccgttacgtacgtaccgtaccggtcggtaccggtaccgg

SEQ ID NO: 50331 - DNA, 732 bp, Homo sapiens
  misc_feature: GYAE6OF01B9COP.37.83.H06.1.454.CMB.1.raw
  modified_base (297)..(297): a, c, t, g, unknown or other
  misc_feature (297)..(297): n is a, c, g, or t
  modified_base (354)..(354): a, c, t, g, unknown or other
  misc_feature (354)..(354): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggcttttctgtggctaattttaaaaggtgtccagtgtgaggtgcagctgctggagtcgtgggggaggcttggtacaggcccggggggtcctgagactctcctgtgaacgcctcgtggattcacctttgacaagtgtgtcatgacctggtccnccaggctcgagggagggctggagtggtctcagttataggtggtagtggtagtagcanagtacttacgcagtactccggtagaacgggtccgttacgacctacgtccgtaccgaaggtacgtaacctaacgtttccccgaaaacgtcggtacctaaccggtcttacggttaactttcggaacctaaacgtacgttacggaaaacctcgggtaccccgttaggaaccggtaaccggcccggtaagggtaaccccgtaacgggaccttaagttaacttaacgtttacgttacgggtaccggtaaacccgttaaaaccgttttcccgttttaggaaccgttttacggggtttaacctttaacccggttacccccgttaagggttacccggtaaaccccgttacgggttccggggggaaccccctttaaacccggggggg

SEQ ID NO: 50332 - DNA, 512 bp, Homo sapiens
  misc_feature: GYAE6OF01AOBPK.37.83.H06.1.454.CMB.1.raw
  modified_base (501)..(501): a, c, t, g, unknown or other
  misc_feature (501)..(501): n is a, c, g, or t
  modified_base (507)..(507): a, c, t, g, unknown or other
  misc_feature (507)..(507): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttatacaactccaagaataagagttctttagcttggtaccagcagaaaccacgacagcctcctaagctgctcgtttactgggcctctacccgggaatccggggtccctgaacgattcagtggcggcgggtctgggacagatttcactctcaccatcagcagcctgcgggctgaagatgtggtcggtttatactgtcagcagtattatgttactcctcactgttttggccgaggggaccaagctgggagatcggcacgactgtcggcngcaccngtccg

SEQ ID NO: 50333 - DNA, 720 bp, Homo sapiens
  misc_feature: GYAE6OF01AX7DH.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtggcttttctgtggctattttaaaggtgtccagtgtgaggtgcagctgctggagtcgtgggggagcttgggtacaggcccgggggggtcctggagactctccgtgtgaacgtcctgtggtattcctacctttgactaagtgtgccagtcgaccgtcgggtcccgccgacggccgtccgaggggtaacggggcgtgggtacggtcgggttctcgtaggttagttaggttgggttagttagggtagttacgacgtacccgtagtacgttacggcaacgtaccgtcggtaggtaaacgggtccggttacacctactcctaccgagacgaactaacttaccaacacgacacgtcttagttactttacgacctactaacgtacgtaaacgacgtaccgtaggaacggaacgacccggaacggaccgaaccggtacctaacttagttaacgtttagtttacggtacgtaacccgtttaaaacccgtttttcccggttttaagttacgtttacggtttaaccttacgttaccccgtttagtaccgtacccgtacgggtccggggtacccggtaaccccgggg

SEQ ID NO: 50334 - DNA, 655 bp, Homo sapiens
  misc_feature: GYAE6OF01CYJKV.37.83.H06.1.454.CMB.1.raw
  modified_base (172)..(172): a, c, t, g, unknown or other
  misc_feature (172)..(172): n is a, c, g, or t
  modified_base (200)..(200): a, c, t, g, unknown or other
  misc_feature (200)..(200): n is a, c, g, or t
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (224)..(224): a, c, t, g, unknown or other
  misc_feature (224)..(224): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcggtcgtgttctaggtcggcatttaaagngtcagtgtgagtgcagctgctggatggngggngcgtgacgnggccggggtcngagactctctgtagagctgtgtacttctacttagactagtgtcgccagtcgaccgtcggtccgcgacggtccgtacggaaggggacgggtcgtaggtagggtcgggttcgttacgttagttagttaggttaggtaggtaggtaggtacgtacgtacgtagtacgtacgacgacgtacgtaccggtacggtacgggtaccggtaccgtacgtactacgtacgacgacgtaacgtaacgtaacaacgacgacgacgtacgttagttagttacgtactacgtacgtacgaacgtacgtacgtacgaacgacggacggacgaccgaccgacgtaactatattagttacgtacgtacgttaacgtttacgtttagttacgttcgtttacgttacgttaccgttacgtacgtacgtaccggtcggtaccggtaccgg

SEQ ID NO: 50335 - DNA, 627 bp, Homo sapiens
  misc_feature: GYAE6OF01EM3TU.37.83.H06.1.454.CMB.1.raw
  modified_base (240)..(240): a, c, t, g, unknown or other
  misc_feature (240)..(240): n is a, c, g, or t
  modified_base (316)..(316): a, c, t, g, unknown or other
  misc_feature (316)..(316): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgaggagggccacgatcaactgcaagtccagccggagttgtttanacaactccaagaataagagttcttagcttggtaccagcaagaaaccacgacagcctcctaagctgctcgtttacgnggcctcgtacccgggagtcccggggtcctagaacgattcgaggtcgggcggacgggtcgtacggggactaggtatttccgacttccgtacacctatccgacgcagccgtcggcgggcgtaggaagtagtcggtggttcggtttattacgttcggtcgtagtacgtaacgttattagttacgttaccttaccgttctaacgttacggttttacggaccggtaacggggaaccgtaacggtacgtacggtacggtagttaccggacgtaaccggtaacgtcggtacggtacgtacgacctaccgtcgttaccg

SEQ ID NO: 50336 - DNA, 636 bp, Homo sapiens
  misc_feature: GYAE6OF01DXBDM.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtggtctttttcttgtggcttaattttaaaaggtgtccagtgtgaggtgcagctgctggagtcgtgggggaggcttggtacgagggcccgggggggtccctggagacctctcctgtgagcctctggattcacctttgacaagtgtgccatcgaccgtgggtcccgccaggcctccgaggggaggggctgggagtgggtctctagttatagtggtagtggtagtagcacgagattacgcagactccggtgaacgggccgttacacccgtatcgtacagagaacaacttaccaacacgacacgtctagttattcgacaacatagaacacgtcctagacgacgacccggaacggaccgaaccggtacctaagttacttaatttagttggtacgtaccgttaaaccttttccgttttagtacgtttagggtttaacctttaccgttacccccgttagttacgtacccgtacggtcggggtcccggtaaacccgggg

SEQ ID NO: 50337 - DNA, 569 bp, Homo sapiens
  misc_feature: GYAE6OF01DNX5T.37.83.H06.1.454.CMB.1.raw
  modified_base (299)..(299): a, c, t, g, unknown or other
  misc_feature (299)..(299): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtctgggggaggcttggtacaggcccgggggggtccctggagactctcctgtgaagcctctggattcacctttgacaagtgtgccatgacctgggtccnccaggctccgaggggaggggctggagtgggtctcagtttatagtggtagtggtagtagcacagattacgcagactccgtgaacgggccgttacacatctccagagacaattccaaacacgcacgactgttattcgacacatagaacagcctgaagacgacgagacacgccagtatattattgtcgtacgtaaacgtttcctttaggtacgttggtttaactttactaccccttagtaccgtacctacggtcggggtaccgtaacccgggg

SEQ ID NO: 50338 - DNA, 580 bp, Homo sapiens
  misc_feature: GYAE6OF01DC2M9.37.83.H06.1.454.CMB.1.raw
  modified_base (148)..(148): a, c, t, g, unknown or other
  misc_feature (148)..(148): n is a, c, g, or t
  modified_base (173)..(173): a, c, t, g, unknown or other
  misc_feature (173)..(173): n is a, c, g, or t
  modified_base (222)..(222): a, c, t, g, unknown or other
  misc_feature (222)..(222): n is a, c, g, or t
  modified_base (300)..(300): a, c, t, g, unknown or other
  misc_feature (300)..(300): n is a, c, g, or t
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
  modified_base (405)..(405): a, c, t, g, unknown or other
  misc_feature (405)..(405): n is a, c, g, or t
  modified_base (457)..(457): a, c, t, g, unknown or other
  misc_feature (457)..(457): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtgngttttctaggtggctatttaaaggngtccagtgtgaggtgcagctgctggagtcgtgggggaggcttggtacgngccgggggggtccctgagactctcctgtgaagcctctggattcacctttgacaagtgtgccattgacctggggtcccnccaggctccgaggggaggggctgggaggtggtctcgtagttgttaggtggtagtggtagtagcanagattcgnaagctcgtgagggcgtacactatcctcagganacctaattccaaacgctcaacggtctaggttattcgactacatagaaaccgnccgtagacgacgaccgagtacgcgtactatattagttgttgtacgtaccttaacgtttcgttagtacgtttagttaccttacctacccgttagtacgacccgtacggtcggggaaccgacggg

SEQ ID NO: 50339 - DNA, 527 bp, Homo sapiens
  misc_feature: GYAE6OF01B48CV.37.83.H06.1.454.CMB.1.raw
  modified_base (238)..(238): a, c, t, g, unknown or other
  misc_feature (238)..(238): n is a, c, g, or t
  modified_base (430)..(430): a, c, t, g, unknown or other
  misc_feature (430)..(430): n is a, c, g, or t
  modified_base (442)..(442): a, c, t, g, unknown or other
  misc_feature (442)..(442): n is a, c, g, or t
  modified_base (493)..(493): a, c, t, g, unknown or other
  misc_feature (493)..(493): n is a, c, g, or t
tcagtagtgtagatcacgaccggtgctcgatttagatcacgtgcgtcgcggggacaacaggcaggcagggacagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacagctaccaacaataagaactacttagcttggtatcagcaataaaccagggcacgcctacctaaactgctctatttactgggctatccgtacccgggacgtcccggggtccctgaccgattcaggtcggcgaggcgggtcgtgggacagtatttcacttctcaccatcaacagcctgcaggctagagatgnggtctatttatntgacagctaagtattataatctccgtcgtacgtcgacgaagggacaagggngaaacaccgaaacgactgtaggcacgctactacg

SEQ ID NO: 50340 - DNA, 547 bp, Homo sapiens
  misc_feature: GYAE6OF01DZRNU.37.83.H06.1.454.CMB.1.raw
  modified_base (172)..(172): a, c, t, g, unknown or other
  misc_feature (172)..(172): n is a, c, g, or t
  modified_base (219)..(219): a, c, t, g, unknown or other
  misc_feature (219)..(219): n is a, c, g, or t
  modified_base (254)..(254): a, c, t, g, unknown or other
  misc_feature (254)..(254): n is a, c, g, or t
  modified_base (348)..(348): a, c, t, g, unknown or other
  misc_feature (348)..(348): n is a, c, g, or t
  modified_base (399)..(399): a, c, t, g, unknown or other
  misc_feature (399)..(399): n is a, c, g, or t
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtgtgtttctaggtggctatttaaaggngtcagtgtgaggtgcagctgctggagtcgtgggggagcgttggtacnggccggggggtcctgagactctcctgtgaagcctntggattcacctttgacaagtgtgccatgacctggtccgcaggctcgagggaagggctggagtggtctgtagttatgtggtagtggtagtagcanagattacgcagactcgtgacggtcgtcaccgatctcagagacaattccaanagcacgctgtacttgcanatanacacgcgtgagacgacgacgacgacgactagtattattagtgtacgtacttaacgtttcgtttagtacgtttagttaacttaccgtacccgttagtaccgtaaccgtcggtcgggaccggtacggg

SEQ ID NO: 50341 - DNA, 272 bp, Homo sapiens
  misc_feature: GYAE6OF01BYTNX.37.83.H06.1.454.CMB.1.raw
  modified_base (258)..(272): a, c, t, g, unknown or other
  misc_feature (258)..(272): n is a, c, g, or t
tcagtagtgtagatcacgaccggtgctcgatttagatcacgtgcgcgcgggtctgggtacgagatttcactctcacccatcagcagcctgcggctgaagatgtggcggtttattactgtcagcagtattatgttactcctcacagttttggccaggtgaccaagctggagatcgcacgaactgtggctgcacctatctgtcttcatccttcccgcatctgaatctacactactgagcgggactggcaaggcgcatagnnnnnnnnnnnnnnn

SEQ ID NO: 50342 - DNA, 555 bp, Homo sapiens
  misc_feature: GYAE6OF01BV3HW.37.83.H06.1.454.CMB.1.raw
  modified_base (239)..(239): a, c, t, g, unknown or other
  misc_feature (239)..(239): n is a, c, g, or t
  modified_base (311)..(311): a, c, t, g, unknown or other
  misc_feature (311)..(311): n is a, c, g, or t
  modified_base (346)..(346): a, c, t, g, unknown or other
  misc_feature (346)..(346): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggagtgttttanacaactccaagaataagagttcttagcttggtaccagcaagaaccacgacagcctctaagctgctcgttacnggcctcgtacccgggaatcccgggtcctagaacgnttcgagtcgggcggtcgggtctaggggactagtacgtttccaacgtctcactatcagcagccgtgcggctgaagagtgtgtcgttattacgtgtcagtcgtagtattagtgttacctcctactacgtaggtttcggaccgagggtaccaagtccgtaggacgtacgtacgcgaacgtacgtacgttacgggctagcctacctgttaccg

SEQ ID NO: 50343 - DNA, 660 bp, Homo sapiens
  misc_feature: GYAE6OF01D41K6.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtggtctttttcttgtggctattttaaaaggtgtccagtgtgaggtgcagctgctggagtcgtgggggagcttggtacaggccgggggggtccctgagactctcctgtgaacgcctctggattctacctttgactaagtgtgccatcgaccgtgggtcccgccgaggccgtaccggagggggaagggggcgtggggaggtggggtcttcgtagtttattaggtggtaggtggtagtagcacagtattacgcacgactccgtaggaacgggtcccgttacaccatcctaccagacgaacaacttacccaaacacgacacgtcttagttatttgacctaacatacgaaacacgacctaggaacgacggaccgaacggaccgaaccggacctaagttacttagttagttgtacgtacgttaaaaccgttttccgttttaggaacgtttcggtttaactttacccgtaccccgttaaggtaccgtacccgtaacgggtccggggacccgtaaacccgggg

SEQ ID NO: 50344 - DNA, 509 bp, Homo sapiens
  misc_feature: GYAE6OF01BLX7A.37.83.H06.1.454.CMB.1.raw
  modified_base (237)..(237): a, c, t, g, unknown or other
  misc_feature (237)..(237): n is a, c, g, or t
  modified_base (501)..(501): a, c, t, g, unknown or other
  misc_feature (501)..(501): n is a, c, g, or t
  modified_base (506)..(506): a, c, t, g, unknown or other
  misc_feature (506)..(506): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttctttagcttggtaccagcagaaaccacgacagcctcctaagctgctcgtttactggcctctacccgggaatccggggtccctgaccgattcgagtggcagcgggtctgggacagatttcactctcacatcaacagcctgcaggctgaggatgtggctatttatactgtcagctatattataattactcctcgacgttcgccgaaggaccaaggtcgaaatccaaacgtactgtagctagcacntcgtnttc

SEQ ID NO: 50345 - DNA, 733 bp, Homo sapiens
  misc_feature: GYAE6OF01CGFB9.37.83.H06.1.454.CMB.1.raw
  modified_base (248)..(248): a, c, t, g, unknown or other
  misc_feature (248)..(248): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgccgtacggggacatcgtgatcgacccagtcctccagacctccctggctgtgtctcgtgggcgaggacgggcccagatcaactgacaagtccaggccggtagttgtttanaacaactacaaagaataagagttcttagcttaggtaccagacaacgaaccacgacacgacctacctaagctgtcttcgtttacgtcgggtcctaccggtaacccgggtaacgtcccggggtaccctaggaaccgtattcgaggtcgggcggtcgggtcgtagggaactacggtactttacgacttccgaccaacctataccgaacggtccgaaccggtcccgttcgggaccgggtaccgtaaggtaaacggtaacggttgggtttacggggttacggttttaacgttacgttcggtacgtaacggtaccgttaaggttaactttaacgttacgtttacccttaccgttaccgttaaccgtttacgggttttacggaacccgggtaacggggtaaccgtaacggtaccggtagggtaacgtacgtaccggtaccgtaacggtaaccggttcggtacggtccgtacgtaccctaaccgtacttccgg

SEQ ID NO: 50346 - DNA, 646 bp, Homo sapiens
  misc_feature: GYAE6OF01D1WGW.37.83.H06.1.454.CMB.1.raw
  modified_base (300)..(300): a, c, t, g, unknown or other
  misc_feature (300)..(300): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggtctttttcttgtggctaattttaaaaggtgtccagtgtgaggtgcagctgctggagtcgtgggggaggcttggtacgaggccgggggggtccctgagactctcctgtgaagcctctggattcacctttgacaagtgtgccatgacctgggccnccaggctccgaggggaaggggctgggagtgggtctcgtagttataggtggtagtggtagtagcacagattacgcagactccgtggaacgggtccgttcaccatcctaccaagaacgactaacttaccaaacgacgccaccgtcttgttactttcggaccaacattacgaaacaggtccctaggaacggacggacccgggaagggaaccgacgggaccctaattacttaattagtttgtacggtaaccgttaaaaccttttccgttttaggaccgtttaggtttaacttaccgttacccccgttaaggtaccgaacccgtacggttcgggggcccctaaaccggggg

SEQ ID NO: 50347 - DNA, 922 bp, Homo sapiens
  misc_feature: GYAE6OF01BUUW1.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggtcttttcttgtggcttaatttaaaaggtgtccagtgtgaggtgcagctgctggagtcgtgggggaggtcgttggtacgacgggcccgggggggtccctggacgtacctccgtcccttggtacgaacgtcccttcgtgggtactttcctacccgttttagaacctaaggttcggtcgcctaagtcggacccgttcggggtccccgccgaacgggcccgtaccgggaagggggtaacgggggccttagggggtacggttcggggtccttacgtaaggttttagtttaagggttgggttaaggttagggttaaggttaacggaccgtaaccgtaaggtaacgtttaaccggacgtaacggtacccgttaccggggtagggtaaaccggggggttccccgtttaccaaacccgttacgttacccgttacccgaaaggtaacgtaaacccttaaaccgttaccccgaaaacgacggaccgtaaccgtcctttaaggttacgttttaccgacctaacgtaacgttaacgaaaccgaccggtaccgtaaggaaccggtaacgggacccggaaacgggacccaaccgggtacccttaagtttaaacgttaattttacggttcggttaccggttaaaacccgtttaaaaccgtttttcccggtttttaaggaccggtttttaaagggtttaccctttaaaccccgtttacccccgggttaaggttaacccggtaacccggtacccggggttaccggggggtaaccccgttaaaaccccgggggg

SEQ ID NO: 50348 - DNA, 778 bp, Homo sapiens
  misc_feature: GYAE6OF01DE4I1.37.83.H06.1.454.CMB.1.raw
  modified_base (225)..(225): a, c, t, g, unknown or other
  misc_feature (225)..(225): n is a, c, g, or t
  modified_base (262)..(262): a, c, t, g, unknown or other
  misc_feature (262)..(262): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtgtcgttttctagtggtctaattttaaaaggtgtcagtgtgagtgcagctgcgtggagtcgtgggggagcgttggtacgnggccggggggtccctgacgctctcctgtgaagtcctntggattacacctttagacaagtgtgaccatcgaccgtcggtccgcgaggccgtaccgagggaagggctgggagtggtctagtagtttattaggtgtaaggttggtacgtagcaacgaagtacgttacgcgtaacgtaccttaccgggtacgggtaaaccgggggttcccggtttaaccaaccccgtaattccccgtaacccgaaggtaaccggaacctaaacgtttaaccccaaacgaaccgaccgtaaccggtaccgttaggtttaacgttttacggacgaacgtaacttacggtaaaccgacggtaccgttaggaaaccgacgggacccggaacggaaccgacccgggtaaccctaattaagttaattttaacgtttaggttaccgtaaccgtttaaacgtttttccgttttaacgttaccgttttaacgggttttaacctttaaccgtttaccccgttaacggtaacccgtaacccggtaccgtttacccgggggacccggttaaacccgggg

SEQ ID NO: 50349 - DNA, 713 bp, Homo sapiens
  misc_feature: GYAE6OF01EV23K.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggtctttttcttgtggcttaattttaaaaggtgtccagtgtgaggtgcagctgctggagtcgtgggggaggcttgggtacgaggcccgggggggtccctggacgactctccgtgtgaagcctctggacttcacctttgacaagtgtcgccatcgaccgtgggtcccgccgaggcctccggaggggaacgggggcgtgggaggtgggtctcgtagttagttagtggtagtggtagtagacacgagacttacgcagtacgtccggtaggaaacggggcccgtttacaccgtacgtctacccgaagaacgtaactaaacttacccaaacgacgaccgaaccgtcttagttacttttcgacctaacgtaatacgaaacgacgtacccgtagaacggaacggacccgggaacgggaaccgaaccgggacctaagttaacttaagtttagttagttacgtaaccgttaaaacccgtttttccgttttacgtaccgtttggtttaacctttaccgttacccccgtttaaggtacccgtaacccgtaccgggtcggggtaccccgtaaacccgggg

SEQ ID NO: 50350 - DNA, 522 bp, Homo sapiens
  misc_feature: GYAE6OF01EF0M2.37.83.H06.1.454.CMB.1.raw
  modified_base (238)..(238): a, c, t, g, unknown or other
  misc_feature (238)..(238): n is a, c, g, or t
  modified_base (518)..(518): a, c, t, g, unknown or other
  misc_feature (518)..(518): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttctttagcttggtaccagcagaaaccacgacagcctcctaagctgctcgtttactgggcctcgtacccgggaatccggggtccctagaacgattcgagtcggcggcgggtctgggacagtactttcactctcaccatcagcagcctgcggctgaagatgtggtcgtttattactgtcagctagtattatgttacctctctactagtttcgccgtagggaccaagcgtggagtatcgcgacgaactggtcgctgactccgntccg

SEQ ID NO: 50351 - DNA, 571 bp, Homo sapiens
  misc_feature: GYAE6OF01CCGXV.37.83.H06.1.454.CMB.1.raw
  modified_base (298)..(298): a, c, t, g, unknown or other
  misc_feature (298)..(298): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtggcttttcttgtggctattttaaaaggtgtccagtgtgaggtgcagctgctggagtcgtgggggaggcttggtacaggccgggggggtccctgagactctcctgtgaagcctctggattcacctttgacaagtgtgccatcgactgggtccncaggctccgagggagggctggagtggtctcagttatagtggtagtggtagtagctacagattacgcagactcgtggaagggccgttacaccatctccagagacaactccaacagcacgctgtatttgcactatcgaacagccgtgacgacgccgaaggaccgacggccaagtatattagttgtacgtacgtaaaccgtttccgttttagactttcggttactttaccgttccccttacgtacgtaacccgtacgtcggggcccgtaaccgggg

SEQ ID NO: 50352 - DNA, 547 bp, Homo sapiens
  misc_feature: GYAE6OF01AKINP.37.83.H06.1.454.CMB.1.raw
  modified_base (229)..(229): a, c, t, g, unknown or other
  misc_feature (229)..(229): n is a, c, g, or t
  modified_base (401)..(401): a, c, t, g, unknown or other
  misc_feature (401)..(401): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctaccaacaataagaactacttagcttaggtatcagcagaaaccagggcagacctacctaaactgctacatttacgtggcagtccgtacccgggagtcccggggtccctgaccgtattcgagtggcgaggcgggtctgggacagtactttcgactctcaccatcaacncgcctgacaggctgagatggtgcgtatttatactgtcagctagtattataactctcctacgtacgttccggacaacgggtaaccaagggtacgaaactaccgaaacgtacgttcggtagcgtacgacctacgacttcgtcgttacc

SEQ ID NO: 50353 - DNA, 544 bp, Homo sapiens
  misc_feature: GYAE6OF01B2VBJ.37.83.H06.1.454.CMB.1.raw
  modified_base (440)..(440): a, c, t, g, unknown or other
  misc_feature (440)..(440): n is a, c, g, or t
  modified_base (527)..(527): a, c, t, g, unknown or other
  misc_feature (527)..(527): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtcgtgggggaggcttggtacaggccgggggggtccctgagactctcctgtgaagcctctggattcacctttgacaagtgtgccatgacctgggtccgccaggctccgaggggaggggctggagtgggtctcgagttattagtggtagtggtagtagcacgagattacgcagactccgtgaagggccgttcaccatctccagagacaattccaacagcacgctgtatttgcacatgaacngcctgagacgccgaggacacggcagtatattattgtgacgtaaactttcctttagacgttggttacttacttcccctagtcgaaccncgtggggccctaacggg

SEQ ID NO: 50354 - DNA, 793 bp, Homo sapiens
  misc_feature: GYAE6OF01B8DHB.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtggtctttttcttgtggcttaattttaaaaggtgtccagtgtgaggtgcagctgctggagtcgtggggagcttgggtacgaggccggggggtccctggacgacctctccgtgtgaacgcctgtggtattcctacctttgaacaagtgtcgacctagtcgaccgttcggggtccccgaccgtacggccgtaccggaagggggtaacggggtccgtagggtacgggttcgggttctacgtaaggttttaagtttagggtggttaaggtgggttaacgtagaccaacgtaagtacgtttaacgacgtaagtacccgttaccggtagggaaaccgggtcccggttaccgtaaaccgtactcccgtacccgaaggtaacgtaaaccttaacgttacccaaacgacgtaccaacgtcttacgttactttagacctaaatagtaacgtaaccaaggtcctaggaacggaacggacccggtaacgggacccgaacggtacctaagttaacttaagttcgttaggtaccgtaaccgtttaaaaccgttttccgttttaaggaccgtttttagggtttaaccctttacccgttaaccccggtttaggtaacccgaacccggtttaccgggtccgggggtaaccccgttaaaacccggg

SEQ ID NO: 50355 - DNA, 634 bp, Homo sapiens
  misc_feature: GYAE6OF01A1ZD5.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtgtcgttttctagtggctattttaaaaggtgtcagtgtgaggtgcagctgctggagtcgtgggggaggcttggtacaggccgggggggtccctgagactctcctgtgaagcctctggattcacctttgacaagtgtgccatgacctgggtccgccaggctccgaggggaacgggctgggagtgggtctctagttattagtggtagtggtagtagcacagtattacgcagactccgtaggaacgggtccggttacaccgtatcctaccgaagacgaactaacgttacccaaacgagccaacggtccttagttatttcggactaacctagtacgaaacgacgtacccgtaggaacggacggacccggaacggtaaccgaccggtacctaagtacttagttacgttgtacgtaccgttaaactttccgttttagactttggttacttacctccccgttagtccgaacccgtacggtggggcccgtaaccggg

SEQ ID NO: 50356 - DNA, 614 bp, Homo sapiens
  misc_feature: GYAE6OF01EN22X.37.83.H06.1.454.CMB.1.raw
  modified_base (177)..(177): a, c, t, g, unknown or other
  misc_feature (177)..(177): n is a, c, g, or t
  modified_base (304)..(304): a, c, t, g, unknown or other
  misc_feature (304)..(304): n is a, c, g, or t
  modified_base (335)..(335): a, c, t, g, unknown or other
  misc_feature (335)..(335): n is a, c, g, or t
  modified_base (426)..(426): a, c, t, g, unknown or other
  misc_feature (426)..(426): n is a, c, g, or t
tcagtagtgtagatcacgaccggtgctcgatttagatcacgtgcgtcgcgggggagagaggagcccagccctgggatttttcaggtgttttcatttggtgatcaggactgaacagagagaactcaccatggagtttgggctgagcggtgtgtttctaggtcggctaatttaaaaggngtcagtgtgaggtgcagctgctggagtcgtggggaggcttggacgaggccggggggtccctgacgactctcctgtgaagcctctggacttcacctttgactaagtgtgccaatcgaccgttgggccnccgaggctccggaggggaaggggcctggggngtgggtcctgtagtttagttaggtggtaagttggtagtagcaagagtattacgcagcctccggtggaacgggtccgttaccacctattccnccgagacgaacctaattccaacacgacacgattgtatttcgcaacatcgaacacgtccgtagaggacgaccgaggaccaccggaccagtattattacttgtagtacgttaactttccgtttagacgtttgttacgtttaccttacccgtacgttacgtaacccgtacggtacgggccgtaaacccggg

SEQ ID NO: 50357 - DNA, 778 bp, Homo sapiens
  misc_feature: GYAE6OF01EG7OJ.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggtctttttcttgtggcttaattttaaaaggtgtccagtgtgaggtgcagctgctggagtcgtgggggaggcttgggtacgacggccgggggggtccctgagactctcctgtgaagcctctggattctacctttgactaagtgtcgccatcgaccgtgggtcccgccgaggcctccggaggggaacggggcgtgggaggtgggtctcgtagtttattaggtggtagtggtagtagcaacgtagtattacgcaagtaccgtccggtaggaacgggtcccggtttaccaacccgtacttccgtacccgaaggaaccggtaaacctaaacgtttaaccccgaaacgtaacgacccgtaaccgtccgtttaggtttaacttttcggaactaacctaagtacggaaaccgacgcccgttaggaacggtaaccggacccgggaacgggtaaacccgaccggtacccgtaatttaacgtttaacgtttaaggtttacggttaccgtaaacccggtttaaacccgtttttccgtttttaacgtaaccgttttacggttttaaactttaaccctttacccccggtttaacggttaccggtaaccccgttaacgggttcccggggacccggtaaaccccgggg

SEQ ID NO: 50358 - DNA, 543 bp, Homo sapiens
  misc_feature: GYAE6OF01AGNLR.37.83.H06.1.454.CMB.1.raw
  modified_base (309)..(309): a, c, t, g, unknown or other
  misc_feature (309)..(309): n is a, c, g, or t
  modified_base (403)..(403): a, c, t, g, unknown or other
  misc_feature (403)..(403): n is a, c, g, or t
  modified_base (420)..(420): a, c, t, g, unknown or other
  misc_feature (420)..(420): n is a, c, g, or t
  modified_base (510)..(510): a, c, t, g, unknown or other
  misc_feature (510)..(510): n is a, c, g, or t
  modified_base (531)..(531): a, c, t, g, unknown or other
  misc_feature (531)..(531): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctaccaacaataagaactacttagcttggtatcagcagaaccagggcacgcctacctaaactgactacatttacgngggctatccgtaacccgggacggtcccggggtccctggaccgattccaggtcggcaggcgggtcgtgggacagtacttcactctcacatcaacngcctgcaggctagaggntggtgcgtattattctgtcagctaatacttataactctcctaccgagttccggacaagggtacccaagggtacggaaatcgaaaacggtncggtacgacctgacctaaccntccgttgtaccc

SEQ ID NO: 50359 - DNA, 264 bp, Homo sapiens
  misc_feature: GYAE6OF01B5C5A.37.83.H06.1.454.CMB.1.raw
  modified_base (253)..(253): a, c, t, g, unknown or other
  misc_feature (253)..(253): n is a, c, g, or t
  modified_base (259)..(264): a, c, t, g, unknown or other
  misc_feature (259)..(264): n is a, c, g, or t
tcagtagtgtagatcacgaccggtgctcgatttagatcacgtgcgtcggcgggtctgggacagatttcactctcaccatcagcagcctgcgggctgaagatgtggcggttttattactgtcagcagtattatgttactcctcactagttttggccaggggaccaagctggagatcgcacgaactgtggctgcaccatctgtcttcatcttcccgccatctgaatctacactactgagcgggctggcaaggcgnagtagnnnnnn

SEQ ID NO: 50360 - DNA, 571 bp, Homo sapiens
  misc_feature: GYAE6OF01BQRLZ.37.83.H06.1.454.CMB.1.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttcttagcttggtaccagcagaaaccacgacacgcctcctaagctgctcgtttacnggcctcgtaccgggatccgggtcctgaacgtattcgagtcggcggcgggtcgtgggacagtactttcactctcaccatcagcagccgtggcggctagaagtagtggtggtcgtttattacgtgtcagctagttatttattcgttaccttccttactacgttaggttttcggaccggtagggaacccgtaggtcgtaggtacgtacgtcggaccgaaccggtaacgttcggtcggtaccgtcgaccaccgtagttcccg

SEQ ID NO: 50361 - DNA, 550 bp, Homo sapiens
  misc_feature: GYAE6OF01CULKF.37.83.H06.1.454.CMB.1.raw
  modified_base (445)..(445): a, c, t, g, unknown or other
  misc_feature (445)..(445): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggtctttttcttgtggctattttaaaaggtgtccagtgtgaggtgcagctgctggagtcgtggggggaggcttggtacgaggccgggggggtccctggagactctcctgtgaagcctctggattcacctttgacaagtgtgccatgacctgggtccgccaggctccgagggaaggggctggagtgggtctcagttattagtggtagtggtagtagcacagattacgcagactccggtgaacgggccgttcaccatctccagagacaattccaacagcacgctgtatttgcacatcgaacncgcctgaagacgaccgaggaccacggccatatattattgtcgactaaactttcctttgacttgttacttactcccctagtcgacccacgtcgggcctaaccgggg

SEQ ID NO: 50362 - DNA, 756 bp, Homo sapiens
  misc_feature: GYAE6OF01A273I.37.83.H06.1.454.CMB.1.raw
  modified_base (322)..(322): a, c, t, g, unknown or other
  misc_feature (322)..(322): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctggtgcctacggggacaccgtgatgacccagtctccagactccctggctgtgtctcgtgggcgagacgggcctccatcaactgcaagtccagccagacttgttttactacagcctaccaaacaataacgaactacttagcttggtatcgagacaagaaaccagggacacgccctacctaaactcgactctatttacngggcactccgtacccgggacggtcccggggtcctggaccgtattcgaggtcggcgaggtcgggtcgtggactagtatttccacttcctacaccctatacccgaaacacgtcccgtagacgtacgggtaccgtacgggaagggtagttacgggttacgggtaccggttttaaattttaacgtttaacgttcggttaccgtaacggttaacgttaacggtttaacttttaaacgttaaacctttaccccgtttaccccgttacccgggtaaccggtttacccgggaaccccggttaaaacggggaacccggttaaaaaggggttaaccggtaaaaacgttaacccggtaaaaaccgggttaacccggttaggggttacccggaaccgttaacggtaccccttaaccgtaacggtttccgttaccgggttttaaccc

SEQ ID NO: 50363 - DNA, 258 bp, Homo sapiens
  misc_feature: GYAE6OF01CLTP8.37.83.H06.1.454.CMB.1.raw
  modified_base (249)..(249): a, c, t, g, unknown or other
  misc_feature (249)..(249): n is a, c, g, or t
  modified_base (255)..(258): a, c, t, g, unknown or other
  misc_feature (255)..(258): n is a, c, g, or t
tcagtagtgtagatcacgaccggtgctcgatttagatcacgtgcgtcggcgggtctgggacagatttcactctcaccatcagcagcctgcggctgaagatgtggcggtttattactgtcagcagtattatgttactcctcacagttttggccaggggaccaagctggagatcgcacgaactgtggctgcaccatctgtcttcatccttccgccatctgaatctacactactgagcgggctggcaaggcncatagnnnn

SEQ ID NO: 50364 - DNA, 690 bp, Homo sapiens
  misc_feature: GYAE6OF01B2NIQ.37.83.H06.1.454.CMB.1.raw
  modified_base (442)..(442): a, c, t, g, unknown or other
  misc_feature (442)..(442): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggtctttttcttgtggtcttaattttaaaaggtgtccagtgtgaggtgcagctgctggagtcgtgggggaggtcttgggtacgaggccggggggtcctggagacctcctcctgtgaagcctcgtggacttcctaccttttgactaagttgtgcctagtcgaccgtcgggtcccgccgacggcctccggaaggggaacggggcgtgggaggtcgggtctacgtagtttagttaggtggtaggttggtagtagcagagtattacgcagactccgtaggacgggtccgttcaaccatccnccaagacaactaacttccaaacacgacaccgtcttagttacttcgactaacctatacggaacacgtacccgtaggaacgacggacccgaacgggaccaccgggtacctaagttacttaagtttagttgttacggtaacccggttaaaactttttccgttttaggtaccgtttacggttttacttaacccgttaccccgttaacggttaccggacccgttaccggtccggggtacccgtaaacccgggg

SEQ ID NO: 50365 - DNA, 668 bp, Homo sapiens
  misc_feature: GYAE6OF01CSJEP.37.83.H06.1.454.CMB.1.raw
  modified_base (535)..(535): a, c, t, g, unknown or other
  misc_feature (535)..(535): n is a, c, g, or t
  modified_base (652)..(652): a, c, t, g, unknown or other
  misc_feature (652)..(652): n is a, c, g, or t
tcagtagtgtagatcacgaccggtgctcgatttagatcacgtgcgtcgcggggacaacaggcaggcaggggcagcaagatggtgttgcagacccaggtcttcatttctcttgttgctctggatctcttgttactacagggtcgccgtacggggacatcggtgatcgacccagtctccagacctcccgtggctgtcgtctcggtgggcgaggacgggaccacgatacaactgacaacgtccgaggccggtagttacgtttaacaactaacctacaaagtaaataaggttagtttacttaggtcgttacggtaccaaggacaaacgaaaccagtacgaacctacgtacctaaccgtaacgcctcggtaccgtttaccggtttacggtccgggtaccccgtaccgggtaaccccgggtaacggttccccggggtaacctacggaacgtacttcggacggtacggggcggtacgggtcgtacgggactacgtacgtttcacctcacgacccagtacaacgacgctgcgagtgacggagngtcggtagtacttaatttactcgtgtagactacgtaattaataactaacgtcctccggtacgtacggtacgaccggaaggaaccgtaaggacgtaaacacgaagtcgtggcgcgacnccaatctcgttgtacc

SEQ ID NO: 50366 - DNA, 750 bp, Homo sapiens
  misc_feature: GYAE6OF01BVPXC.37.83.H06.1.454.CMB.1.raw
  modified_base (247)..(247): a, c, t, g, unknown or other
  misc_feature (247)..(247): n is a, c, g, or t
  modified_base (329)..(329): a, c, t, g, unknown or other
  misc_feature (329)..(329): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagacctccctggctgtgtctcgtgggcgaggcgggccagatcaactgacaacgtccaggtccggtagttgttttaanacaactaccaagaataagtagtttcttagcttacggtaccagacaagaaaccacgacacgcctactaagctgtctcgttacncgggcctcgtaacccgggtacgtcccgggtcctaggaacgtgttcgaggtcgggcggtcggtcgtagggacacggttactttccaaccgttccgtaccaacccgtagttaccgaaccggtccgaaccgtccgtacgggtccgggaaccttagggaaacggtgttcgggttacgggttacggttttaacttacggtcgtaccgaagtccgttaagtttagttaacgttacgtttaacccgttacccttacgttaaaccggtttggttttaccggggaacccggtaaacgggggtaaacccgttaacggggtacgttaacggggaaccgttaccggttacccgggtaaccgtaaacccgggttaacggttacgggtaccgggttacctaacggtaccccctaaaccggttacgtttaacccgg

SEQ ID NO: 50367 - DNA, 825 bp, Homo sapiens
  misc_feature: GYAE6OF01DE2ML.37.83.H06.1.454.CMB.1.raw
  modified_base (240)..(240): a, c, t, g, unknown or other
  misc_feature (240)..(240): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatcgacccagtctccagactccctggctgtgtctcgtgggcgagagggccagatcaactgacaagtccagccggagttgtttanacactccaaacaataagaactacttagcttaggtatcagacaagaaccagggacacgcctacctaaaactcgacctctattttacgagggtactaacgtcccgtaaccccgggggtacggttccccgggggttaccccttaggtaaccccggtacgttttaccgaacgggttcggggaccgtaacggggtcccgggggttacttacgggggggtaaacctaaggttaaccttttttacccgaaccctttcctaacccgtaaacccctacgttaaccccaaaaccgtaccggtacccgttacggaccgtaacggggtcccgttagggtaacgggtaagttcgggtacgggtacggtttaaactttttacggttaaccgttcggttaacgaacgtaaccgttaaacgggtttaatttaaacgttaaactttaacccgttaccccgttacccgggttaaacccggtttccggggaaacccgtaaaacgggggtaacccgtaaaagggggttacggaaaaacttaacccgaaaaaccgggtacgttacggttacggtaacgttacggaaccctacccgttagttacccg

SEQ ID NO: 50368 - DNA, 882 bp, Homo sapiens
  misc_feature: GYAE6OF01DAG1O.37.83.H06.1.454.CMB.1.raw
  modified_base (119)..(119): a, c, t, g, unknown or other
  misc_feature (119)..(119): n is a, c, g, or t
tcagtagtgtagatcacgaccggtgctcgatttagatcacgtgcgtcgcggggacaacaggcaggcaggggcagcaagatggtgttgcagacccaggtcttcatttctcttgtgctcgngtactctcgtctacgacgaggtcgaccgtacggactgtcgtagactacgacctcgtccacgacgtccgtccgtggtcttgtcgtcgtcggtcgggacggacgggtaccggtccctacgtaacgtaacctaacgtacgaaccgtaccgtaccgaacgtaccgttaacgtttacttttacgttttacaaccgtaccgtaaccctaaaacctaaaaacgttaaacgttaaaccgttaacctttaacggttacgttacggtttacggtaactaccgaagtaaaccgaaaccggaaaccggcggaacctaccgttacccttaaactacgtcgtacctttacgttacgttacggcggtacctaccggttacccgggtacccggtccgggttacccggtacctaggtacccgttagtacggtacgcgggtacgtaacggggtccgggttagaccggtaacgttacgtttaccctttacgaccccgttacctacccgtaaccgttaaccgaacgtaacccggtcgtaccgtacggtccgacgggtacgttacgggacggtttacgttcgggtacgtttacttttaaaggttttacccgtgtacgtaccgtacggttaatttaacgtttaatttaaccgtacccgttccggttaccccggttaacgggaccccgttaacgggaaaccgggttaaacggtaacggttaacggttaaaccgtaaacgaaaccgttaacggttacgtccgggttacaaccggtctacccggtaac

SEQ ID NO: 50369 - DNA, 649 bp, Homo sapiens
  misc_feature: GYAE6OF01CHGF2.37.83.H06.1.454.CMB.1.raw
  modified_base (242)..(242): a, c, t, g, unknown or other
  misc_feature (242)..(242): n is a, c, g, or t
  modified_base (323)..(323): a, c, t, g, unknown or other
  misc_feature (323)..(323): n is a, c, g, or t
tcagtagtgtagatcacgaccggtgctcgatttagatcacgtgcgtcgcggggacaacaggcaggcagggacagcaagatggtgttgcagacccaggtcttcatttctctgttgctctggatctctgttactacaggtgcctacggggacatcgtgatgaccagtctccagactccctgctgtgtctcgtgggcgagagggccacgatacaactgacaagtccgagccggtagtgttttaanacaactccaaagaataagtagttcttagcttaggtaccagacaagaaccacgacacgcctacctaagctgcttcgtttacngggtcctacgtacccgggatcccggggtcctagaaccgtattcaggtcggacgggtcgggtacgtgggactagtacgtttaccacttcaccgtaccatcacggtaccacggtcccgtggccgggtactacggaaaggtagttacgggtacgggttacgggttttaagtttacgttcggtacgaacgtacgttaagttatttagtttacgtttacctccgtacttacgttacggtttcggaccggtaacgggtaaccgaaggtcgtaggacggtagtccggtaccgaaaccggtaacgtcggtacgacgtgtacctaccgtagttcg

SEQ ID NO: 50370 - DNA, 712 bp, Homo sapiens
  misc_feature: GYAE6OF01CTQ7I.37.83.H06.1.454.CMB.1.raw
  modified_base (173)..(173): a, c, t, g, unknown or other
  misc_feature (173)..(173): n is a, c, g, or t
tcagtagtgtagatcacgaccggtgctcgatttagatcacgtgcgtcgcgggggagagaggagcccagccctgggtattttcaggtgttttcatttggtgatcaggactgaacagagagaactcaccatggagtttgggctgagcgtgtgtttctagtggctagtttaaaggntcagtgtgaggtgcagctgcgtggagtcgtgggggaggcgttggtaacgcgggcccggggggttccctggacgtacctcctccgtgtaggacgtcctctcggattctccgttagaactaagtgtgacctatccgtaccgtcgggtcccgccgaaggtccgtaccggaaggggtacgggcggtggacggttgggtctacgtaagtttagttagtggtagtggtagtagacagagtacgtaacgtcaacgtactcggtaggacggtcccggtacacgctcgtacgagacgtaactaaccttacaaacacgaccgaaccgtcttacgttacgtttcgacgtaacctagtacggaacctacgacgttaggaccgaaacggccggaacggtacggaccgtaactaacgtactaagtttgtaggtaccgttaacgttaacccgttttaccgttagttaaccggtttgttttaacgttacccggtttaccccgttagtaacccggtacccgtaccgggtacccggggtaccggttaaaccccgggg

SEQ ID NO: 50371 - DNA, 804 bp, Homo sapiens
  misc_feature: GYAE6OF01DXDCG.37.83.H06.1.454.CMB.1.raw
  modified_base (245)..(245): a, c, t, g, unknown or other
  misc_feature (245)..(245): n is a, c, g, or t
  modified_base (259)..(259): a, c, t, g, unknown or other
  misc_feature (259)..(259): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgccgtacggggacatcgtgatgacccagtctccagctcccgtggctgtgtctcgtgggcaggacggccaacgatacaactgacaagtccaggccggagttgttttanacagcctaccaaanaaataagaactacttagcttaggtatcagcaagaaaccgagggcagaccctacctaaaactgactactaagttttacgagggtacaacgttaccggtaacccggggtaggtccccgggggtaccctacggtaaccgtattccgtaaggttcggacgtacggtcggggtacgttaggggaacctaggttaacgtttttcccgaaacctttcccgtaacctaacccgtaacgttacccgaaaaaccgtaccggtaaccccgttacgggaacccggtaaacggggttccgttaagggaagggtaaacgttcggggttaacgggttaaccgtttaagtttttaaacgtttaaccgtacggtttaccgaaacgtaaccgttaaaggttaaactttttaaactaaaccgtacccttacccggtaacccggtaaccggtttacccggaaccccggtaaaagggaacccgtaaaggggtaacggaaaacttaaacccgaaaacggtaaccgttacgggtacgggaacgtttacgaaccgtaacccggttaaac

SEQ ID NO: 50372 - DNA, 267 bp, Homo sapiens
  misc_feature: GYAE6OF01AWYEH.37.83.H06.1.454.CMB.1.raw
  modified_base (219)..(219): a, c, t, g, unknown or other
  misc_feature (219)..(219): n is a, c, g, or t
  modified_base (260)..(267): a, c, t, g, unknown or other
  misc_feature (260)..(267): n is a, c, g, or t
tcagtagtgtagatcacgaccggtgctcgatttagatcacgtgcgcgcgggtctgggacagatttcactctcaccatcagcagcctgcaggctgaggatgtggcgatttattactgtcagcagtattataatactcctccgacgttcggccaaagggaccaaggtggaaatcaaaacgaactgtggctgcaccatctgtcttcatcttcccgcatctanaatctacactactggagccgggctggcaaaggcgacatagnnnnnnnn

SEQ ID NO: 50373 - DNA, 624 bp, Homo sapiens
  misc_feature: GYAE6OF01EH4DK.37.83.H06.1.454.CMB.1.raw
  modified_base (260)..(260): a, c, t, g, unknown or other
  misc_feature (260)..(260): n is a, c, g, or t
  modified_base (277)..(277): a, c, t, g, unknown or other
  misc_feature (277)..(277): n is a, c, g, or t
tcagtagtgtagatcacgaccggtgctcgatttagatcacgtgcgtcgcgggggagagaggagcccagccctgggatttttcaggtgttttcatttggtgatcaggactgaacagagagaactcaccatggagtttgggctgagcgtgtcgttttctagtgctattttaaaaggtgtcagtgtgaggtgcagctgctggagtcgtgggggagcttggtacaggccgggggggtccctggagactctcctgtgaacgcctntggacttcacctttganaagtgtcgccattcgaccgtgggtcccgccagggcctccggaggggaaggggctgggagtgggtctgaagtttattaggtggtagtggtagtagacagagtattacgcagacgtccgtagaacgggtccgttcaaccatccgtacagacgaacaacttaccgaaacacgaccacgtacgtagtacgtttgacctaacatacgaacacgcgtagagacgccggagacacggacacgttataagttaagtttgacgtacgttaaaccgtttccttttataacgtttcggtttaacttaccgttacccccttaggtaccgaccgtaaccgggtcggcccggtaacccggg

SEQ ID NO: 50374 - DNA, 619 bp, Homo sapiens
  misc_feature: GYAE6OF01CGCGF.37.83.H06.1.454.CMB.1.raw
  modified_base (173)..(173): a, c, t, g, unknown or other
  misc_feature (173)..(173): n is a, c, g, or t
  modified_base (186)..(186): a, c, t, g, unknown or other
  misc_feature (186)..(186): n is a, c, g, or t
  modified_base (192)..(192): a, c, t, g, unknown or other
  misc_feature (192)..(192): n is a, c, g, or t
  modified_base (194)..(194): a, c, t, g, unknown or other
  misc_feature (194)..(194): n is a, c, g, or t
  modified_base (196)..(196): a, c, t, g, unknown or other
  misc_feature (196)..(196): n is a, c, g, or t
  modified_base (200)..(200): a, c, t, g, unknown or other
  misc_feature (200)..(200): n is a, c, g, or t
  modified_base (203)..(203): a, c, t, g, unknown or other
  misc_feature (203)..(203): n is a, c, g, or t
  modified_base (211)..(211): a, c, t, g, unknown or other
  misc_feature (211)..(211): n is a, c, g, or t
  modified_base (219)..(219): a, c, t, g, unknown or other
  misc_feature (219)..(219): n is a, c, g, or t
  modified_base (221)..(221): a, c, t, g, unknown or other
  misc_feature (221)..(221): n is a, c, g, or t
  modified_base (232)..(232): a, c, t, g, unknown or other
  misc_feature (232)..(232): n is a, c, g, or t
  modified_base (251)..(251): a, c, t, g, unknown or other
  misc_feature (251)..(251): n is a, c, g, or t
  modified_base (253)..(253): a, c, t, g, unknown or other
  misc_feature (253)..(253): n is a, c, g, or t
  modified_base (255)..(257): a, c, t, g, unknown or other
  misc_feature (255)..(257): n is a, c, g, or t
  modified_base (284)..(284): a, c, t, g, unknown or other
  misc_feature (284)..(284): n is a, c, g, or t
  modified_base (286)..(286): a, c, t, g, unknown or other
  misc_feature (286)..(286): n is a, c, g, or t
  modified_base (289)..(289): a, c, t, g, unknown or other
  misc_feature (289)..(289): n is a, c, g, or t
tcagtagtgtagatcacgaccggtgctcgatttagatcacgtgcgtcgcggggagagaggagcccagccctgggattttcaggtgttttcatttggtgatcaggactgaacagagagaactcaccatggagtttgggctgagcggtcgtgttctaaggcgctaagttaaaggntcatgtgagtcgnagctgngngngtgnggngtgtgcgnggcggcgngngctctctgtgngcgtgtgtcgtctctagangngnnngcgacgtcgcgcgcgcgacggaggagngnggngtgtcgtagtagtagtagtggtagtagtagtagagagtacgacgtacgacgtacgtacgtacggtacggtacgtacgtacgtacgtacgtacgtacgtacgaacgaacgtaaccgtacgaacgtacgtacgtacgtacgtacgttacgtacgtacgtaacgtacgtaacgtacgtacgtacgacggaacgacggacggacgaccgtacgtacgtaagtagttacgttagttacgtacgttaaccgttaccgttacgttagttacgttaacgttaccgttacttaccgttaccgtaaccgtaccggtaccggtaccggtaccggtaaccgg

SEQ ID NO: 50375 - DNA, 743 bp, Homo sapiens
  misc_feature: GYAE6OF01C4504.37.83.H06.1.454.CMB.1.raw
  modified_base (258)..(258): a, c, t, g, unknown or other
  misc_feature (258)..(258): n is a, c, g, or t
  modified_base (295)..(295): a, c, t, g, unknown or other
  misc_feature (295)..(295): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtcgtgggggagcgttggtacgaggccggggggtcctgagactctcctgtgaagcctntggattcacctttgacaagtgtgccatgacctggccnccaggctccgagggaacggggctggagtgggtctcgaagtttattaggtggtagtggtagtagcacagtattacgcgagtacctccggtaggaacgggtccggttacaacctagtccgtccgaagtaacggactaaacgtttacccgaaacacggtaccaaccggtcgttacggttacttttacgggaccctaacgtaagtacgaaaaccgacggtacccgttagggaaacggaccggtaacccgggaacgggtaacccgaaccgggacctaacgttatttaaacgtttaacggtttacgtacggtaaccgttaaaacccgttttcccggtttttaagaacccggttttacgggtttttaaaccttttaccgtaacccccccgttttaaggttaacccggtaacccgttaacccgggttccggggggacccgttaaaaccccgggggg

SEQ ID NO: 50376 - DNA, 258 bp, Homo sapiens
  misc_feature: GYAE6OF01DQWOZ.37.83.H06.1.454.CMB.1.raw
  modified_base (255)..(258): a, c, t, g, unknown or other
  misc_feature (255)..(258): n is a, c, g, or t
tcagtagtgtagatcacgaccggtgctcgatttagatcacgtgcgtcggcgggtctgggacagatttcactctcaccatcagcagcctgcgggctgaagatgtggcggtttattactgtcagcagtattatgttactcctcacagttttggccaggggaccaagctggagatcgcacgaactgtggctgcaccatctgtcttcatcttcccgccatctgaatctacactactgagcggctggcaaggcgcatagnnnn

SEQ ID NO: 50377 - DNA, 716 bp, Homo sapiens
  misc_feature: GYAE6OF01CLYJY.37.83.H06.1.454.CMB.1.raw
  modified_base (118)..(118): a, c, t, g, unknown or other
  misc_feature (118)..(118): n is a, c, g, or t
  modified_base (162)..(162): a, c, t, g, unknown or other
  misc_feature (162)..(162): n is a, c, g, or t
  modified_base (178)..(178): a, c, t, g, unknown or other
  misc_feature (178)..(178): n is a, c, g, or t
  modified_base (317)..(317): a, c, t, g, unknown or other
  misc_feature (317)..(317): n is a, c, g, or t
  modified_base (604)..(604): a, c, t, g, unknown or other
  misc_feature (604)..(604): n is a, c, g, or t
tcagtagtgtagatcacgaccggtgctcgatttagatcacgtgcgtcgcgggacaacagggctaggcaggggcagcaagatggtgttgcagaaccaaggtcttcatttctcgtgttcncctctggatctctgttaccagaggtgccgtacgggacagttcgngactcgacccagtccnccgacgacctccgtggctggtcgtcgacgcgggcgaggccggaccacgatacaactgactaacgccgacgccggtagttactttacaacgaacgtaacaaagtaagttaaacgtggtttacgtaacgcgttacgaaccncgaaccgtaaccggaaacgacgacgtacggtacctacgtaaggccttagtaccgtttacggtttacgacgggtaccctaccgggtaacccggtaacgttcccggggtacctaaggtacgtacgttccgaaggggtcgggtccgggtacggttacgtacgggaactacggttacctttacgacccgttctaaacccgaactacgtacacggtccacggtccgaaggccggtacgtaacgaagtcgtacgggtacgttacgttaatcgtagtcgtaggtactaagtttntagttcgtaacctcgtaacgttagttaaggttccggacggtacggacgaggtcgaggacgtacggtacacgttaacgtagtcggtacggtactacgcctaacgtgttacccg

SEQ ID NO: 50378 - DNA, 622 bp, Homo sapiens
  misc_feature: GYAE6OF01E18YN.37.83.H06.1.454.CMB.1.raw
  modified_base (242)..(242): a, c, t, g, unknown or other
  misc_feature (242)..(242): n is a, c, g, or t
  modified_base (593)..(593): a, c, t, g, unknown or other
  misc_feature (593)..(593): n is a, c, g, or t
  modified_base (611)..(611): a, c, t, g, unknown or other
  misc_feature (611)..(611): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagacgggccacgatcaactgcaacgtccagccggtagtgttttanaccaactaccaaagaataacgtgtttactttagcgttaggtaccagccaacgaaaccacgacacgcctactaagctgtccgttcgtttacgcgggtcccttaccgtacccggggtacggtccccggggtacctcggaccgtatcgagtgcgaggtccgggtctggactagtctttcacttccacaccatcaacgcgtcctcggacgaggtctggacggtagtcggtacgggtcttaagttttactacgttgtacgagtactaagttaattacgtaaacttcccgtcccgtacggtaccgttaccggacgtaacgggtaaaccgaaggtacggaaaccttacgaaacgtcgnggtacgctacgactacgntttcgacttcc

SEQ ID NO: 50379 - DNA, 612 bp, Homo sapiens
  misc_feature: GYAE6OF01CUZ87.37.83.H06.1.454.CMB.1.raw
  modified_base (139)..(139): a, c, t, g, unknown or other
  misc_feature (139)..(139): n is a, c, g, or t
  modified_base (168)..(168): a, c, t, g, unknown or other
  misc_feature (168)..(168): n is a, c, g, or t
  modified_base (192)..(192): a, c, t, g, unknown or other
  misc_feature (192)..(192): n is a, c, g, or t
  modified_base (215)..(215): a, c, t, g, unknown or other
  misc_feature (215)..(215): n is a, c, g, or t
  modified_base (539)..(539): a, c, t, g, unknown or other
  misc_feature (539)..(539): n is a, c, g, or t
  modified_base (575)..(575): a, c, t, g, unknown or other
  misc_feature (575)..(575): n is a, c, g, or t
  modified_base (608)..(608): a, c, t, g, unknown or other
  misc_feature (608)..(608): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtnccgtacgggacatcgtgatgacccagtcnccagactccctgctgtgtcttcgngggcaggacggccacgatcaagngacaagtccgaggccggtattgtttaacaacaacctacgaaagtaataagtagttcttaagtcttacggtacagacaaacgaaaccacgaacacgacctacaagctcgtacctttcggtttaacgtcgggtacctaccgtaacccgggtaacgtccccggggtacctaaggaaccgtattcgaggtcgggacgggtcgggtctaggggactagtagttccacgttcacacatacgagtacagccgtaggcccggataaggaagtacgttgggtcggttacgtttatacgtgtactagactagttatagttcgttactccttacncgttagttacggaccgaagggtacagtcgtaggacncgtcgacaccgtaatgtccggactgactccgtntacg

SEQ ID NO: 50380 - DNA, 721 bp, Homo sapiens
  misc_feature: GYAE6OF01DJH3M.37.83.H06.1.454.CMB.1.raw
  modified_base (210)..(210): a, c, t, g, unknown or other
  misc_feature (210)..(210): n is a, c, g, or t
  modified_base (543)..(543): a, c, t, g, unknown or other
  misc_feature (543)..(543): n is a, c, g, or t
tcagtagtgtagatcacgaccggtgctcgatttagatcacgtgcgtcgcgggggagagaggagcccagccctgggattttcaggtgtttcatttggtgatcaggactgaacagagagaactcaccatggagtttgggctgagctggtctttttcttgtggtcttaagtttaaaaggtgtccagtgtgaggtgcagctgcgtggagtcggnggggggagtcgttgggtacgacggggcccgggggggttccctggacggacctcctccgtgtagaacgcctcgtggtacttcctacctttgactaaggtgtgccatcgaccgtgggtcccgcgacggccgtcggaggggaacggggctgggacggtgggtcctcatccaagtttacggtaagttacggttaggtaccttaacgtataactactacgacaagtacctagtaggtcggaggggtacctattaccactacgttccaaccgaaggacgaacccgaacgacccaaacgtaacctactactagtactacgtagtaactaaatcggaaacncgtaaccggtagaaacggccggtaccgggaacggtaacccggccggtacttagggttacggtttaactaccgggtttaggaccggacggtaaccgtaaccccgtccccgttaaccccgacctaaccggaccggtaccacggtaccggtaccggggtcgggttaccgttaaccccgggg

SEQ ID NO: 50381 - DNA, 561 bp, Homo sapiens
  misc_feature: GYAE6OF01CYDRU.37.83.H06.1.454.CMB.1.raw
  modified_base (293)..(293): a, c, t, g, unknown or other
  misc_feature (293)..(293): n is a, c, g, or t
  modified_base (354)..(354): a, c, t, g, unknown or other
  misc_feature (354)..(354): n is a, c, g, or t
  modified_base (447)..(447): a, c, t, g, unknown or other
  misc_feature (447)..(447): n is a, c, g, or t
tcagtagtgtagatcacgaccggtgctcgatttagatcacgtgcgtcgcgggggagagaggagcccagccctgggattttcaggtgtttcatttggtgatcaggactgaacagagagaactcaccatggagtttgggctgagctggtcttttcttgtggctatttaaaaggtgtccagtgtgaggtgcagctgctggagtcgtgggggagcttggtacaggccggggggtcctgagactctcctgtgagcctctggattcacctttgacagtgtgccatcgacctgggtcccncaggctccgaggggagggctggagtgggtctcgagtttataggtggtagtggtagtagcanagattacgcagactcggtagaacgggccgttcaccgatctaccagtacgacaacttaccaaacagcaacgtcttgttatttgcactatgaacngcctgaagcgcgaggaccacggcctaatacttattagtgtagtaccgtaaactttctttagacttcggttaattaccgtccctagtacgaccctacggtggggacctaaccggg

SEQ ID NO: 50382 - DNA, 788 bp, Homo sapiens
  misc_feature: GYAE6OF01DFX0X.37.83.H06.1.454.CMB.1.raw
  modified_base (302)..(302): a, c, t, g, unknown or other
  misc_feature (302)..(302): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggtctttttcttgtggcttaattttaaaaggtgtccagtgtgaggtgcagctgctggagtcgtgggggaggcttggtacgagggccggggggtcctgagactctctgtgaagcctctggattctactttgacaagtgtcgccatgaccgtgggtccnccgaggcctaccgaggggaacgggcgtgggagtgggtctgtagtttattaggtggtagtggtagtagcaacgagtaatacgcaagaccgtaccggtagaacggggtccgttacacctactacctaccgaagaacgacctaaacgttaacccgaaaccgtacgaccgtaacgtccgtttagtttaacgtttacggacctaaccgtaattaacggaaaacccgtacggtacccgtaacgggaacggtaaccgggtaccccggggaaagggtaaccccgaaccgggtaaccccttaaagtttaaaccgtttaagtttttaacggtttaacggttaccggttaacccggttaaaaacccctttttcccggttttttacggtaaacgttttacgggttttaaactttttaacccgttaccccccgttttaagggtacccgttaaacccggtacccgggttaccgggggtaccccggttaaaaccccggggg

SEQ ID NO: 50383 - DNA, 742 bp, Homo sapiens
  misc_feature: GYAE6OF01D44LS.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtggtcttttcttgtggctaattttaaaaggtgtccagtgtgaggtgcagctgctggagtcgtgggggaggcttggtacgaggccgggggggtccctgagactctcctgtagaagcctctggattcacctttgacaagtgtgccatcgaccgtgggtcccgccgaggcctaccggaaggggaacggggcgtagggaggtgggtctcgtagtttattaggtggtagtggtagtagcacagtattacgcagtacctcgtaggaacgggtccgttacacctatcctaccgaagacgaactaacttacccaaacgacgcaacggtcttagttatttcgacaactaagtacgaaacctacggtacccgtaggacggaacggtacccggaacggggtaacccgaacccggggaccctaagtttaacgtttaacgtttaagtttacgggttacggtaaacccgtttaaaaccgttttcccgttttttaaggtaacccggttttagggttttaaacctttaacccgtttcccccccgtttaaagggttacccgtaaacccccggtaaccgggttccggggggaacccccgttaaaaccccgggggg

SEQ ID NO: 50384 - DNA, 602 bp, Homo sapiens
  misc_feature: GYAE6OF01ENLGY.37.83.H06.1.454.CMB.1.raw
  modified_base (380)..(380): a, c, t, g, unknown or other
  misc_feature (380)..(380): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggtctttttcttgtggctaattttaaaaggtgtccagtgtgaggtgcagctgctggagtcgtggggggaggcgttgggtacagggcccgggggggtccctggacgactcctcctgtgaacgcctctggacttcacctttgacaagtgtgccatcgaccgtgggtcccgccgaggcctccggaggggaaggggcgtggagtgggtctctagttattagtggtagtggtagtagcanagacttacgcagactccgtaggaacgggtccggttacaccatcctaccgaagacgaactaacttaccaacgagaccaacgtctagtatttcgacacatacgaacacgcctaggacgacgccgaaggacacggaccatattatagttgtacgacgttaactttcgtttagtacttggttaacttacctccccgttagacaccgtacgtcgggccgtaaccggg

SEQ ID NO: 50385 - DNA, 627 bp, Homo sapiens
  misc_feature: GYAE6OF01B7PWG.37.83.H06.1.454.CMB.1.raw
  modified_base (160)..(160): a, c, t, g, unknown or other
  misc_feature (160)..(160): n is a, c, g, or t
  modified_base (174)..(174): a, c, t, g, unknown or other
  misc_feature (174)..(174): n is a, c, g, or t
  modified_base (189)..(189): a, c, t, g, unknown or other
  misc_feature (189)..(189): n is a, c, g, or t
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (270)..(270): a, c, t, g, unknown or other
  misc_feature (270)..(270): n is a, c, g, or t
  modified_base (277)..(277): a, c, t, g, unknown or other
  misc_feature (277)..(277): n is a, c, g, or t
  modified_base (290)..(290): a, c, t, g, unknown or other
  misc_feature (290)..(290): n is a, c, g, or t
  modified_base (316)..(316): a, c, t, g, unknown or other
  misc_feature (316)..(316): n is a, c, g, or t
  modified_base (322)..(322): a, c, t, g, unknown or other
  misc_feature (322)..(322): n is a, c, g, or t
  modified_base (434)..(434): a, c, t, g, unknown or other
  misc_feature (434)..(434): n is a, c, g, or t
  modified_base (438)..(438): a, c, t, g, unknown or other
  misc_feature (438)..(438): n is a, c, g, or t
  modified_base (461)..(461): a, c, t, g, unknown or other
  misc_feature (461)..(461): n is a, c, g, or t
  modified_base (475)..(475): a, c, t, g, unknown or other
  misc_feature (475)..(475): n is a, c, g, or t
  modified_base (481)..(481): a, c, t, g, unknown or other
  misc_feature (481)..(481): n is a, c, g, or t
  modified_base (490)..(490): a, c, t, g, unknown or other
  misc_feature (490)..(490): n is a, c, g, or t
  modified_base (493)..(493): a, c, t, g, unknown or other
  misc_feature (493)..(493): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcggtgtcgtttctaggngctaatttaaaggntcagtgtgaggtgcngctgctggagtgtggggnggcttggacnggcccgggggtcctggatctctcgtgtgagcctgtgtatcactttgataggtntcgactntcgaccgtggccnccgaggtccgacggaggggaacgggntagggnggtccggtgtactaggtttagttaaggtcggtaagtgggttagtacggacagtagtaacgttacgcgtaacgtccgttcggtacgggaacgggtccggttacactaactccncganacgaactaactccaaactgaccngtactattcgttanactagngtacacgancgngacgacgacgacgacgacgtactactacttagttagttacgtacgttaaccgttaaccgtttaccgtttagttacgtttacgttaccgttaccgttaccgtacgtacgtaccgtacggtccggtccggtaccgg

SEQ ID NO: 50386 - DNA, 787 bp, Homo sapiens
  misc_feature: GYAE6OF01EXGDU.37.83.H06.1.454.CMB.1.raw
  modified_base (774)..(774): a, c, t, g, unknown or other
  misc_feature (774)..(774): n is a, c, g, or t
  modified_base (781)..(781): a, c, t, g, unknown or other
  misc_feature (781)..(781): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgccgtacgggacatcgtgatcgacccagtctccagacctccgtggctgtgtctcgtgggcgaggacggccaacgactacaacgtgactaacggtccgacggtccggtagtttacgtttttaactaacctaaaccttaaccgaaaagtaaagttaaaggtacgttttaccgttttaagtccgtttacggtaaccagaccgtaaacggaaaaccccaacggaacacggtccccttaccgtaaacggtcctacggtacccgtttaccggttttaaccggtcgggtacccctttacccgggtaacccccggggttaaccggttacccccgggggttacccttaacggaaaccgttacggttaccgtaacgggttcgggggaccgggttccggggtacggttacggggtaacctaagtttaccgtttcccgaacctttcccgtacctaaccgtaacttcccgacggaccgtaccggtccggtaggggacccggtatacgggtaagtaggttcgggttacggttacggttttaataccgtcgtacgtacgtattaagttcttacgttacttacctcgtacgtcgttagttccggacgtacggacagcgtaggactaggcgtacgaagtccgtggtcgcgtanacctcgngttccg

SEQ ID NO: 50387 - DNA, 768 bp, Homo sapiens
  misc_feature: GYAE6OF01C3VOK.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggtcttttcttgtggtcttaatttaaaaggtgtccagtgtgaggtgcagctgcgtgggagtcgtggggggaggtcgttgggtacgacggggcccgggggggttccctaggacgtactcctccgtggtagaacgtcctcgtggtactttccgtaccttttggaaccaaggttcgtcggtaccctaagttcggacccgttcggggtccccggccgacgggtccgtacccgaagggggggaacggggtcgtggggtaggtcgggttactcgtaaggtttagttaggtgggtaggtagggttaagtacggcgaacgtagggtaacttacggactaaggaccgttccggtagggtaaccgggtcccggttaccaacctactccgtacgaagaacgtaacctaaacgttaccaaacaggacctaacgtcttaaggtacttgacctaacagtaaccgaacagtcccgtagaggaccgacccggaagtaccgaccggctaattagttaacgtttgtaggtaccgtaaaccggaaaaccggtcccccgtaaaaggggtccctaaccaacgggttattaacggggtacgtttaccgtttaggtaccccggtttggggaaccggggtaacccgg

SEQ ID NO: 50388 - DNA, 598 bp, Homo sapiens
  misc_feature: GYAE6OF01BWQS5.37.83.H06.1.454.CMB.1.raw
  modified_base (241)..(241): a, c, t, g, unknown or other
  misc_feature (241)..(241): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgaggagggccacgatcaactgacaagtccagccggagttgtttanacaactccaaagaataagtagttctttagcttggtaccagacaagaaaccacgacacgcctacctaagctgctcgtttactgggccctacgtacccgggtaatcccggggtcctagaacgtattcgaggtcgggccgggtcgggtcgtggggactaggtactttccacttcctccaaccgatcgacgcctacgcctgggccgggcgtaggaagtgtgtgggttacggtttattcgtgtcacgtctagttattagttcgttaccttccttactacgttaggtttcggaccggtaggggtacccaaggtccgtaggacgtagtacgcgaacgtacgtggtcggacctagcctactgtcg

SEQ ID NO: 50389 - DNA, 671 bp, Homo sapiens
  misc_feature: GYAE6OF01CVPGA.37.83.H06.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (413)..(413): a, c, t, g, unknown or other
  misc_feature (413)..(413): n is a, c, g, or t
  modified_base (422)..(422): a, c, t, g, unknown or other
  misc_feature (422)..(422): n is a, c, g, or t
  modified_base (475)..(475): a, c, t, g, unknown or other
  misc_feature (475)..(475): n is a, c, g, or t
  modified_base (496)..(496): a, c, t, g, unknown or other
  misc_feature (496)..(496): n is a, c, g, or t
  modified_base (536)..(536): a, c, t, g, unknown or other
  misc_feature (536)..(536): n is a, c, g, or t
  modified_base (580)..(580): a, c, t, g, unknown or other
  misc_feature (580)..(580): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtgttcttttcgtggtggtacttaagttttaaaggctactagtgtgaggtgcgagntgcgtaggngttcggagggggagtcgttggacgcgggggtcccgggggtcctaggacgtactccgtccgtggtacgaaccgtccgttgtaggtacttaccgtacgtttagaacgtagttgcaccagtcgaccggttcggccacgcggcctacggaaggggcggtcgtaggaggtggtctagttaagttagtaggtgtaacggtgtagagcaanaggttaacncgactaagacccgttggagggaaccggtccgttaacacctacgttcaccgganaaccgtaataacccgtcaaanacggtcaacggttcttaggttatcgaacactagaacgacngtaccgagacgacgtcgaagtaccgccgtataactattacgttntggacctaaacgttaccttttcgtagttacggttaacttacgtacccctaccgttaggccaacgggttccggtacgggccctaaaccgggg

SEQ ID NO: 50390 - DNA, 945 bp, Homo sapiens
  misc_feature: GYAE6OF01ALAD7.37.83.H06.1.454.CMB.1.raw
tcagtagtgtagatcacgaccggtgctcgatttagatcacgtgcgtcgcgggggagagaggagcccagccctgggattttcaggtgttttctatttggtgatcaggactgaacagagagaactcaccatggagtttgggctgagctggcttttcttgtggctatttaaaggtgtccagtgtgaggtgcagctgctggagtcgtgggggaggtcgttgggttaacgacgggtcccggggggggttccctgggacgtaccgttccgtacccgttggtacgaaacggtcccgttcgttagggtaacttttcccgtaaccccgtttttagaaccgtaaacggttcggtacggtaccccgtaagttacggtaacccccggttccgggggttccccggaccccgtaaggggtccccgttaccccggaagggggggttaaaccggggaccgttgggggaacggttcgggggttacctaccggttaaggtttagttagggttggggttaagtggggttaacggttacggactaaccggtaaaggttacgttaaccggacgtaacggtaaccgttcccggggttaaggaacccgggggtccccggtttacgaaccccggttatccccgttaaccgaaggttaaccgaaccgttaaacggttaccccaaacgttaaccggacccgtaaccgtacgttacggtttaacgttttacggaaccgtaacccgtaagtaaccggtaacctaccgtacccggttaggaccgtaacggacccgggtaaggaacccgtaccgggacctaacgtttaattaccgtttattacggggttaccttaacggttaaaacccgttttcccttttagggtaaccttttaggggtttaaccttaacccgtttccccgttaaggttaccttaacccggtaccgggttccgggggtaacccgtaaacccgggg

SEQ ID NO: 50391 - DNA, 681 bp, Homo sapiens
  misc_feature: GYAE6OF01CFONU.37.83.H06.1.454.CMB.1.raw
  modified_base (116)..(116): a, c, t, g, unknown or other
  misc_feature (116)..(116): n is a, c, g, or t
  modified_base (301)..(301): a, c, t, g, unknown or other
  misc_feature (301)..(301): n is a, c, g, or t
  modified_base (318)..(318): a, c, t, g, unknown or other
  misc_feature (318)..(318): n is a, c, g, or t
  modified_base (382)..(382): a, c, t, g, unknown or other
  misc_feature (382)..(382): n is a, c, g, or t
tcagtagtgtagatcacgaccggtgctcgatttagatcacgtgcgtcgcgggggagagaggagcccagccctgggattttcaggtgttttcatttggtgatcaggactgaacaganagaactcaccatggagtttgggctgagctggtctttttcttgtggcttaattttaaaaggtgtccagtgtgaggtgcagctgctgggagtcgtgggggaggcgttgggtacgacgggcccggggggggtccctggagacctcctcctgtgaagtcctctggacttcaccttttgaccaagtgtcnccatcgacctgggtccnccgaggctccgagggaaggggctgggagtggtctcgtagttattaggtggtagtggtagagcanagattacgcagacctcggtaggaacgggtcccgttcaccgactccgtaccaagacgaactaacttaccaacgacgacacgctcgtaatttcgacactagtacgaacacgtccgtagaacggtaacggcccgggaagggaaccgtaccgggaacccaagttaacttaactttacgtttaggttacgtaaccggttaaacccttttccggttttacgtaaccgtttggtttaaccctttaacgttccccccgttaagttaccggtaacccgacgggttcggggtcccggtaaaccccgggg

SEQ ID NO: 50392 - DNA, 732 bp, Homo sapiens
  misc_feature: GYAE6OF01D6FEA.37.83.H06.1.454.CMB.1.raw
  modified_base (556)..(556): a, c, t, g, unknown or other
  misc_feature (556)..(556): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacgaggtgccgtacggggacatcgtgatcgacccagtctccagctccctggctgtgtcgtcgtgggcgaggacgggccacgactcaactgacaacgtccgacggtccggtagtttagttttaacactaaactaccgaaagtaataagtacgtttactttaggtccgttaggtaccagaccaaacgaaacccacgaccaacgtccgtaccgtaagctcgtcgttacgtttacgcgggtaccctacggtaacccgggtaacgttcccggggtaccctaggaacgtacttacgagggttcgggcgggtccggttcggacggtaacgtagtacgtttcctaccttcgtaccacccgagtacgacgtccgacgtccgtacggacggtactaggtaagtggttagggttacggttacggtttaacttcgnggttacgacgtacgttaagttacgtttagttaccgttacctacttacgtacgtttcggttacgggaccgtaacggggtaacccgtagaccggtaagggtaccgtacgacggttaccggaaaccgttcggttacgggtaccggtaccgttaaccgaccctaaccgttacgtttaccg

SEQ ID NO: 50393 - DNA, 792 bp, Homo sapiens
  misc_feature: GYAE6OF01DAVBL.37.83.H06.1.454.CMB.1.raw
  modified_base (98)..(98): a, c, t, g, unknown or other
  misc_feature (98)..(98): n is a, c, g, or t
  modified_base (538)..(538): a, c, t, g, unknown or other
  misc_feature (538)..(538): n is a, c, g, or t
tcagtagtgtagatcacgaccggtgctcgatttagatcacgtgcgtcgcggggagagaggagcccagccctgggattttcaggtgttttcatttggtnatcaggactgaacagagagaactcaccatggagtttgggctggagcgtgtcgttttcgtaggtcggacttaagttttaaaaggtgtactagtgtgaggtgcagctgcgtaggagtggtggggagcgtttggaacgcgggcccggggggtccctggaacgacgtctccgtgttacgaagtcccgtgtacggtactttaccgaccttttaagaccgtaaagtcgtacgccctaagttcggtaccccgttacggggtcccccggaccgaacgggtcccggtaaccccgggaagggggaacggggtccgttaacgggtagggttcgggtacgttacgtaaaggttttaaggttaggttcgggtaagttaggttacgacgacgtacgtaagtacttacgactacgtaacgtaccggttaggaccggttaccggtaacaacccgtnttaccgaccaagaaccgtaacaaaccttaccgaaacgtacgaccacggtaccttagttacgtttacgaccctaacgtacgtaaccgaaacgaccgtacgaaggaccggaaccggaccggaacggtacccgaaggtacctagttaactttagttaaccgtggtaaccgttaaccgttaacccgtttacgtttgtaactttacgtacttaccgtacccgtagtaccgaaccgtcgggtaacggccgttaacccggg

SEQ ID NO: 50394 - DNA, 981 bp, Homo sapiens
  misc_feature: GYAE6OF01BAA84.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccatggtaggtttgggctgagtcttggttctttttcgttggtggtacttaagttttaaaaggtgtcctagttggtgaggtgcagctgcgtggaggtcggtaggggaacggtcttacgggtaacgacggggtcccgggggggtccctaggacgtaccgttccgttcccggtaggtacgtaaaccggtcccttacggtacgggttaaccttttaccctaacccgtttttaacggaaaccgttaaggttcggttccggtaaccctaaggttaccggtaaccccggttccggggggtacccccgtaccggaacggggtacccccggtaccggggaaaggggggtaccggggggtccgttagggggaacgggtttcggggttaccttacggttaaaggttttagttacgggttagggttaagggttagggtagtaacggacgtaaccggtaagttacgtacgaccgtaacggtacccgttaccggggtaaccgggtaacccgggggtcccgtttaacccgaaaccccgttagttacccccgttaacccggtaaagggtaacccttaaaacccgtaaccgttaaacccccgaaacgttacccgaaaccggttaacccgtcgtttaacggttttccgttaacggaccccgaattaaccggtacaaacccggtacgttacccgtagggaaccgtaccgggaacccggtaacgggaacctaccgggtacttaaagttacgttcttaaggttccgttaaggtaacccttttaaaccgttttcgtttaagtacggtttacgtttaaccttacccgtaccgtacggtaccgaaccgttacgggtacccgggtacccggtaaacccgggg

SEQ ID NO: 50395 - DNA, 272 bp, Homo sapiens
  misc_feature: GYAE6OF01B0HN7.37.83.H06.1.454.CMB.1.raw
  modified_base (263)..(272): a, c, t, g, unknown or other
  misc_feature (263)..(272): n is a, c, g, or t
tcagtagtgtagatcacgaccggtgctcgatttagatcacgtgcgcgcgggtctgggacagatttcactctcaccatcagcagcctgcgggctgaagatgtggcggtttattactgtcagcagtattatgttactcctcactagttttggccgaggggaccaagctggagatcgcacgaactgtggctgcaccatctgtcttcacttccttcccgcctatctagaactctacactactgagcgggctggcaaggcgacatagnnnnnnnnnn

SEQ ID NO: 50396 - DNA, 834 bp, Homo sapiens
  misc_feature: GYAE6OF01DPL8V.37.83.H06.1.454.CMB.1.raw
tcagtagtgtagatcacgaccggtgctcgatttagatcacgtgcgtcgcgggggagagaggagcccagccctgggattttcaggttgttttcatttggtgatcaggactgaacagagagaactcaccatggtagtttgggctgagcgtggtctttttcttgtggtacttaattttaaaaggtgtccagtgtgaggtgcagctgcgtggagtcggtgggggagtcgttggtaacgacgggcccgggggggtccctaggacgtaccttccttccgtggtacggaacgccttcgtggactttcctaccgtttgaacgtaaggtcgtacgaccctagtcgtacccggttcgggtcccgccgtacggccgtaccggaagggggaacggggtcggtagggtacgggtcgggttctacgtaggtttagttaggtaggttaggtggtagtacgcgaacgtagtaactacgacgagtacccgtcggacggacgggtcccgttaccacctactcctacgaagtaacgaaccctaaacttacccgaaacgccgtaccgtaaccgtactttacgtttaacctttaccggaacctaacgtacgtaacggaaacctaccggtaccgtacgaacggaacccggtaacccgggaaacgggaaccggtaaccgaaccttaagtttacgttaacggtttacggttacgttacgggttaaaccctttaaaccggttttttccgtttaacggttacggttttaccggtttaaacctttacccgttaaccccgttaacgggttacccgaaccccggttaacggggtcccggggtaaccccggtaaaccccggggg

SEQ ID NO: 50397 - DNA, 745 bp, Homo sapiens
  misc_feature: GYAE6OF01AS92N.37.83.H06.1.454.CMB.1.raw
  modified_base (526)..(526): a, c, t, g, unknown or other
  misc_feature (526)..(526): n is a, c, g, or t
tcagtagtgtagatcacgaccggtgctcgatttagatcacgtgcgtcgcgggacaacaggcaggcaggggcagcaagatggtgttgcagacccaggtcttcatttctctgttgctctggatctctgttactacaggtgccgtacgggacagtcgtgatcgacccagtcctaccagacctcccgtggtcttggtcgtccgttcgtcggggacgacggacgggccaacgtactaccgaaacgtcggaactaacggtccgaacggtccggtaagttttcgttttaaccaaaccgtaacctaaccgaaaaggtaaaacttaaggttacgttttacgtttaagtaccgtttacgggaacctaagaaccgaaacgaaaacccgtacgaaccgtacgtaccctaccgttaacgccgttacgtcctttacggtttacgcggtacccgtaccggtaacccggtacgtccggtaccagtaacgcttcgaggtcggcggtcggtcgtacggatacgtattccgaacttcacacctancgtacgcgtacgccgtggtaccggtacgtaaggacgttagtcggttacgggtttacgtttacgttacgtacgtacgtacgacgttagtttaacgttaacgttccgttaacctaccgttaacttacgttacgggttaccgacggtaaggtaaccgacggtacggtacggagtacctacggactaacggtagttcgaggtaccacgtactcgtcgttaccg

SEQ ID NO: 50398 - DNA, 828 bp, Homo sapiens
  misc_feature: GYAE6OF01DXH61.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggctttttcttgtggtctattttaaaaggtgtccagtgtgaggtgcagctgcgtggagtcgtgggggagcttggtacaggccggggggtccctgagactctcctgtgtagcctctgtaactttcccctttaggtctttagttggtatggacgcgttcggggtccccgcgaacgggccgtaccggaagggggaacggggtcgtaggggtacgggttcggggtacggacccgtaaaacgtaaggttaaaaacgaccgaaaaggagttaaggggaaaaggttaaaggaaagggtagttaagtggtaggaccttcggtaggtaacggtaaccgggttccctttacgaacctagtaccctaccgaaggacgaaccgaaccgacccgaaacgaccgttcccgtagcctaatcgtacgaacaaagttacgaaatcgttactaggaacggtaccgaccggaaacgggtacctaaccgggttactttaaacgtttttaacggttaacccgtgggacccgggaaggtaaaccgggaaacggggtaaaccgggttccgggttacggggggttaacccgggtttttaacggaacccggttaccgggggtaaccgggggtaccccgtaaaacccgggggttaccccgttacgggttaccccgtaaaccccgggttcccttacccggtaacccccgg

SEQ ID NO: 50399 - DNA, 581 bp, Homo sapiens
  misc_feature: GYAE6OF01EV26S.37.83.H06.1.454.CMB.1.raw
  modified_base (240)..(240): a, c, t, g, unknown or other
  misc_feature (240)..(240): n is a, c, g, or t
  modified_base (398)..(398): a, c, t, g, unknown or other
  misc_feature (398)..(398): n is a, c, g, or t
  modified_base (414)..(414): a, c, t, g, unknown or other
  misc_feature (414)..(414): n is a, c, g, or t
  modified_base (420)..(420): a, c, t, g, unknown or other
  misc_feature (420)..(420): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgaggagggccacgatcaactgcaagtccagccggagttgttttanacaactccaagaataagagttctttagcttggtaccagacaagaaaccacgacagcctcctaagctgctcgttactgggcctcgtacccgggaatccggggtcctgaacgtattcgaggtggcggtcgggtcgtgggacagtatttcactctccaccntcagcagcctggcggntgaagntggtggtcggtttattcgtgtcagctagttattagttgtttaacctccttactacgttacggtttcgggaacccgtacggggaacctaacggtacgtagggaacgtagtccggacctaacgggtaacttgggtacggcttacggacctaaccgtcgttccg

SEQ ID NO: 50400 - DNA, 997 bp, Homo sapiens
  misc_feature: GYAE6OF01CZ1KG.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccatggtagtttggctgagctggtctttttcttgtggtcttaattttaaaaggtcgtccagtgtgaggtgcgagctgcgtggagtcggtgggggagcgttggtacgacgggcccggggggttccctggacgaccttcctccgtggtacgaacgccttcgtggtactttacctaccgttttagaaccgtaagttcgtcgaccctagtccggtaacccgttcggggtaccccgccggtacggtccccggttaccggaaagggggaacgggggtccggttaggggtaacggggtttcggggttccttacggtaacggttttaaggttagggttaggggttaagggtttcgggtaaggttaacgcgtaaacggtagttaaacgttaccggactaacggtacccgttaccggggtaacggggaaccggggtttcccggttacctaaacccgtacgttcccgtaccggaaacggtaacgtaaacccttaaaccgtttaacccaaaacgtaccggtaccgtaacccggttacgtttacggttttaactttaccggaacctaaccgtaagttaaccggtaaacccgaaccggttaccggtaacgggaaaccggtaaccgggaacccccgggaaacgggtaacccccggaacccggggtaaccctttaaagtttaccgtttaaagtttttaacgggttaccggttaaaccgttaaacccggttttaaaacccgttttttttcgggttttaaaccggtttacccggtttttaaaccggttttaaaccgtttttaaccccccgttcccggttttaaaccggtacccggttaaccccccggttaacggggtaccccggggttaacccccggtaaaccccgggggg

SEQ ID NO: 50401 - DNA, 767 bp, Homo sapiens
  misc_feature: GYAE6OF01CY8PP.37.83.H06.1.454.CMB.1.raw
  modified_base (260)..(260): a, c, t, g, unknown or other
  misc_feature (260)..(260): n is a, c, g, or t
tcagtagtgtagatcacgaccggtgctcgatttagatcacgtgcgtcgcgggggagagaggagcccagccctgggtattttcaggttgttttcatttggtgatcaggactgaacagagagactcacatggagttggctgagtcttggttctttttcgtgtggtacttaaagtttttaaaagggtcgttccgtagttggtggaaggtgcagtcttgcgtggtagtcggtggggagtcgttggtacgcgggccgggggtccngagcctctcgtgtacgacgtctctggtcttaccgtccttagaacgtaggttgtcgccaagttccggaccgttcggggtcccacgtacgggaccgtacgggagggggtaacgggtcggtagggtaggtcgggttactacgtagtttaagttaggtagggttaggtaggttaagacgacgaaacgtagtaacgtacctgtaaacgtcgtcgggtaaacggacgggtcccgttaacaaccgtctaccgtacgaagtaacgacctaactacccgaaacggttcgaaccgtacgttacttacgggtatttacgaaccgtataaggtaccgtaacgaccgtacgtagaacggtacggaacccgaaggtaccgacccgtaacgtaattagttaacgttagtacggttactaagggttaccctttaccggtttaatacgttttacgttaacctttaccgtttcccgtaacggtacgacccggtttaacggggacccggttaccggtaaacccggg

SEQ ID NO: 50402 - DNA, 262 bp, Homo sapiens
  misc_feature: GYAE6OF01BTNLS.37.83.H06.1.454.CMB.1.raw
  modified_base (221)..(221): a, c, t, g, unknown or other
  misc_feature (221)..(221): n is a, c, g, or t
  modified_base (259)..(262): a, c, t, g, unknown or other
  misc_feature (259)..(262): n is a, c, g, or t
tcagtagtgtagatcacgaccggtgctcgatttagatcacgtgcgtcggcgggtctgggacagatttcactctcaccatcagcagcctgcgggctgaggatgtggcgatttattactgtcagcagtattataatactcctccgacgttcggccaaagggaccaaggtggaaatcaaaacgaactgtggctgcaccatctgtcttcatcttcccgccatctnaatctacactactgagcgggctggcaaggcgcatagannnn

SEQ ID NO: 50403 - DNA, 762 bp, Homo sapiens
  misc_feature: GYAE6OF01DS4FP.37.83.H06.1.454.CMB.1.raw
  modified_base (431)..(431): a, c, t, g, unknown or other
  misc_feature (431)..(431): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtcgccgtacggggacagtcgtgatcgacccagtctccagacctcccgtggtctgtcgtcctcgtgggacgaggacgggtccagtataccaacgtgactacgtccgacggccggtagttagttttaacaaccaacgttaaccgaaaagtaactaaagttcgtttacgttacgtccgtttacggtaaccaaggacctaaacgaaacccgacgaacacgtccctacgtaagccgtacgtccgttacgtttacgcggtaccctaccggtaaccgggacgtcccgggtactagaacgtntcgaggtcgggccgttcgggctagggactacgtcgtttacccacgttaccgaccaacctggtaaccgtacgaccgtaccggtcccggtacgggtcccggtagtaacggtaagttagtacgggtttacggtttaacggttttacgtacggtcgttaacggacgttaaccgtaaggtttaactttcgttaccgtttaaccctccgttacgttaacgggtttgggttccgaaaccgggtagggtaacccgtaggtggtaacggaccgttaacgtccggaaacgtaacggttcggtacggtcgtaacccgtctaaccgtaccgttacgtttcccg

SEQ ID NO: 50404 - DNA, 790 bp, Homo sapiens
  misc_feature: GYAE6OF01BLP8J.37.83.H06.1.454.CMB.1.raw
  modified_base (174)..(174): a, c, t, g, unknown or other
  misc_feature (174)..(174): n is a, c, g, or t
  modified_base (340)..(340): a, c, t, g, unknown or other
  misc_feature (340)..(340): n is a, c, g, or t
  modified_base (464)..(464): a, c, t, g, unknown or other
  misc_feature (464)..(464): n is a, c, g, or t
tcagtagtgtagatcacgaccggtgctcgatttagatcacgtgcgtcgcggggagagaggagcccagccctgggattttcaggtgttttcatttggtgatcaggactgaacagagagaactcaccatggaggtttggctgagctggtcttttctgtggcttaagtttaaaggtntcagtgtgaggtgcagctgcgtgggagtcggtggggagtcgttgggtaccgaggggtcccggggggtccctgacgtacgtccgttccgtggtacgaacgccgttacgtggtacttccgtaccgtttgaaccgtaagtcgtcgcctagtcgacccgtgggtaccccnccgaacggccgtacccggaaggggtaacgggtccgtaggggtaggtcggggtctacgttaacggtttagttaagggttgggtaagttcgggtaagaggacccgtaagtaacgtaacgttaccgngtaaacgtacccgtaccggtagggaaaccgggttcccgttaccgaaccgtacgttactaccgaagtacgtacaacgttacccaacgtacgacctacggtcttcgttaattcgacctatacgttcgaacgagtacccgagtaacgacggtaccgagggtaacccgacgtaccgtaacgttagttaacgtttcgttacggtacccggttaacgtttaaaccgttttcccggtttagtaaccggtttacggttttacttaaccggtttaaccccgttaggttacccgtaaacccggtaccgggttaccgggtaacccgtaaacccgggg

SEQ ID NO: 50405 - DNA, 679 bp, Homo sapiens
  misc_feature: GYAE6OF01A7YQ2.37.83.H06.1.454.CMB.1.raw
  modified_base (176)..(176): a, c, t, g, unknown or other
  misc_feature (176)..(176): n is a, c, g, or t
  modified_base (219)..(219): a, c, t, g, unknown or other
  misc_feature (219)..(219): n is a, c, g, or t
  modified_base (326)..(326): a, c, t, g, unknown or other
  misc_feature (326)..(326): n is a, c, g, or t
  modified_base (436)..(436): a, c, t, g, unknown or other
  misc_feature (436)..(436): n is a, c, g, or t
  modified_base (455)..(455): a, c, t, g, unknown or other
  misc_feature (455)..(455): n is a, c, g, or t
  modified_base (475)..(475): a, c, t, g, unknown or other
  misc_feature (475)..(475): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtgtgtttctaggtgctaatttaaaggtgtcngtgtgaggtgcagtctgctggagtcgtggggaggcttggacgnggccggggggtcctgagcctctcctgagacgcctgtgtcttctactttgacagtgtgaccagtcgtccgtcggccgcacggccaccggaggggacggggtcgtgggnggtgggtctacgtaagttagttaggtggttaggtaggttacgtagacagagactacgacaagccgtcggtaggacgggtcccgtacactactacgcaaggcaaacttaanacccgaaagcgtaactcgngttagtttcctgacacttanaacgacgtacgacgtaggacgaccggaccggaacggaccggtaacgaactaagtttatttaattcggttacgtaaccgttaacgttttaacccgtttttaccgtttaggttaacttttaccggttttaaccttaccccgttaacccggttaacgttaccgggtacccggtaccggggttaacccgggtcccggtaaccccgggg

SEQ ID NO: 50406 - DNA, 751 bp, Homo sapiens
  misc_feature: GYAE6OF01DBORB.37.83.H06.1.454.CMB.1.raw
  modified_base (519)..(519): a, c, t, g, unknown or other
  misc_feature (519)..(519): n is a, c, g, or t
tcagtagtgtagatcacgaccggtgctcgatttagatcacgtgcgtcgcgggggagagaggagcccagccctgggattttcaggttgttttcatttggtgatcaggactgaacagagagaactcacatggagtttgggctgagcgtggtcttttcttgtggtcttaattttaaaaggtgtcctagtgtgaggtgcaggctgctggagtcggtggggagcgttggtacgagggccggggggtccctaggacgacttcgtccgtggtagaacgcccgtgtggtacttcctaacctttggaactaaggtcgtcgtacctagtcggtacccgttcggggccccgaccgtacggacccgttaccggaaggggggaaccggggtccgtagggtaggtcgggtccttacgtagtttacgttaggtaggtagtggtaactgatacgagtacgtacgacaggtaccgtccgtagggtaaccggtccgttacaacctagtcctaccgagacgaactacctaacgacgancgtactacttgacttgaccatagtacgaactcgtacgtaggaccgacggtaccggaacggtacccgaacggtacctaagttaacttgtttaaacgtcgttaaggtaacccgttttaaacccgttttcggtttaagttaacccggtttcgttttaaccgtacccgttaccccgttttaacgggacccgtaccgggttaaccgggtccggggtaaaccccgttaaacccggggg

SEQ ID NO: 50407 - DNA, 767 bp, Homo sapiens
  misc_feature: GYAE6OF01E03VF.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggtctttttcttgtggcttaattttaaaaggtgtccagtgtgaggtgcagctgctggagtcgtgggggaggtcttggtacacgggcccgggggggtccctggacgactcctcctgtcgaacgcctctggtacttcacctttgactaagtgtcgccagtcgaccgtcgggtcccgccgacggtccgtaccggaaggggaacggggtcgtgggtaggtgggtctacgtaggttactttacgtggttaggtaggtaacctaccggactacttaaccgtacgacgaacgtaccgttcccggtacggtacccggggttaccccggtttcccgaacccggttccctaccgaacggaacgtaacctaaacgtttacccgaaagtaacgttaaccgggttcttaagtccgtaagggtaaaactccggaaacgtacgtcccgtaggaacggtacggacccgggaacgggtacccgaaccggttaccccttaagttaaccgtttaacgttcggtacggtacgaaggtacgtaagtccgaaagggtaaccgggtagtaacgtagtacgaaggccgtaacggtcccttaccggtacgaacccgttcggggtaccggggacccgtaaaccccggg

SEQ ID NO: 50408 - DNA, 777 bp, Homo sapiens
  misc_feature: GYAE6OF01AFEHL.37.83.H06.1.454.CMB.1.raw
tcagtagtgtagatcacgaccggtgctcgatttagatcacgtgcgtcgcgggacaacaggcaggcagggcagcaagatggtgttgcagacccaggtcttcatttctctgttgctctaggctctctgtttacacaggttgccgtacgggacatcgtgaactgacccagtcctccagtacctccgtggtctggtcgtcgttcggtaggggacgagggacgggaccacgtaacgtacctaaaccgttgaacctaacggtccgacggcccgggttaagttacgtttttaacaacctaacgtaccgaaaaggtaagtaaacggttaacgtttacgtttaacgtaccgtttacggtaacctaacggtaacaaccggtaaaaccaaccggacctaacggtccctaaccgtactcgtacgtacgttaccgttaccggtacggtaccgtaccgttacccgggacgttcccgggtacctaacggaccgttaactcgtaacgggtcggtacgggtcggtacggtacgggtaacgtcgtactttacgcttaccgtacgaaccgtcgtacgacgtacgacgtaccgtcgggccggtagtacggtaagtacggttcgggttacggtcgtttaacgttacgtacgtacgacgtagttaacggttatttacgttacggttaccttaccgttacgttacgttaccggtttacgaacccggttacggtacaacgggtcgtagtacggtatccgacgtaaccgtagtacgttccgactaccggctaccgtcgttcg

SEQ ID NO: 50409 - DNA, 754 bp, Homo sapiens
  misc_feature: GYAE6OF01EVSHF.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccatggaggtttgggctgagctgtctttttcttgtggcttaagttttaaaggtgtccagtgtgaggtgcagctgcgtgggagtcggtgggggaggtcgttgggtacgacggggtcccgggggggtccctaggacgtaccttccgtccgtggtacgaacgtccttcgtggtactttcctaccgtttagaacgtaaggttcgtacgacctagtcggtaccgttccggggtccccgaccgtacgggccgtaccgggaagggggaacggggtcgtaggggtaggtcgggttctacgttagttagttaggtggttaggtaggtagtagacgacgagtacttacgcgacgtaccgtcgggtaggaccgggtccggttacacctagtcccgtacgaacggtacctaacctaaccgttccaaaacgcgaccgtaacgtcttagttacttacgactaacacgttagaaacgcgtacgtagggaacgaccggtacggaggtaacccacgggtactaagtttaacttagttaacttggtacgtaaaccgtttacctttcccgtttaaggtaccgtttcggtttaacttacccgtaccccgttaggactaccccggtaggtcccggggccgtaaacccgggg

SEQ ID NO: 50410 - DNA, 902 bp, Homo sapiens
  misc_feature: GYAE6OF01ADG1L.37.83.H06.1.454.CMB.1.raw
tcagtagtgtagatcacgaccggtgctcgatttagatcacgtgcgtcgcgggggagagaggagcccagccctgggatttttcaggtgttttcatttggtgatcaggactgaacagagagaactcaccatggagtttgggctgagctggtctttttcttgtggtcttaagttttaaaggtgtccagtgtgtaggtgcagctgcgtggagtcgtgggggagtcgttggtacgacgggcccgggggggttccctggacgacctcgttccgtggtgaacgtcccgttcgtcggtactttcctaccgtttagaaccgtaaggttcggtcgacctagttccggtaccgttcggggtccccggaccgtacgggtccgtaccgggaagggggtacggggtccgttaggggtacgggttcggggttccgttacggtaaagggttttacggtttaagggttaggggtttaagggttagggtttaacggtaacggacccgtaacgtaaggttaaccgttaaccggaccgaacggtacccggttcccgggttaacggggtaaaccggggttccccggtttaccgaaccctaccgttacccggttaaccaacgggtaacgtaaccctaaaccgttacccgaaacgtaaccggaccgtaacggtcctttaaggtttactttacggaccgtaacgtaacgtaaccgaaccgtaacgggtacccgttaggaaacgggtacccggggaaccggaacggggtaccccgaacggttaccctaaagttaactttacggtttaagtcggtacgtaaccttttaaaccggttttcccgttttagacggtttacgttttaccgttaccttaccccgttaggttacccgaacccgttacgggtccggggtacccgtaaacccgggg

SEQ ID NO: 50411 - DNA, 842 bp, Homo sapiens
  misc_feature: GYAE6OF01D0VIF.37.83.H06.1.454.CMB.1.raw
  modified_base (205)..(205): a, c, t, g, unknown or other
  misc_feature (205)..(205): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctcgtgttactacgaggtcgccgtagggactagtcgtagatacgaccgagtcctccacgacctccgtggtctgtcgtctcggngggcgagggacggcctagactactaacgcgaccgtaacggtccgagggtaccggttaggttttacgttttaacaaaccgtaaacctaaccgaaaagtaacgttaacgttacggtttttacgttacgacgttttacgaacgacgacgaaaaccggaaaccaccgacgtaccgtaaccttacggtaacgtccgtacgtttccgtttaaccggtttacggtcccgggttaccgtttacccgggggtaaaccccggttacccgggttaccccggggtaaccgtaacgaaaccggtttacggttacgggtaacggggtcggggtaccgggtcgggttacgggacgggtaacttacgggttttacctacccttaaccggtcccttaacccaacggttacctcggaaccggtaccggacgtacccgggtcgggaccggttaacgtaacggaacgtttccgggtagggtttaccggttttaagttacgtaccggtagtaccgtcgtattaaggttcttttacggtacttcccgttaccgtaagttcgttaaccgggttggaacccggtaagggtaccgtacgtagggtacgtacggacctacggataccgggtagtcggtaccacgtacctcctagtcgtttacg

SEQ ID NO: 50412 - DNA, 825 bp, Homo sapiens
  misc_feature: GYAE6OF01DQDC8.37.83.H06.1.454.CMB.1.raw
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgccgtacggggacatcgtgatcgacccagtctaccagacctcccgtggctgtcgtctcgtgggacgaggacgggccacgactacaacgtgactaacgtccgaggccggtagttagttttacaacctaacctaccgaaagtaaattaaggtacgttttactttacggtacgtttacggtaaccagaccaacgaaacccacgaacacgtcctacctaagctacgtccgttcgtttacgcgggtaccctaccggtaacccgggtaacgtcccggggtcctagtaaccgtcttcggacggtcgggcgggtcgggtcgtagggactagttaccgttttaccgaccttccgtaccaaccgtacgtaccgtacggccgtaccggtccgtaccggggaccgggtacgttaaggtaacgggttacggtttacggggttacgggtttaccggttttaaacgtttacccggtagtttaccgtaacggttacgtttaacggtttaactttttaacggttaccgttttaacccgtttacccgttaaccgttaccggttttacgggtttacccgggaacccggggtaacgggtaacccgtaacgggtccggtaacgggaacgtaccgttaccggaaccggtaacggttaaccgttcggggtaccgttacccgtacctaccccgtaacgttccgtttaccgg

SEQ ID NO: 50413 - DNA, 575 bp, Homo sapiens
  misc_feature: GYAE6OF01A66RR.37.83.H06.1.454.CMB.1.raw
  modified_base (239)..(239): a, c, t, g, unknown or other
  misc_feature (239)..(239): n is a, c, g, or t
  modified_base (399)..(399): a, c, t, g, unknown or other
  misc_feature (399)..(399): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgaggagggccacgatcaactgcaagtccagccgagttgtttanacactcaagaatagagttcttagcttggtaccagcaacgaaaccacgacagcctacctaagctgctacgtttacgcggccctcgtacccgggatcccggggtccctaggaacgtacttcgaggtcggacgggcggtcgtacgggacagtactttcactcncacatcagcagccgtggcggtcgtagaagtagtggtcggtcgtttattacgtgtacgagtactagttattattcgttactccttacgtacgttacgtttcggacgacgggaccgtaaggccgtacggagtacgtacggctaacgacgtaggtcggtactcgactaccgtagttccg

SEQ ID NO: 50414 - DNA, 861 bp, Homo sapiens
  misc_feature: GYAE6OF01DXL0I.37.83.H06.1.454.CMB.1.raw
tcagtagtgtagatcacgaccggtgctcgatttagatcacgtgcgtcgcggggacaacaggcaggcaggggcagcaagatggtgttgcagacccaggtcttcatttctctgttgctctggatctctgttactacgaggtcgaccgtacggggactatcgtgatacgaccctagtcctaccgacgaccttcccgtggtcctggtcgtccgtcggtcgggcgaggacggtaccaacgtactacaactcgacaacgtccgacggtaccggtagtttacgtttaacaacctacctaccgaaagtaacttaagtacgtttaccgttacggtcgtttaacggaaccaaggacctaaaccgaaacctccgtaacacgtcctactaacgcttcgtacttcgtttacgccggtacctaccgtaaccgggtacgtcccgggtacctagaaccgttacgtcggacgggtcgggaccgggtcggttacgaacgggtaccttacggtactttccgaaccgttcctaacccgaaccgtataccggaacgtaccgtaaccgtcgggtacgggtacccggtacgtaacggtaaggttacggtttcgggtaaccgggttttacggttttaacttaccggtcggtaacgtaacggtaccgtttaagttaaacctttaaccgttaaccgttaccccgttaccccggtttacccgggttaaccggttaccccgggaaccgggtaaaacgggttaaacccgtaaggggttaaaaccgtaaacctaaaccgggtaaaaccgttggttccgggtaaacgtaccgaacggttaacccctacgttaacccggttccgtttacccgttacgttacccgtttaccccg

SEQ ID NO: 50415 - DNA, 754 bp, Homo sapiens
  misc_feature: GYAE6OF01DQNJJ.37.83.H06.1.454.CMB.1.raw
  modified_base (266)..(266): a, c, t, g, unknown or other
  misc_feature (266)..(266): n is a, c, g, or t
  modified_base (269)..(269): a, c, t, g, unknown or other
  misc_feature (269)..(269): n is a, c, g, or t
tcagtagtgtagatcacgaccggtgctcgatttagatcacgtgcgtcgcggggagagaggagcccagccctgggattttcgaggttgttttcatttggtgatcaggactgaacagagagaactcaccatggagtttgggctgagcgttggtctttttcttgtggtacttaagtttttaaaaaggtcgtccagtgtgaggtgcagctgctggagtcggtggggagtcgttggtacgacgggccgggggtcctgacgtctctccgtgnganccgtgtggtattcctaccttgaacagtcgtcgaccagtcgtaccgtcggtcccgcgacggtccgtccggaaggggacgggtcgtgggtacggtcgggtctacgttagtttacgttaaggtggttaaggtggtaacgtacgaccgtaaacgtaaggtaacgttaaccgacgtaacggtaccgttccggaaggaaccgggttcccgtaacccacgtactccgtaaccgaagtaacaaccgtaacttaccaaacgtacgaccaacggttcgttagttacgttacgccgtaaccaaggttacgaaacccgcgtaccgtaggaaccgaaccggacccgggaaggacccgaaccggtactaagttacttaattacgttacgtacggttaacttaaaccgttttcggtttaagtaccggttttacgttaacctttcccgtaaccccgttagacccgtacccgtacgggtcccgggtaaccgtaaccccgggg

SEQ ID NO: 50416 - DNA, 676 bp, Homo sapiens
  misc_feature: GYAE6OF01B26LC.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggtcttttcttgtggctaatttaaaggtgtccagtgtgaggtgcagctgctggagtcgtggggaggctggtacaggccggggggtcctgagactctcctgtgaagcctctggattctaccgtttgactaagtgtacgcctaatcgaccgtggggtcccacgtacggcctaccggaaggggaacgggcgtggacggtgggtctgtagttagttagtcggtagtggtatagactacagtattcgacgagactccggtaggaccgggtccggttacgaaccccgtctacccgaagggtaacctacgtaaacttcccgaaaaggtaactacggtctaatcgtaagggaaactgaacctacggtcccaggaacggacgacccggaaggaccctaccgggtacccccttagttaaacttaccgttgggtacgacggaacgtaggtaactcgaaaagggcggtaaagttacaaaggcccgacgtaaacgcgtacctttacggaagtaacccgtttaagggccccgggggtaaaccccc

SEQ ID NO: 50417 - DNA, 843 bp, Homo sapiens
  misc_feature: GYAE6OF01AV3BN.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccagtggtaggtttggctgagcgttggttctttttcttggtggtacttaaagtttttaaaaggtcgtaccaggtgtggaggtgcagcgtgcgtggagtcggtagggggaggtcgttaggtacggacggggtcccggggggtccctaggacgtacctccgtcgtggtacgaacgtccgttcgtacggtacttcctaccgtttagaacgtaaggtgtccgacctagtccggtaccggtccgggtcccgccgtaacggtccgtaccgggaaggggacgggtccgtgggtacggttcggtacttacgtaaggtttagttagggttgggttaaggttaggtaagtacgtaccgaacgtaagtaacgttaaccggacgtaaccggtaccgtaccggtaacggggtaaccgggttcccgttaaccaccgtactcccgtaaccgaagtaacgtaacctaaccgttaaccccgaagtacgacccgttaacgtacgtttaggttacttaccggaactacgtaacgtaacgaaccgtacgtaccggtaagaaccggaccgggtaacccggaacgggtaacccgaaccgggtaacttaagttaactttaggtttacgtacggtaccgttaaaccggtttaaccgttttcgttaacgtaggttttaccgttacttacccgtacccgttacggtaccgaaccggtccgggtaccgggacccggtaaacccggg

SEQ ID NO: 50418 - DNA, 695 bp, Homo sapiens
  misc_feature: GYAE6OF01DHLHO.37.83.H06.1.454.CMB.1.raw
  modified_base (177)..(177): a, c, t, g, unknown or other
  misc_feature (177)..(177): n is a, c, g, or t
  modified_base (352)..(352): a, c, t, g, unknown or other
  misc_feature (352)..(352): n is a, c, g, or t
  modified_base (389)..(389): a, c, t, g, unknown or other
  misc_feature (389)..(389): n is a, c, g, or t
  modified_base (402)..(402): a, c, t, g, unknown or other
  misc_feature (402)..(402): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtgtcgttttctaggtggctaattttaaaaggngtcagtgtgaggtgcagctgctgggagtcgtgggggagcgttggtacagggccgggggtcctgagtactctccgtgagaagcctgtgtattactaccttagtaacaagtcgtcgtcctaagttcgaccggtggtccgcccgagcgtaccgagggaacggcgtaggtagtgggtcncgttaagttagttaggtagtaggtaggttagagctanatacgggggtacngaacgtactcgtacgtaacgggtccgttacaacctacgtacgtaccgaagaacgaactaacttaccaaacgagaccaacggtacctaaggttactttaagacctaacgtatacgaactacgtaccgtaagaacgacgaccgtaaggaaccacggaactaagttaagttagttaacgtacgttacgtaccgttaaaccgtttacgtttacgttaacgtttaggttaaccttaaccgtaacccgttaacggtaaccgtaacccggtacgggtaacccgggtacccggtaaaccgg

SEQ ID NO: 50419 - DNA, 794 bp, Homo sapiens
  misc_feature: GYAE6OF01DD5ZH.37.83.H06.1.454.CMB.1.raw
  modified_base (216)..(216): a, c, t, g, unknown or other
  misc_feature (216)..(216): n is a, c, g, or t
tcagtagtgtagatcacgaccggtgctcgatttagatcacgtgcgtcgcggggacaacagtcaggcaggggcagcaagatggtgttgcagacccaggtcttcatttctctgttgctctggatctctgttactacaggtcgaccgtacggggactagtcgtagacgtcgaccctagttcctaccgaagacctcccgtggtcttggtcgtcttacggngggacgacggaccggacccaacgtactaccgtaagtcgacaacggtccgacggccgggttaagtttacgtttaactaaccaacgtaaccaaaggtaaataaggttacgtttactttacggacgttacggtaaccacgtaaccgaaacgaaacccgtaacgtacaacgtacctaacgtaacgtcgtacgtaccgttacgtttaccggacggtacccttaacccggtaccgggtaaccggttcccgggtacctacgacgtacgtttacgacgggtcggacgggtcggtacgtacggaactacgtactttcaacctctaccgactacgtacgacgacgtacgtccggtacggacggtacgtacggaagtgttacgggttacggtttacggtttaactacgttcgtacacggttaactttaggttaactttacgtttaccgttaccttacctacgttacgttacgggttacggaccggtaaaccgggtaactacggtacggtaaggtaaccgtacgccggtaacggtaaccggttaccgtagggtacccggatacccggaacgttaaccccttgtttcccgg

SEQ ID NO: 50420 - DNA, 832 bp, Homo sapiens
  misc_feature: GYAE6OF01B05VC.37.83.H06.1.454.CMB.1.raw
  modified_base (199)..(199): a, c, t, g, unknown or other
  misc_feature (199)..(199): n is a, c, g, or t
tcagtagtgtagatcacgaccggtgctcgatttagatcacgtgcgtcgcgggggagagaggagcccagccctgggattttcaggtgttttcatttggtgatcaggactagaacagagagaactcaccatggtagtttgggctgagcgttggtctttttcttgtggacttaatttaaaaggtgtaccaggtgtgaggtgnagtctgctggtacgtcggtgggggagtcgtcggtacgacgggtcccggggggtccctggacgtacctccgtccgtagtacggtaacgccgttcgtaggtacttaccgtaacctttacgtaacgtaaaggttcgttacgacctaacgtcggacccggttcgggtccccgaccgacggtaccgtacggaagggggaacgggtcggtgggacggttcgggtacctacgtagttaagtttggtagggtagttggtaacgtacgacgaacgtagtaacgttacgacgtaacgtaccgtaccgggtacggaacggttcccggttaccaacgtacgtccctaacgaaggaactaaccctaagttacccaacgtacgacgtacgtacgttagttacgtacgtaactacgtaagtaccgaaccgtacgaccgtaggaaaccggacggtaccggtaaccgggaacccgaacccggtaacttaacgtaattaaccgtttagttaacggttacccgtaaaccgttttaaaccgtttacggtttttacgtaacgttttaacggtttaccgtttaacccttaccccggttaaaggttccccgtaaaccgggttacggtacccgggggtaacccgttaaaccccgggg

SEQ ID NO: 50421 - DNA, 637 bp, Homo sapiens
  misc_feature: GYAE6OF01BLXL3.37.83.H06.1.454.CMB.1.raw
  modified_base (469)..(469): a, c, t, g, unknown or other
  misc_feature (469)..(469): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatcgacccagtctccagacctccctggctgtgtctcgtgggcgaggacgggccacgatcaactgacaacgtccaggccggtagttgttttaacacaactaccaaagaataagtagtttctttagcttacggtaccagacaacgaaaccacgacacgccctacctaaactgtcttcgtttacgcggtccctaccgtacccgggtacgtcccggggtccctaggaaccgtattcgagggtcgggcgggtcgggtcgtagggacacgttactttccaccttctaccaccagtcacgcgacgtccgtcgggccgggntagaagtgttcggtcggttcggtttatacgtgtacgagtactagttattacttacgttacctccttacgttacgttacggtttacggaccggtaacgggacgtaacggtcgtagggacgacgtcgacgtacgtacgtcggtcggtacctcgacctacctgtcttaccg

SEQ ID NO: 50422 - DNA, 703 bp, Homo sapiens
  misc_feature: GYAE6OF01CX341.37.83.H06.1.454.CMB.1.raw
  modified_base (235)..(235): a, c, t, g, unknown or other
  misc_feature (235)..(235): n is a, c, g, or t
  modified_base (595)..(595): a, c, t, g, unknown or other
  misc_feature (595)..(595): n is a, c, g, or t
tcagtagtgtagatcacgaccggtgctcgatttagatcacgtgcgtcgcgggggagagaggagccccagcccctgggtattttcaggtgttttcattttggtgatcaggactgaacagagagaactcaccatggagtttgggctggagcgtgtcgttttcgtagtgcttaagttttaaaggtgtccagtgtgaggtgcagctgcgtggagtcggtggggaggtcgttaggtacgngggcccgggggtccctgacgctctcctgtgaacgccgtcgtgacttcgtacctttagaacgtagtcgtcggacacgtacgaccgtcggtccgaccgagccgtacggacggggagggcgtaggaggtcggtacgtgtagtttagtaggtggtaggtggtaagtcgtcgaacgagtacgtacgacgaagtccgtacggtacggtaacgggtccgttaccgacctaactccgttaacccagaccgtaaccgtaacttaccccgaacgtcgaaccgacgtacctttaggttacctaggtaccaacgtacgaacgacgtacgaccgtaggaacgacggaccggaacgaccggtaagaccgttaanagtttacgttaacgttgttacgtaagttacctttacgtttacgttacgttcggttaactttaccgtacgttacgtacgtccgttaaacggccggtaaccgaaccgggg

SEQ ID NO: 50423 - DNA, 830 bp, Homo sapiens
  misc_feature: GYAE6OF01AT5LW.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccagtggagtttgggctgagcgtggtcttttctgtgacttaagtttaaagtgtccagtgtgaggtgcagcgtgcgtggtagtcggtgggggagtcgttacgggtacgacggggtcccggggggttccctaggacgtaccgttccgttccgttggtaggtaaccgcccgttacgtaggtacttccgttaaccgtttagaacgtaagttcgtacgtacctaagtccggtaaccggttccggtaccccgccgtacgggtaccgtaccgggaaggggtaacgggtccggtagggtacggttcgggtccttacgttaaggtttaggttaggttacgggttaaggttagggtaacgtacggaaccgtaacgtaacgttaacggttaccgacgtaaacggttacccggtacggtaccggggtacgggtcccgttaccgaacctacgttcccgtaacgaacgtaacgtaaaccgttaaccgttaaccaccgagtaccctgtacgttaagtcgtacgaccaagtacgacgaaccgtcgcccgtaaggacgtaaccggacccggaagtaacccgaggtaaccttagtaacgtttacttcggttagtaaccgtaacgtttaacccgttttcgttaagttacgtttacgtttaacccgttccgttacccggttaaggccccgttaaacggcgggttcccgggaaccggttaacccggg

SEQ ID NO: 50424 - DNA, 849 bp, Homo sapiens
  misc_feature: GYAE6OF01BG29U.37.83.H06.1.454.CMB.1.raw
  modified_base (246)..(246): a, c, t, g, unknown or other
  misc_feature (246)..(246): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgccgtacgggacatcgtgatcgaccagtctccagacctccctggctgtgtctcgtgggcgagacgggaccacgatcgaactgcgaagtccgagccggtagttgtttanaaccaactaccaaagaattaagtagtttacttagtcgttacggtaaccagaaccaacgaaaacccgacgaaccacggtacccttaccgtaaagtcctacgtaccgttacggttttaccggccgggtaccccggtacccgtaaccccggggtaacggttcccccgggggttacccctaagggtaaccggtaacgttaccggtacggggttacggggcccgggggttcccggggtacgttacggggtaaccctaggttacctttaccgtacccgttacctaacccgaacctaacgtaccgacgtaccgtaccggaccccgttgggtaccccgggtacgttaacgggtaaaggttaaccggttacgggtttacggggtttaccggtttttaacgttaccggtttacggtaccgtaaggtaccgtaaggttttaacgttttaacgtttaccggtttaacccgttacctttaacgttaaccggtttacgggttttacccggaaccgggtaaccgggaaccgtaacgggtacggtagtaccggtaactaccggacgtaaaccggttacgttacggtaccggtaccgtacgaccctaccgtacgttacgg

SEQ ID NO: 50425 - DNA, 867 bp, Homo sapiens
  misc_feature: GYAE6OF01C3KV7.37.83.H06.1.454.CMB.1.raw
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgccgtacggggacatcgtgatcgacccagtctccagactccctggctgtcgtctcgtgggcgaggacgggccacgatcaactgacaagtccgagccggtagttgtttaataccaacctaccgaaagtaattaagtacgtttactttacgtccgtttacggtaccagaccaaacgaaaccccacgaccacgtccctactaacgctcgtcgttaccggtttaacgtccgggtaccttacccgtaacccggggtaaccgttccccggggtaccctaggtaaaccgtcgtttcgaacgggttcggggccggggtccgggttacggtacgggaacgtacgtacgttttaccgacccttcgtacccaacccgtactaccgacggtaccgacgggttccccgtggggaccccgggtacgtaacgggtaaacggtacggtttcggggtttaaccgggggtttaccggtttttaaaagtttaccggttcggtttaaacgaccgggttaaaccgtttaaggtttttaacgtttaaccgttttacccgtttaaccccgttaccctttacccgttaacggttttacgggttttacccgggaacccgggttaaaccgggggtaacccgtaaccgggtacggttacggggtaaccgtacgttaacccgggaacccgtaaacccgggtttaaggtaccgggtttaccgggacccgtttccggaaccccaacgttaccgtttcgg

SEQ ID NO: 50426 - DNA, 900 bp, Homo sapiens
  misc_feature: GYAE6OF01DOM75.37.83.H06.1.454.CMB.1.raw
tcagtagtgtagatcacgaccggtgctcgatttagatcacgtgcgtcgcgggggagagaggagcccagccctgggtattttcaggttgttttcatttggtgatcaggactgaacagagagaactcaccatggtagtttgggctgagcgtggtctttttcttggtggtcttaagttttaaaggtgtccagtgtgaggtgcagctgcgtggaggtcggtggggggaggtccgttgggtaacgcgggggtcccgggggggttccctaggacgtaccgttctccgtgtagaacgtcctcgtcggtattcctaccttcgaactaagtgtcgacctagtcgtaccgtgggtcccgccgaggccgtaccgggaagggggaaggggtcgtagggtaggttcgggttcttacgtaaggtttagttaagggtggttaagggttaggttacggtaagacctaacggaacggttaactaccggtaaccgtaaggtaacccggtttccggtacgggtaaacccgggggttcccgtaacccgtaaccctacgttaccctacgaaacgggaacctaaccgttaaaaccttacccccgaaacgaaccgtacccgtaaccggttactttacggtttacgtttaccgaccgtaacgtaaacggttaacgaaaccgtacccggtaccgtaacggaaacgggtaacccggtaaaccggggaaccggtaaccccgtaaccgggtaaccctaaatttaacgttaaacggttttacggtttacgtaaaccggtttaaccgtttaaaacccgttttcccggttttaaacggttaacgttttacggttttaaacgtttaccccgttaacccgttaaccggttacggacccggtttaacgggcggggtaacccggtaaaccccggg

SEQ ID NO: 50427 - DNA, 252 bp, Homo sapiens
  misc_feature: GYAE6OF01CNKM5.37.83.H06.1.454.CMB.1.raw
  modified_base (247)..(252): a, c, t, g, unknown or other
  misc_feature (247)..(252): n is a, c, g, or t
tcagtagtgtagatcacgaccggtgctcgatttagatcacgtgcgtcggcgggtctgggacagatttcactctcaccatcagcagcctgcgggctgaagatgtggcggtttattactgtcagcagtattataatactcctccgacgttcggcaagggaccaggtgaaatcaaacgactgtggctgcaccatctgtcttcatctccgcatctgaatctacactactgagcggctggcaaggcgcatgnnnnnn

SEQ ID NO: 50428 - DNA, 312 bp, Homo sapiens
  misc_feature: GYAE6OF01C7XT6.37.83.H06.1.454.CMB.1.raw
  modified_base (252)..(256): a, c, t, g, unknown or other
  misc_feature (252)..(256): n is a, c, g, or t
  modified_base (258)..(312): a, c, t, g, unknown or other
  misc_feature (258)..(312): n is a, c, g, or t
tcagtagtgtagatcacgaccggtgctcgatttagatcacgtgcgcgcgggtctgggacagatttcactctcaccatcagcagcctgcggctgaagatgtggcggttttattactgtcagcagtattatgttactcctcacagttttggccaggggaccaagctggagatcgcacgaactgtggctgcacatctgtctcatcttccgcatctagatctacatactgagcggactggacaaggcacagttagnnnnngnnnnnnnnnnnnnnnnnnnnnnnnnnnnnnnnnnnnnnnnnnnnnnnnnnnnnnn

SEQ ID NO: 50429 - DNA, 937 bp, Homo sapiens
  misc_feature: GYAE6OF01CEXYF.37.83.H06.1.454.CMB.1.raw
tcagtagtgtagatcacgaccggtgctcgatttagatcacgtgcgtcgcggggacaacaggcaggcagggcagcaagatggtgttgcagacccaggtcttcatttctctgttgctcgtggatctcgtgttacctacgaggtcgccgtacgggacatcggtgactcgaccctagtcctaccgacgacctcccgtggctgtcgtcgtcggtgggacgacgggacgggccacggactaccaacgtgaccgtaacgtccgacggtaccggtagtttacgtttaacaaccaaaccgttaaccgaaaggttaactaaacggttacgttttacgtttaacgtccgttttaacggaacccgtaacgaaccgtaaaccggtaaaacccgacggtaacccgtaaccgttaccctttaaccggaacgttccggttacgttacccggtttaccgtttttacccggccgggttaacccccgttaaccccgggttaaaccccgggggttacccggttaccccgggggtaccccttaacgggtaaaccggtttacggttaccgggacggggttcccgggggtccggggttaccggggttaccgttaaaccgggggacctttacgggttaccttttaccccggtaacctccgttaacccaccgttacgtacccggaacgtccggtaaccgtcccgggtacgggtcggtaacgtacggtaaacgttggttcgggttacggtttaccggttttaagttaccgttcggtaacccgtagtaaaccggtttcttaaaggttttaacccttcggtttaaccctccgttttaaccgtacgggtttaccggttaccgggaaccgggttaacgggaacgtaccggtattaccgggaacgttaccgtacgaacgttaaaccggtggtaccgtacggtcgtaccgtacccttacgccgtttacg

SEQ ID NO: 50430 - DNA, 843 bp, Homo sapiens
  misc_feature: GYAE6OF01AW9QS.37.83.H06.1.454.CMB.1.raw
  modified_base (489)..(489): a, c, t, g, unknown or other
  misc_feature (489)..(489): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctcttgttactacaggtgccgtacggggacatcgtgatcgacccagtcctccacgacctccctggctgtgtctcgtggggcgaggacgggacccgacgtactcgaactcgaccaacgtccgacggtccggtagtttagttttactaacctaaacctaccaaaggtaaagttaacggtaacgttttcctttaaggtcctttacggttaaccaggaactaacggaaaacccctaacgaacctaacggccccttaccgtaacgtcctcgtaccgtttccgttttacggtccgggtaccccgtaccggttaacccccggggtaaccggttccccgggggttccccgtaacgggtaaccgtaacgttaccgngggttaccggggccgggtccggggttacgcggggtaactaggttactttcctactcccgtactaccgtactacgacggtccgtaccggtcctacggggtcccggtacgtaagggtaacgtaacggttttcgggttacgggttttaccggttttaactttaaccgtcggtttaccggaccggttaacgttaaccgttttaagtttaccgtttacggtttaccttaccccgtttaaccggttacgttttacccgggttacggtaaccccgggtacgggttaaacgaacggtcggtacgggatacggtaccgcggtaacggtactacgggttcgacgttacggacctcgtattcccg

SEQ ID NO: 50431 - DNA, 735 bp, Homo sapiens
  misc_feature: GYAE6OF01ASC5W.37.83.H06.1.454.CMB.1.raw
tcagtagtgtagatcacgaccggtgctcgatttagatcacgtgcgtcgcgggggagagaggagcccagccctgggattttcaggttgttttcatttggtgatcaggactgaacagagagaactcaccagtggagtttgggctgagctggtctttttctgtggtcttaagttttaaaggtgtccgagtgtgaggtgcagctgcgtggagtcggtgggggaggtcgttgggacgacggggtcccggggggtcctggacgtactcgtcgtggtgaacgtcctcgtggtattcctaccgtttgaactaggtcgtcgaccagtcggtaccggtcggggtccccgacgacggcccgtaccgggaaggggtacgggtccgtagggacggttcgggtccttacggtagttttaggttagggtagggttaggttacgggtagtaacgacgtaacgtaggtacttacgacgtacggtaccgtaccggtagggaccgggtccgttaccaacctcgtcctacgaaggacgtaacctaactacccaacgtacgaccgtacgtccgtttagttaacttccgacctaacgtactacgaacgtgaccgtaggaaccgacggacgaacgaccgacgacttagtaattattcgtagtaccgtaacgttaacctttcgttaagttacggttgttaacccgttccttacccgtacggttaccgaacccggtcgggtcccgggtaaccgtaccggg

SEQ ID NO: 50432 - DNA, 882 bp, Homo sapiens
  misc_feature: GYAE6OF01B4KIS.37.83.H06.1.454.CMB.1.raw
  modified_base (134)..(134): a, c, t, g, unknown or other
  misc_feature (134)..(134): n is a, c, g, or t
tcagtagtgtagatcacgaccggtgctcgatttagatcacgtgcgtcgcgggacaacaggcaggcaggggcagcaagatggtgttgcagacccaggtcttctatttctctgttgctctggatctctgttactanaggtcgaccgtacgggactagtcgtgacgtcgaccctagtcctccagcctcccgtggtctggtcgtcgtcggtgggacgacggacggacctacgtactacaacgtcgacctaacggtccgacgggtaccggtagttttacgtttaacgaccgacgtacctaaccaaaaataaagttaaacgtaaaccgtttagttaacgttacgtttaggtactaaccgaacggaaccgaaacggaaaacccggagggacctaaccgtacccttaaaccgtaaactcgtaccttaacgttaacgtttcggacgggttacctaacccggttacccgggtacccggggttaacggttccccggggtacctaggtaaccgttaacgtcggacggtcggacgacgggttacgggtcggtaacggtaactacgttactttacccacgttaccaaccctaaccgttacaaccgaaccggtctacccgggtagaacccgggtaggtaggtaacgggtacggtagtttacgggtacggttaaccttttaacgttttacgtaaccggttcgtaacgtacgttaacggttaaactttaacgttaaccgttaacccgttacccggttaaccccggtaccgggttaacccgggttaaaccggaacccgggtaaaaggtacccgggtaaagggaaacccttaaaagtaaaacccccgggtaaacgtccggtaacgggtacccgtaaacgtccggtaaacctaccgtttacg

SEQ ID NO: 50433 - DNA, 948 bp, Homo sapiens
  misc_feature: GYAE6OF01ES0BT.37.83.H06.1.454.CMB.1.raw
tcagtagtgtagatcacgaccggtgctcgatttagatcacgtgcgtcgcggggacaacaggcaggcaggggcagcaagatggtgttgcagacccaggtcttcatttctctgttgctctggatctctgttactacgaggtgcctacggggacatcgtgatcgacccagtcctccagacctcccgtggctgtgtctcgtgggacgaggacgggaccacgactcaaaccgtgaccgaacgtccgaacggccggtagttgttttaacaacctaacctaccgaaagtaaaagttaaggtacgttttacctttaggtaccgtttacgggtaacccaaggacccgaaacgaaaaccccgaaccggaacctaccggtaccccttacccgttaaaacggtccgttacggtacccttttacccgggttttacccggtaccgggggtaccccccgttaacccggttaaacccccggggggtaaacccggttttccccccgggggggttaacccctaacgggtaaaccggttaacgtttaccggtaaacgggggtcccggggtacccgggggtccggggtttaccgggtaacgggggaacccttaacgggtttacttttacccgaaccgttccccttaaacgaaccccttacctacgtaaccggacccgtaacccggtccgttcggggaccgggtaccgtaagggtaacggtacggtttacggggttacgggttttaccggtttttaacttaccggttacgttaacgtacggttaacgtaaggtttaagttttaccgtttaccggtttaacccttaccggttaaccttaccgggttttaacggggttttaccgggaacccgggttaaacggggaccccgttaaggacggttaggacggttaacgacggtaaccgtaacggtacggtacgggttccgtacgtccgaacctcgtacgttacg

SEQ ID NO: 50434 - DNA, 618 bp, Homo sapiens
  misc_feature: GYAE6OF01DGABW.37.83.H06.1.454.CMB.1.raw
  modified_base (310)..(310): a, c, t, g, unknown or other
  misc_feature (310)..(310): n is a, c, g, or t
  modified_base (390)..(390): a, c, t, g, unknown or other
  misc_feature (390)..(390): n is a, c, g, or t
  modified_base (414)..(414): a, c, t, g, unknown or other
  misc_feature (414)..(414): n is a, c, g, or t
  modified_base (422)..(422): a, c, t, g, unknown or other
  misc_feature (422)..(422): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggtctttttcttgtggtcttaattttaaaaggtgtccagtgtgaggtgcagctgctggagtcgtgggggaggcgttggtacgaggcccgggggggtccctggacgactctcctgtgaacgcctctggattccacctttgacaagtgtgccatcgaccgtggtccnccgaggctccgaggggacgggcgtgggaggtcgggtctcgtaagtttattaggtggtagtggtagtagcacgagatacgnagactccgagacgggtcgtacacntctcaganactaatccaacacgcacgctagtatttgacctacatacgaacacgtcctggaacgcggaccggaaggaccgaccggacctaagttacttaatttacgttagtacgtacttaaaccgttttccgtttagtacgtttgtttaacttaccttccccgttaagtaccgaaccgtacggtcggggacccgtaaacccgggg

SEQ ID NO: 50435 - DNA, 895 bp, Homo sapiens
  misc_feature: GYAE6OF01D3W8T.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccatggaggtttgggctgagctggtctttttcttggtggtcttaagttttaaaaggtgtccagtgtgaggtgcagctgcgtagggagtcggtggggggaggtcgttgggtacgacggggtcccgggggggtccctggacgtacctccgttccgtggtacgaacgtcctcgtaggtactttccgtaccgtttgaaccgtaaggttgtccgtacctaacgttcggtacccgttcggggtcccccgaccggtacgggccgttaccggggaaggggggtaacggggtccgtagggggtacggttcgggttcgtaacgttaagggttttaagtttaggggtggttaacgggttagggtaaggtaacgacgtaaggtaacgtaacgttaccgacgtaaacggtaccggttaccggggtaacgggtaaccgggggttcccggtttaccaaaccgtacgtacccgtacgaaacggtaacgaaaccctaacgttaacccgaaacgacgtaccgtaaccggttcgttaggtttactttccggaaacctaacgtaacgttaacggaaaccgtaccgtaccggttaagggaaccggaaccgggacccggaacggggtacccgaaccggtactaatttaacgttaagttttacggtagttaccgtaaaccggttttaccgttttccgttttaggttaacgtttcggtttaacgtttaccccttacccgggttaacgtacccggaacccggttccgggtaccggggtacccggttaaacccgggg

SEQ ID NO: 50436 - DNA, 736 bp, Homo sapiens
  misc_feature: GYAE6OF01BFLQV.37.83.H06.1.454.CMB.1.raw
  modified_base (538)..(538): a, c, t, g, unknown or other
  misc_feature (538)..(538): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatcgacccagtctccagacctcccgtggctgtgtctcgtgggcgaggacgggccacgactcaactgcctaagtccgagccggtagttagtttaactacaactaccgaaagtaaataaggtagtttactttagtacgttcggtaaccagactaaacggaaacccaacgacctaccggaccttacccgaaggtcctacgttcctttaaccgggtttaccgtccggggtcccttacccggttaaccccgggtagttaccccccgggggttcctaacggtaaccgtacgttacggaaccgggttcggggcccggtcggggttcctaggggacctacggttaacttcctaccgtccgtaacgtccaataccgacgtaccgacgtcgngggtccgggtacgtacggtaagtacgtcgggtaggttaccgtttagttacgtgtacgacggtactaagttattacgttcgttaccgtaccgttcgtaacgtttacggttaccggaccggtacggaccgtaagcggtacgtacgtacgtccgaccgtccgtaagtcggtacggttcgacgtcctaaccgtcggttaccg

SEQ ID NO: 50437 - DNA, 873 bp, Homo sapiens
  misc_feature: GYAE6OF01DSZ87.37.83.H06.1.454.CMB.1.raw
tcagtagtgtagatcacgaccggtgctcgatttagatcacgtgcgtcgcggggacaacaggcaggcaggggcagcaagatggtgttgcagacccaggtcttcatttctctgttgctcgtggattctcttgttacctacgaggtcgaccggtacgggactagtcgtagtactcgaaccctagtcctccgacgcctcccgtggtctgtcgtctcgtacgggacgaggacggaccacgactacaacgtcgaactaacggtccgacggtaccggttaagtttcgttttaacaaccaacctacgtaaaagtaaattaacggttacgttttacgtttaacgtaccgttaaccggtaacctaacgaaccgaaacgaaaccgaaccggtaccaacgtaccccgttaacgtacgtaccgtacggttccgtttacccggtttaccggtacccgggttacccgttaacccgggtaaccccgggttacccgggtaccccgggtacccgtaaggtaacccgttagttaccggggaacggggttccgggtaccggggttaccgggttacgggacggtaaccgttaaggttacctttacccgtacccgttacaacccgtaacgtaccgtaacgaccgaccgtaacgggttccggacggggtaaccggtacgtaacgtaacggttacgttcggggtttacggtttagtttaaccgttacgtcggttactaacggtacctttaaagtttcgttacttacgttaaccccttcgtaaccgttacggttacggttaccgggaacggtaacgggactacggtacggtaggtaaccgtacgtacccgtacgtacggttacgtccgggtccgagtacccgacctagttccgttccg

SEQ ID NO: 50438 - DNA, 311 bp, Homo sapiens
  misc_feature: GYAE6OF01DN7O1.37.83.H06.1.454.CMB.1.raw
  modified_base (182)..(182): a, c, t, g, unknown or other
  misc_feature (182)..(182): n is a, c, g, or t
  modified_base (266)..(267): a, c, t, g, unknown or other
  misc_feature (266)..(267): n is a, c, g, or t
  modified_base (269)..(311): a, c, t, g, unknown or other
  misc_feature (269)..(311): n is a, c, g, or t
tcagtagtgtagatcacgaccggtgctcgatttagatcacgtgcgtcgcgggtctgggacagatttcactctcaccatcagcagcctgcgggctgaggatgtggcgtatttattactgtcagcagtattataatactcctccgacgttcggccaagggaccaaggtgaaatcaaaacgatgnggctgcaccatctgtcttcatccttcccgccatctagaaattcctaacactactgacgcggctggacaaaggcgacctagtagnngnnnnnnnnnnnnnnnnnnnnnnnnnnnnnnnnnnnnnnnnnnn

SEQ ID NO: 50439 - DNA, 735 bp, Homo sapiens
  misc_feature: GYAE6OF01BCWMN.37.83.H06.1.454.CMB.1.raw
  modified_base (716)..(716): a, c, t, g, unknown or other
  misc_feature (716)..(716): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctcgtggatctctgttactacgaggtcgccgtacgggacagtcgtagatcgacccagtcctccagacctcccgtggtcttgtcgtcctcgtgggcgaggacggccagactacactgacacgtcgaggaccggtatttcggtttaacaaccaactacgaaagtaataagtgtttctagcgttacgaccagacaacgaaccacgacacgtcctactaagtctgtacgttccgttacgccgggtcccttaccggtaacccgggtaccgttccccgggtacctacgtaacgtacgttccggagggtccggggccggtcggggtacgttaacggacgttaagttacctttccaccgtttaccgaaccgtacgtacgtaccgacggtacctacggtccggtacgggcgggtacaagggtaacggtgggttacggtttacgggtttaccgttttaataccgtcggtaacccgaagttacttaagtttactttcgtttaccgtttaccctcggttaccttacggttccgggtttaccggaccggaacggtacggtacgtaccggtagaccgtaagccccgttaagaccgggttatacgggtcgaccgtanaaccgttccgtctttccgg

SEQ ID NO: 50440 - DNA, 702 bp, Homo sapiens
  misc_feature: GYAE6OF01E4HFJ.37.83.H06.1.454.CMB.1.raw
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgccgtacggggacatcgtgatcgacccagtctccagacctccctggctgtgtctcgtggcgagaggccagactcaactgacaacgtccaggccgtagttgtttaacactaactccaaagtaactaagtacgttcgtttacgcttaggtaccagtacaacgaaaaccacgaacgtacgacctacctaagtcctcgtaccgtttcggtttaccgtcgggtaccccgttaacggtaccccgggtaacgttccccggggtaccctaacgaaccgtacgttacgtacgggtcggggccggtcgggtccgtacgggacctaaggttctttaccgaccgttcctacgacctaataccgacgtacgaccgtccgtggcgggtacctaggtacgtaggttcggtaggttcggtttacttacgtgtacgtagtcgttaacgttagtttaacgtcgttttaacctccgttaacttacggtttaggttccggaccggtaagggaaccctacggtcgttaggacttacgtaaccgcgtaaccgtagtcggacggtcgtaccgcctaccgtcgttccg

SEQ ID NO: 50441 - DNA, 648 bp, Homo sapiens
  misc_feature: GYAE6OF01ALEDW.37.83.H06.1.454.CMB.1.raw
  modified_base (258)..(258): a, c, t, g, unknown or other
  misc_feature (258)..(258): n is a, c, g, or t
  modified_base (280)..(280): a, c, t, g, unknown or other
  misc_feature (280)..(280): n is a, c, g, or t
  modified_base (297)..(297): a, c, t, g, unknown or other
  misc_feature (297)..(297): n is a, c, g, or t
  modified_base (316)..(316): a, c, t, g, unknown or other
  misc_feature (316)..(316): n is a, c, g, or t
  modified_base (427)..(427): a, c, t, g, unknown or other
  misc_feature (427)..(427): n is a, c, g, or t
  modified_base (628)..(628): a, c, t, g, unknown or other
  misc_feature (628)..(628): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtgtcgttttctaggtggctaattttaaaaggtgtccagtgtgaggtgcagctgctggagtcgtggggagcttggtacaggccggggggtccctggagactctcctgtcggaancctgtggattcacttgacagtntgccatgacctggtccncaggctccgagggagggcngggagtgggtctgtagtttattaggtggttaaggtggtaagtacggcagtaacgtagttacccgagagtaacctcggtagggaacgggtcccggttaacaccgagttaccnccgaaggactaacctaacgttcccaaagaacggcctaacgtccgtataacgtttcgcctaagtactacgaaacacgtacccgtaggaacgacgggaccgaagggttaccgaaccggcctaagttagtaatttacgtggtaactaccggttaaactttccgtttagactttggttaaccttcctcccgtagtacccaaccgngttccggggacctaaccggg

SEQ ID NO: 50442 - DNA, 980 bp, Homo sapiens
  misc_feature: GYAE6OF01C4HEW.37.83.H06.1.454.CMB.1.raw
tcagtagtgtagatcacgaccggtgctcgatttagatcacgtgcgtcgcggggacaacaggcaggcaggggcagcaagatggtgttgcagacccaggtcttcatttctcttgttgctcgtggactctctgttactacgaggtcgaccgtacgggacagtcgtgatcgaccctagtcctacacgtacctcccgtggctgtcgtctcgtgggcgaggacggccacgactaccaacgtcgacaacggtccgacggtaccggttaagtttacgttttaacaaacctaaccttaacgaaaagtaaagttaacggttacgttttacgtttaacggtacgtttaccgggtaacccagtaacccgaaaaccggaaacccaaccggaaccgtaaccgtacccttaacccggtaacgtccgttaaccggtttccgtttaccgggttttaaccgccgggttacccccgttaacccggggttaacccccggggtaaccggttacccccgggggttaccctaaacggtaaaccggtttaacgtttaccggggtaacggggtacccgggggtccggggttacccgggggtttacggttaacgggggaaacctttaacgggttttaccttttaacccggtaacccctttacccgttaacccaacccgtaacgtccggaacgacccggttaccgggcccgggttacggggacccgggtaacgttaaggtaacggtacggtttacggggttacggttttaaccggttttaacgttaccgttaggttaacgtaaccggttaagggtttaacttttaaggttttaaccgtttcccgtttaacccgttaccgttaaccggttttaaggttttaccccgggggttaaccgggaacccgggtaacgggttacccgaagggttacggtagggaaaccgtcgtaacccggtacgaaaccgtttacggttcggacggttactacggacccttacgttgttacccg

SEQ ID NO: 50443 - DNA, 855 bp, Homo sapiens
  misc_feature: GYAE6OF01CRZC0.37.83.H06.1.454.CMB.1.raw
  modified_base (321)..(321): a, c, t, g, unknown or other
  misc_feature (321)..(321): n is a, c, g, or t
  modified_base (345)..(345): a, c, t, g, unknown or other
  misc_feature (345)..(345): n is a, c, g, or t
tcagtagtgtagatcacgaccggtgctcgatttagatcacgtgcgtcgcggggagagaggagcccagccctgggattttcaggttgttttcatttggtgatcgaggactgaacagagagaactcacagtggagtttggctgagcgttggttctttttcgttggtggtctttaaagttttaaaaggtctccgtagtggtgaggtgcagctgcgtggagtcggtggggagtcgttggtaccggacggggtcccgggggtcctagacgtaccttcgtccgttgtacgacgtcctgtggtacttccgttacttagactagtgtcncgtagtcgaccgttcggccgacgnggccgacggaagggcggcggtggtacggtgtacttacggttagtttaggttacggtaggttacggtaggttacgtacgacgagtaacgtcggttaacgacgtaacggaccgtcggtaacggtaccgggttacctaccgacgttcgaccgtacgaacgtaacgaactaaccgtacgaaacccgacgcccgttaacggtcgttacggtttacttaccgaacgtaaccgtaacggtaaaccgaacgttaccggaaaccgttacgggaaaacccgggaacccggaaaccgtaaacccggggtaaccgtaaacccggttaacgtttaaaccgtttaccgttaagggtttacgggaaacggttaaacggggaaaccggggtttacgggggtacgggggtaaacgggggttttacccggggtaaccgggtacccgggggaacccggggttaaccccgggtaaccggggttaaccgtttccccgggtaaaccccgtcccccggtttccgtaaccccgg

SEQ ID NO: 50444 - DNA, 279 bp, Homo sapiens
  misc_feature: GYAE6OF01DUSWO.37.83.H06.1.454.CMB.1.raw
  modified_base (141)..(141): a, c, t, g, unknown or other
  misc_feature (141)..(141): n is a, c, g, or t
  modified_base (262)..(279): a, c, t, g, unknown or other
  misc_feature (262)..(279): n is a, c, g, or t
tcagtagtgtagatcacgaccggtgctcgatttagatcacgtgcggcgcgggtctgggacagatttcactctcaccatcagcagcctgcgggctgaagatgtggcggttttattactgtcagcagtattatgttactcctnacagttttggccaggggaccaagctggagatcgcacgaactgtggactgcaccatctgtcttcacttccttcccgccatctgaactctacactactgagcggctgcaaaggcgcagtacgnnnnnnnnnnnnnnnnnn

SEQ ID NO: 50445 - DNA, 810 bp, Homo sapiens
  misc_feature: GYAE6OF01BLSBN.37.83.H06.1.454.CMB.1.raw
tcagtagtgtagatcacgaccggtgctcgatttagatcacgtgcgtcgcgggggagagaggagcccagccctgggtattttcaggttgttttctatttggtgatcaggactgaacagagagaactcaccagtggtaggtttgggctgagtcgttggttctttttcgttaggtggtactttaaagttttaaagggtcgttccgaggttggtggacgggttgccgtaggctggcgtgggtaggtcgggtgggggaggtcgttgggtacggacggggtcccggggggtcctggacgtcttcgtcgtggtagacgtcctgtgtacttcctacgttagagtaggtgtcgcctagtccgtcggtccggtcccgacggtacggccggtacgggaggggacgggtcgtgggtacgggttggtccttaggtagtttaggttagggtaggttacgggttaggtaggcgaacggtactaaggtacgtacgacgacggtacggtcgggtaacggggtaccgggttccgttacaccgtcgtacctaacgggactaacggtaacttaaccggaccagtacgaccgttccggtattaaggtttacctcgactaaacgtacaacggacccgtagtcggtaacggcgggttaacgccgggaaagtcccggtaactagttaacgttaagttctttagggttacggtaccttaaaccgttttaccggttttacgttaagtttccgttaaagttttcccaacccccgtttagggtaccgtaacccggaccgggttaccgggggtcccggtaaacccggttacccccgggg

SEQ ID NO: 50446 - DNA, 740 bp, Homo sapiens
  misc_feature: GYAE6OF01A8HWE.37.83.H06.1.454.CMB.1.raw
tcagtagtgtagatcacgaccggtgctcgatttagatcacgtgcgtcgcggggagagaggagcccagccctgggattttcaggtgttttcatttggtgatcaggactgaacagagagaactcaccatggagttgggctgagctggtcttttctgtgcttaagtttaaaaggtgtccagtgtgaggtgcagctgcgtggagtcggtggggagcgttaggtacgacggggtcccggggggtcctaggacgtaccttccgtccgtggtacggaacgtccgtcggtaggtactttcctaccgttttaggaactaaggttcgtccgtacctagtccggtaccggtcggggtacccgcccgtacggtcccgttacggggaacggggtaaggggtccgtaggggtagggtcgggtctacggtaggtttagttacgggtggttaggtaggtacgtagacgaacgtagtaagttaccgagacggtaccgtacggtacgggtaccgggtccgtacaccgtcgtcacgaagtacgtaacctacgtaaccaagacgaccacgtctagttagttccgaactacgtagtaacgtacacggtaccgtaggaacggacggaccgtaagggaaccgtacggactaagttattacgttagttgtacgtaaccgtttaacgtttcgtttagtacgttcggtttaactacccgtttacccgtacggtaccgtacgcccggttaccggggccgtaacccgg

SEQ ID NO: 50447 - DNA, 842 bp, Homo sapiens
  misc_feature: GYAE6OF01BM99S.37.83.H06.1.454.CMB.1.raw
  modified_base (160)..(160): a, c, t, g, unknown or other
  misc_feature (160)..(160): n is a, c, g, or t
  modified_base (199)..(199): a, c, t, g, unknown or other
  misc_feature (199)..(199): n is a, c, g, or t
  modified_base (552)..(552): a, c, t, g, unknown or other
  misc_feature (552)..(552): n is a, c, g, or t
  modified_base (617)..(617): a, c, t, g, unknown or other
  misc_feature (617)..(617): n is a, c, g, or t
tcagtagtgtagatcacgaccggtgctcgatttagatcacgtgcgtcggcgggggagagaggacgcccagcccgtgggattttcgaggttgttttcatttggtgatccaggactgacagagagactcaccatggtagtttggctgaggtctggtcttttnttagtgtacttaagtttaaagtgtaccagtgtcgagtcncagtctgcgtggtacggtggaggggacgtcttcggtacgacgggtacccgggggtcctaggtacgactccgtccgtagtagaacgtcctacgtaggtacttaccgtaacccgttttagaaccgtaacgttgggtaacgacccttaagtaccggttaaaccggccggggttcccccaaacgaaccggtaaccccttaccgggaaggggtaaacgggttccgaggggttaccgtaggggttaccctttagtaaagtttaggtttaacggtaggttacgtaggtaacgtagtaaccgagttacgaacgttacgccgtaagaacccgttcggtacgggtaaacggtccccgttaaanaaccctagttaccgaacctaagggtaacccacgtaaccttaaccggaaactacgaacgtacccgngtttaacggttattaccggactaacacgtaaccgtaaaccgtagaccgttaacgacggaaccgttaacggactaccggaaacgtctaataaccttagttacgtagttacggaaacccttaccggttttacttaacggtaactttacggtttaacgtttaacccccgacccggttaaccggtacgttaaccccggtacgggtccccggggtaacttaaaccccggg

SEQ ID NO: 50448 - DNA, 746 bp, Homo sapiens
  misc_feature: GYAE6OF01CC0SP.37.83.H06.1.454.CMB.1.raw
tcagtagtgtagatcacgaccggtgctcgatttagatcacgtgcgtcgcggggacaacaggcaggcaggggcagcaagatggtgttgcacgacccaggttcttctattttctctgttgctctggattctcttgttactacgaggtcgccggtacggggactagtcgtagacgtacgacctacgtcctaccgacgtccgtcccgtggtcttgtcgttccgtcggtcggggacggacggacggaccaacgtactacgtaacgtcgacgtaacgtccgacggtcggttagtttacgtttaacaacgtaacaacgtaaaagtaacgttaagtacgttttagttacgtacgttacgacaacgacaacgaaccacgacaccgtacctacgtacgctacgtccgtttacgtacgccggtaccctaccgggaccggttaccggtccggtaacctagaacgttcgtacggagggtccgggcggttacggtagtacgggacttacgtcttaccgactacccacgaactcgccgagtaaccgccggtacggtggggtacgtagtaaaggtcgttggttacggggtttacggtttaactttacgacggttgaaccgtaaggttaccttaagttttcgtactttaccggtccctacgttacgttaccgggtttaggtcccggaacgggttacgaccttagcggtaacgtaccgtactacggtacgacgttgggcgtacgactcgaactcgttagttccc

SEQ ID NO: 50449 - DNA, 576 bp, Homo sapiens
  misc_feature: GYAE6OF01B64HB.37.83.H06.1.454.CMB.1.raw
  modified_base (242)..(242): a, c, t, g, unknown or other
  misc_feature (242)..(242): n is a, c, g, or t
  modified_base (309)..(309): a, c, t, g, unknown or other
  misc_feature (309)..(309): n is a, c, g, or t
  modified_base (403)..(403): a, c, t, g, unknown or other
  misc_feature (403)..(403): n is a, c, g, or t
  modified_base (478)..(478): a, c, t, g, unknown or other
  misc_feature (478)..(478): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggttgccgtacggggacatcgtgatcgacccagtctccagactccctggctgtgtctcgtgggcagacgggtccacggatcaactgcaagtcagccggtatgtttanacaactcaagaataacgagttcttaagcgttaggtaccagtacagtaaaccacgacagcctacgtancgtagctcgtttaacctgggcctcgtacccggaatccgggtaccctgacgacttcacgtaggtcggcggtctggggatacgattttcgacttcnctacacgtcaagcctagccgtcgcgggcttaggaaagtagtgtgggtacggtttaatttaccgtaggtccgtaanacgagtaagtttaaatcgtttaactccttacgacttaaggtttcgaccgtagggacctaaagcctaggacgatacgctagaactgtgatgcgccatcg

SEQ ID NO: 50450 - DNA, 1000 bp, Homo sapiens
  misc_feature: GYAE6OF01ASOK5.37.83.H06.1.454.CMB.1.raw
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtcgccgtacggggacatcgtgatcgacccagtcctccagacctccctggctgtgtctcgtgggcgaggacggcctccatacaactgcaacgtccagccagtacttagttttactacgacgccttaccaaactaaagtaaacgtaaaccttaacgtttaacggaccgtttagggtaacttccgaaaggaacccgtaaaacggaaaaaccccggtacgggggtaccctaaccggtacccctttaacccgttaaaaacgtccggtaacctttaaccgttaacgtttttacccggtacggggtaacccttaaccggttacccccggtaaccccgggggttacccggggtttaccccccgggggttaccccttacgggtaaaccccggttacggtttaacccggaacgggtttaccgggacccggtaacgggggttacccgggggtttaccgggtaaccggggtaaccgttaaacgggttttacccgtttttaacccgaaccccgttttaccccgttaccccgtaaaaccccggttaacccttaaacccgtaaaacccccggtaccggttacccccggtacggaaccccgggtacgggtacccggttaacggggtaacgggttaacgggttcggggtttaaccgggttaccgtttaacgttttttaaccggttaaccgttccggttaacgtagtaacccggttaagttttaaaccctaagttaaaccccgttccggttaccccgttaccgggtaaccggttaaccccgggaaccggtaaaccggggttaaccgtaacgggggtaaactaaaaccgttaaccggaaaaccggttcgttacggtaacccgcgtaccggtaccctaaccgg

SEQ ID NO: 50451 - DNA, 681 bp, Homo sapiens
  misc_feature: GYAE6OF01BLI0B.37.83.H06.1.454.CMB.1.raw
tcagtagtgtagatcacgaccggtgctcgatttagatcacgtgcgtcgcgggacaacaggcaggcaggggcagcaagatggtgttgcagacccaggtcttcatttctcttgttgctctggatctctggtcgcctacgggacaccgtgatcgacccagtctccgagtacctccgtggctgtcgtctcgtggcgagacggcctaccagtccaacgtcgaccaacgtccaggacctagtactttagtttaacaccgacgtcctacaaataaagtaacgtaaccttacgttagtacgtttacggtaactccgaacgacgaaaacggtaaacccggagggacctaccggtaacccttaacgtaaaccgtcgaccttacgtagttacgcggactacgtacccggttaaccgggtgtaccccggtcctacgaccgtagttcgaacggtcgacgtacggcggttcgtaggactaagtcctttacgacttacgaccaactctaacacgtcgtccgtagacgtacggtacgtagacggtacgtcggtacggtacttaagttacgtctacgtacgtagtacgtagttaatacgtaacttcccgtacgtaccggtacgtacggaccgaacgtaccgaagtacgaactaacgtaacacgtagaccgtacgtacacgtaaatccttagtcgtacc

SEQ ID NO: 50452 - DNA, 538 bp, Homo sapiens
  misc_feature: GYAE6OF02H4NES.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtgcgtttctaggtggctatttaaaaggtgtccagtgtgaggtgcagctgctggagtctggggggaggcttggtacaggccggggggggtccctggagactctcctgtgaagcctctggattcacctttgacaagtgtgccatgacctgggtccgccaggcctccaggggaaggggctggagtgggtctcagttattagtggtagtggtagtagcacagattacgcagactccgtgaagggccggttcaccatcctccagagacaattccaacagcacgctgtatttgcacatgaacagcctgagagccgaggacacggcatatattatgtgcgtaaacttcctttagactggtttatacttccctagtcgaccacgtcggggcctaaccgggg

SEQ ID NO: 50453 - DNA, 256 bp, Homo sapiens
  misc_feature: GYAE6OF02F2DWJ.37.83.H06.1.454.CMB.1.raw
  modified_base (256)..(256): a, c, t, g, unknown or other
  misc_feature (256)..(256): n is a, c, g, or t
tcagtagtgtagatcacgaccggtgctcgatttagatcacgtgcgtcggcgggtctgggacagatttcactctcaccatcagcagcctgcgggctgaagatgtggcggtttattactgtcagcagtattatgttactcctcacagttttggccaggggaccaagctggagatcgcacgaactgtggctgcaccatctgtcttcatcttcccgccatctgaatctacactactgagcgggctggcaaggcgcatagn

SEQ ID NO: 50454 - DNA, 258 bp, Homo sapiens
  misc_feature: GYAE6OF02IM69G.37.83.H06.1.454.CMB.1.raw
  modified_base (257)..(258): a, c, t, g, unknown or other
  misc_feature (257)..(258): n is a, c, g, or t
tcagtagtgtagatcacgaccggtgctcgatttagatcacgtgcgtcggcgggtctgggacagatttcactctcaccatcagcagcctgcgggctgaagatgtggcggtttattactgtcagcagtattatgttactcctcacagttttggccaggggaccaagctggagatcgcacgaactgtggctgcaccatctgtcttcatccttcccgccatctgaatctacactactgagcgggctggcaaggcgcatagnn

SEQ ID NO: 50455 - DNA, 503 bp, Homo sapiens
  misc_feature: GYAE6OF02H6VEF.37.83.H06.1.454.CMB.1.raw
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttatacaactccaagaataagagttctttagcttggtaccagcagaaaccacgacagcctcctaagctgctcgtttactgggcctctacccgggaatccggggtccctgaacgattcagtggcggcgggtctgggacagatttcactctcaccatcagcagcctgcggctgaagatgtggcggtttatactgtcagcagtattatgttactcctcactagtttggccaggggaccagctggagatcgcacgaactgtggctgcaccatcg

SEQ ID NO: 50456 - DNA, 260 bp, Homo sapiens
  misc_feature: GYAE6OF02H87BM.37.83.H06.1.454.CMB.1.raw
  modified_base (254)..(260): a, c, t, g, unknown or other
  misc_feature (254)..(260): n is a, c, g, or t
tcagtagtgtagatcacgaccggtgctcgatttagatcacgtgcgcgcgggtctgggacagatttcactctcaccatcagcagcctgcgggctgaagatgtggcggtttattactgtcagcagtattatgttactcctcacagttttggccaggggaccaagctggagatcgcacgaactgtggctgcaccatctgtcttcatcttcccgccatctgaatctacactactgagcgggctggcaaggcgcatagnnnnnnn

SEQ ID NO: 50457 - DNA, 258 bp, Homo sapiens
  misc_feature: GYAE6OF02JCAYQ.37.83.H06.1.454.CMB.1.raw
  modified_base (254)..(258): a, c, t, g, unknown or other
  misc_feature (254)..(258): n is a, c, g, or t
tcagtagtgtagatcacgaccggtgctcgatttagatcacgtgcgcgcgggtctgggacagatttcactctcaccatcagcagcctgcgggctgaagatgtggcggtttattactgtcagcagtattatgttactcctcacagttttggccaggggaccaagctggagatcgcacgaactgtggctgcaccatctgtcttcatcttcccgccatctgaatctacactactgagcgggctggcaaggcgcatagnnnnn

SEQ ID NO: 50458 - DNA, 262 bp, Homo sapiens
  misc_feature: GYAE6OF02IUZCO.37.83.H06.1.454.CMB.1.raw
  modified_base (232)..(232): a, c, t, g, unknown or other
  misc_feature (232)..(232): n is a, c, g, or t
  modified_base (253)..(262): a, c, t, g, unknown or other
  misc_feature (253)..(262): n is a, c, g, or t
tcagtagtgtagatcacgaccggtgctcgatttagatcacgtgcgcggcggtctgggacagatttcactctcaccatcagcagcctgcggctgaagatgtggcggtttattactgtcagcagtattatgttactcctcactagttttggccaggggaccaagctggagatcgcacgaactgtggctgcaccatctgtcttcatcttcccgcatctgaatctacactactgancgggctggcaaggcgcatagnnnnnnnnnn

SEQ ID NO: 50459 - DNA, 541 bp, Homo sapiens
  misc_feature: GYAE6OF02HSKJ6.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggcttttcttgtggctattttaaaaggtgtccagtgtgaggtgcagctgctggagtctgggggaggcttggtacagccgggggggtccctgagactctcctgtgaagcctctggattcacctttgacaagtgtgccatgacctgggtccgccaggctccgagggaaggggctgggagtgggtctcagttattagtggtagtggtagtagcacagattacgcagactccgtgaagggccgttcaccatcctccagagacaattcaacagcacgctgtattgcacatgaacagcctgagagccgagacacggccagtatattattgtgacgtaaacttctttgacttggtttaacttacgttcccctagtcgtacccgtacgtcggggcctaacgggg

SEQ ID NO: 50460 - DNA, 262 bp, Homo sapiens
  misc_feature: GYAE6OF02JACIR.37.83.H06.1.454.CMB.1.raw
  modified_base (256)..(262): a, c, t, g, unknown or other
  misc_feature (256)..(262): n is a, c, g, or t
tcagtagtgtagatcacgaccggtgctcgatttagatcacgtgcgtcggcgggtctgggacagatttcactctcaccatcagcagcctgcgggctgaagatgtggcggtttattactgtcagcagtattatgttactcctcacagttttggccaggggaccaagctggagatcgcacgaactgtggctgcaccatctgtcttcatcttcccgccatctgaatctacactactgagcgggctggcaaggcgcatagnnnnnnn

SEQ ID NO: 50461 - DNA, 592 bp, Homo sapiens
  misc_feature: GYAE6OF02HNXJT.37.83.H06.1.454.CMB.1.raw
  modified_base (371)..(371): a, c, t, g, unknown or other
  misc_feature (371)..(371): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtggtcgtttctaggtggctatttaaaaggtgtcagtgtgaggtgcagctgctggagtctgggggaggcttggtacaggccgggggggtccctggagactctcctgtgaagcctctggattcacctttgacaagtgtgccatgacctgggtccgccaggctccgagggaaggggctgggagtgggtctcgagttattagtggtagtggtagtagcacagtattacgnagactcggtgaagggccgttcaccatctccagagacaattaccaacagcacgctagtattgcacatagaacagcctagagacggccggaaggaccacggaccaagttataagtttattggtacgtacgttaaacctttcgttttacggtaacttaggtttaactttaccgtaccccgttaaggttaccgtaacccgtacggtacggggaccctaaccgggg

SEQ ID NO: 50462 - DNA, 549 bp, Homo sapiens
  misc_feature: GYAE6OF02G1P05.37.83.H06.1.454.CMB.1.raw
tcagtagtgtagatcacgaccggtgctcgatttagatcacgtgcgtcgcgggggacaacgaggacgaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttatacaactccaagaataagagttcttagcttggtaccagcagaaaccacgacagcctcctaagctgctcgtttactgggcctctacccgggaatcccggggtcctgaacgactcagtggcggcgggtctgggacagatttcactctcaccatcagcagcctggcggctgaagatgtggtcggtttattacgtgtcagctagtattattgttactcctctacgtggttttcggccgtaggggaccaggtcgtacgggaagtacttccggactaccgtaacgtggttcggcgtacggacctaccgattaccg

SEQ ID NO: 50463 - DNA, 547 bp, Homo sapiens
  misc_feature: GYAE6OF02I99BQ.37.83.H06.1.454.CMB.1.raw
  modified_base (385)..(385): a, c, t, g, unknown or other
  misc_feature (385)..(385): n is a, c, g, or t
  modified_base (414)..(414): a, c, t, g, unknown or other
  misc_feature (414)..(414): n is a, c, g, or t
  modified_base (430)..(430): a, c, t, g, unknown or other
  misc_feature (430)..(430): n is a, c, g, or t
  modified_base (443)..(443): a, c, t, g, unknown or other
  misc_feature (443)..(443): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtgtcgtttctaggtggctatttaaaggtgtcagtgtgaggtgcagctgctggagtctgggggaggcttggtacagccggggggtcctgagactctcctgtgaagcctctggattcacctttgacaagtgtgccatgacctgggtccgccaggctccgagggaacggggctgggagtgggtctcagttattagtggtagtggtagtagcacagattacgcagactccgagacgggccgttnaccatcgtccagtagactaattcccaacngcacgctgtattgcanatgacagctgagnccgagacacggccagtatacttagttgtacgtcgaaacgccccgaacggtcgaaccacgtagttcgggaacgtcgtttttacgacgtttcgtaggggtaacccg

SEQ ID NO: 50464 - DNA, 257 bp, Homo sapiens
  misc_feature: GYAE6OF02FHHL5.37.83.H06.1.454.CMB.1.raw
  modified_base (255)..(257): a, c, t, g, unknown or other
  misc_feature (255)..(257): n is a, c, g, or t
tcagtagtgtagatcacgaccggtgctcgatttagatcacgtgcgcgcgggtctgggacagatttcactctcaccatcagcagcctgcgggctgaagatgtggcggttttattactgtcagcagtattatgttactcctcacagttttggccaggggaccaagctggagatcgcacgaactgtggctgcaccatctgtcttcatcttcccgccatctgaatctacactactgagcgggctggcaaggcgcatagnnn

SEQ ID NO: 50465 - DNA, 521 bp, Homo sapiens
  misc_feature: GYAE6OF02IMG0H.37.83.H06.1.454.CMB.1.raw
  modified_base (229)..(229): a, c, t, g, unknown or other
  misc_feature (229)..(229): n is a, c, g, or t
  modified_base (304)..(304): a, c, t, g, unknown or other
  misc_feature (304)..(304): n is a, c, g, or t
  modified_base (387)..(387): a, c, t, g, unknown or other
  misc_feature (387)..(387): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcagaaaccagggcagcctcctaaactgctcatttacnggcatctacccgggagtcccggggtcctgaccgattcgagtggcaggcgggtctgggacagatttcactctcaccatcaaacncgcctgcaggctgaggatggtggcgtattttatactgtcagctagttatataatacttcctccgtacgttcggaccaagggaccaagggtagaaactacaaacgtaactgtaggctgaccaccatcctgttacc

SEQ ID NO: 50466 - DNA, 536 bp, Homo sapiens
  misc_feature: GYAE6OF02JCWFW.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtctgggggagcttggtacaggccgggggggtcctgagactctcctgtgaagcctctggattcacctttgacaagtgtgccatgacctgggtccgccaggctccgagggaaggggctgggagtgggtctcgagttattagtggtagtggtagtagcacagattacgcagactccgtgaagggccggttcaccatctccagagacaattccaacagcacgctgtatttgcacatgaacagcctgagagccgagacacggccatatattattgtgacgtaacttcctttagacttggttacttactccccttagtcgaccacgtgggaccctaacggg

SEQ ID NO: 50467 - DNA, 571 bp, Homo sapiens
  misc_feature: GYAE6OF02FQ7OG.37.83.H06.1.454.CMB.1.raw
  modified_base (366)..(366): a, c, t, g, unknown or other
  misc_feature (366)..(366): n is a, c, g, or t
  modified_base (453)..(453): a, c, t, g, unknown or other
  misc_feature (453)..(453): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggctttttcttgtggctattttaaaggtgtccagtgtgaggtgcagctgctggagtcgtgggggaggcttgggtacaggccggggggggtccctgagactctcctgtgaagcctctggattcacctttgacaagtgtgccatgacctggggtcccgccaggctccgaggggaggggctgggaggtgggtctcgagttattaggtggtagtggtagtagcanagattacgcagactcggtgaacggggccggttcacctatcctaccagagactaattcccaacagcacgctgtatttgcacatgaacngcctgagacgccgaggacaccggccaatatattagttgtagtacgtaactttccgtttagtacgttggtttatttaccttcccctagtaccgacctacggtcggggccctaaccgggg

SEQ ID NO: 50468 - DNA, 533 bp, Homo sapiens
  misc_feature: GYAE6OF02F2S42.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggcttttcttgtggctattttaaaaggtgtccagtgtgaggtgcagctgctggagtctgggggaggcttggtacaggccggggggtccctgagactctcctgtgaagcctctggattcacctttgacaagtgtgccatgacctgggtccgccaggctccgaggggaaggggctggagtgggtctcagttattaggtggtagtggtagtagcacagattacgcagactccgtagaagggccgttcaccatctccagagacaattccaacagcacgctgtatttgcacatgaacagcctgagacgccgagacacggccatatattatgtgacgtaactttcctttagacttgttattactccctagtacgaccacgtcgggcctaacggg

SEQ ID NO: 50469 - DNA, 560 bp, Homo sapiens
  misc_feature: GYAE6OF02FQZMU.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtggcgttttcttaggtggctattttaaaaggtgtccagtgtgaggtgcagctgctggagtctgggggaggcttggtacagccgggggggtccctggagactctcctgtgaagcctctggattcacctttgacaagtgtgccatgacctgggtccgccaggctccgagggaaggggctgggagtggggtctcagttattagtggtagtggtagtagcacagattacgcagactccgtgaagggccgttcaccatctccagagacaattccaacagcacgctgtatttgcacatgaacagcctgagagcgaggacacggccagtatattagttgtgacgtaaacctttccttttagtaccttaggtttactttaacgtccccgttagtcgaccctacgttcggggcctaacccgggg

SEQ ID NO: 50470 - DNA, 546 bp, Homo sapiens
  misc_feature: GYAE6OF02I0MTX.37.83.H06.1.454.CMB.1.raw
  modified_base (367)..(367): a, c, t, g, unknown or other
  misc_feature (367)..(367): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtggcttttcttgtggctattttaaaaggtgtccagtgtgaggtgcagctgctggagtctgggggaggcttggtacagccgggggggtccctgagactctcctgtgaagcctctggattcacctttgacaagtgtgccatgacctgggtccgccaggctccgagggaaggggctgggagtgggtctcagttattagtggtagtggtagtagcacagattacgnagactccgtgaagggccgttcaccatctccagagacaattccaacagcacgctagtatttgcacatgaacagcctgagagccgaggacacggccatatattattgtgacgtaactttccttttagacttggttactttatccccttagttcgacccgtacgtcggggacctaaccgggg

SEQ ID NO: 50471 - DNA, 547 bp, Homo sapiens
  misc_feature: GYAE6OF02J1OJM.37.83.H06.1.454.CMB.1.raw
  modified_base (238)..(238): a, c, t, g, unknown or other
  misc_feature (238)..(238): n is a, c, g, or t
  modified_base (312)..(312): a, c, t, g, unknown or other
  misc_feature (312)..(312): n is a, c, g, or t
  modified_base (339)..(339): a, c, t, g, unknown or other
  misc_feature (339)..(339): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttcttagcttggtaccagcagaaaccacgacagcctactaagctgctcgtttacnggcctcgtacccgggatccggggtccngaacgattcagtggcggcgggtctcgggacagtactttcactctcaccatcagcacgccgtcgcggctgaagatggtggtcgtttagttacgtcgtcgtagctagttattatacgttactctactactacgtttcggccgtagggtaccagcgtaggacgtacgtcgtacgtacgtaacgtcggtacggcgtcgactacctagttccg

SEQ ID NO: 50472 - DNA, 583 bp, Homo sapiens
  misc_feature: GYAE6OF02G3122.37.83.H06.1.454.CMB.1.raw
  modified_base (387)..(387): a, c, t, g, unknown or other
  misc_feature (387)..(387): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttatacaactccaagaataagagttctttagcttggtaccagcagaaaccacgacagcctcctaagctgctcgtttactgggcctctaccggatccggggtcctgaacgattcagtgcagcggtctgggacagattcacctcacactacacacncgtctcgacgacgtcgtaggagtgtggtcgagttagttacttacgtcgtacgacgtacgtaagttattaacttaactaccgttaccgttaccggttaccggttaccggaaccggtaacggaaccggtaagggtaaacgaacgtaaccgaaacgtacgttacggtacgtacgtcgtaccactacttacgtcgttacc

SEQ ID NO: 50473 - DNA, 834 bp, Homo sapiens
  misc_feature: GYAE6OF02H9GZX.37.83.H06.1.454.CMB.1.raw
  modified_base (238)..(238): a, c, t, g, unknown or other
  misc_feature (238)..(238): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtcagccggagttgtttanacaactccaagaataagagttcttagcttggtaccagcaagaaaccacgacacgcctactaagctgcttcgtttacgtcgggtaccttccgtaacccgggtaacgtccccgggggtaccctaggtaaaccgtacgtttccgaaggttcggggccgggtccggggttaccgtagggggaacctaggtaactttttccgaaccgtttccgtaccgtaacccgtaagttaccgtaacggtacccgtaacggtccccgttacgggaccggggtacccgttagggtaaaacggtacggtttacgggttacggggtttaccgggttttttaaacgtttaaccggttacggtttaccgtaacggtaccgtaaggttttaaacgttttaacggtttaccgttttaacccgttaccccgttaaccgttaaaccgtttaacgggttttttaccgggaaccccgggttaaacggggggtaaaccccgtaacgggttacccggttacggggtaaaccggtaacggttacccggaacccgttaaaccggtaaccggtttacgggttacgggtaccgttacggtaacccgtacccgttacgtttacccgg

SEQ ID NO: 50474 - DNA, 255 bp, Homo sapiens
  misc_feature: GYAE6OF02GH73U.37.83.H06.1.454.CMB.1.raw
  modified_base (253)..(255): a, c, t, g, unknown or other
  misc_feature (253)..(255): n is a, c, g, or t
tcagtagtgtagatcacgaccggtgctcgatttagatcacgtgcgcgcgggtctgggacagatttcactctcaccatcagcagcctgcgggctgaagatgtggcggtttattactgtcagcagtattatgttactcctcacagttttggccaggggaccaagctggagatcgcacgaactgtggctgcaccatctgtcttcatcttcccgccatctgaatctacactactgagcggctggcaaggcgcatagnnn

SEQ ID NO: 50475 - DNA, 561 bp, Homo sapiens
  misc_feature: GYAE6OF02G4TC8.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggctttttcttgtggctattttaaaaggtgtccagtgtgaggtgcagctgctgggagtcgtggggggaggcttgggtacgaggccggggggggtccctggagactctcctgtgaagcctctggattcacctttgactaagtgtgccatgaccgtgggtcccgccgaggcctccgaggggaaggggctgggaggtgggtctcgtagttattaggtggtagtggtagtagcagagtatacgcagactccggtagaacggggtccgttacacctatctccgagaacgacaacttaccaacagcacgctagttattgacacatagaacacgcctgagacgacgagacgacgcatatatatgtcgactaacttctttgacttgttattacttaccctagtcgaccgacgtcgggctacggg

SEQ ID NO: 50476 - DNA, 544 bp, Homo sapiens
  misc_feature: GYAE6OF02IN7J5.37.83.H06.1.454.CMB.1.raw
  modified_base (238)..(238): a, c, t, g, unknown or other
  misc_feature (238)..(238): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagttgtttanaccaactcaagaataagagtttcttagcttggtaccagcaagaaaccacgacagcctcaagctgctcgttactcggcctcgtaccgggatccggggtcctagaacgcttcagtcggcggcgggtcgtgggacagtatttcactctcacctatcgagcagtccgtggcgggtctacggaagtgtagtcgggtacggttttatactgtcagctagtacttagtcgtactcctactagtacgtttcgccgaagggtaccagtcgtaggagtactccgacacgtacgttgtcggactggacctactgtcg

SEQ ID NO: 50477 - DNA, 520 bp, Homo sapiens
  misc_feature: GYAE6OF02HPWT4.37.83.H06.1.454.CMB.1.raw
  modified_base (236)..(236): a, c, t, g, unknown or other
  misc_feature (236)..(236): n is a, c, g, or t
  modified_base (307)..(307): a, c, t, g, unknown or other
  misc_feature (307)..(307): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccgagtgtttanacaactcaagaataagagttcttagcttggtaccagcagaaaccacgacagcctctaagctgctcgttacngggcctcgtaccggatccggggtacctgaacgattcgagtcggcggcggtctgggacagtattcactctcacatcagcagccgtgcggctagagagtgtggtcgtttattactgtacagcagttattagtcgtactcctctacttagtttcgacgacgggaccagtcgtaggagtactcgcgaacgtaacgtgtcggcgtagactacctatcg

SEQ ID NO: 50478 - DNA, 501 bp, Homo sapiens
  misc_feature: GYAE6OF02G89IS.37.83.H06.1.454.CMB.1.raw
  modified_base (413)..(413): a, c, t, g, unknown or other
  misc_feature (413)..(413): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttatacagctccaacaataagaactacttagcttggtatcagcagaaaccagggcagcctcctaaactgctcatttactgggcatctacccgggagtccggggtccctgaccgattcagtggcagcgggtctggggacagatttcactctcaccatcaacagcctgcaggctgagatgnggcgtatttatactgtcagcagttattataatactcctcgacgttcgccaagggaccaaggtgaaatcaaacgactgtgctgcactac

SEQ ID NO: 50479 - DNA, 787 bp, Homo sapiens
  misc_feature: GYAE6OF02HPZS5.37.83.H06.1.454.CMB.1.raw
  modified_base (127)..(127): a, c, t, g, unknown or other
  misc_feature (127)..(127): n is a, c, g, or t
  modified_base (130)..(130): a, c, t, g, unknown or other
  misc_feature (130)..(130): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctgggtatctnttnttactacgtggtcgtaccggtacggatagtcgtagatccgaccgtacgtcctacacgtacctccgtcgtcgtgtcgtctcggtcgggacgagggaccggtccctacctactacctaacgtcgaacgtaaccgtaccgacgaccgacgttacgttttagtttaacacgacgtcctaaccaaataaagtaaactaacttaacgtacgttacgttagtactacgacgacgaaaccgaaaccggacggacgaccgacccttaaaccttaacgtcgtctacttaactttacggtacggtactacgttacccggtaccgggtaccggggttccccggtccgtacggaacgttacgtacgaggtcggacgtacgggtccggttcggacgggtacgagtttactttacccgtacttacccgtaccaaccgtacgtaaccaacgaccgtaccgtcgaaccggtacggtaccgtaggtaggtacgttgggtcggtacgtttaattttacgttacgttacgtacgtagtacgttaagtttaactttaaattaaccttacctcccgttaccggtaccgtttccggaaccggtaaccgggtaaccgtaaagggtaacgtaaccgtaacgtaaacgttacggtaggtaccggtacgtacgtaccctaaccg

SEQ ID NO: 50480 - DNA, 262 bp, Homo sapiens; identical to SEQ ID NO: 50460
  misc_feature: GYAE6OF02I07MM.37.83.H06.1.454.CMB.1.raw
  modified_base (256)..(262): a, c, t, g, unknown or other
  misc_feature (256)..(262): n is a, c, g, or t

SEQ ID NO: 50481 - DNA, 726 bp, Homo sapiens
  misc_feature: GYAE6OF02J0BUR.37.83.H06.1.454.CMB.1.raw
  modified_base (295)..(295): a, c, t, g, unknown or other
  misc_feature (295)..(295): n is a, c, g, or t
  modified_base (415)..(415): a, c, t, g, unknown or other
  misc_feature (415)..(415): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtgtcgtttcgtaggtcggctatttaaaggtgtcagtgtgaggtgcagctgctggagtcgtggggagcgttaggtacaggccgggggggtccctggaggtactcctccgtgttagaacgcctgaggtacttcacgtttgacaagtgtgccntgcctggtccgccaggctccgaagggacggggctgggagtcgggttccgacgtaggtttaagttacggtgggttaaggtccggtaaggttaaggccttaacggagtacttacggcggaanaccgtaccggtggaacgggtcccggttacaacgactttctacccggaagacggaacgtaactttacccgaagtacggacctaacggacgttggtaactttcggacttaccgaattcggaacccaaggccgttaccggacaggtaccccggaaaggtcggaaacccggttaccaaaggtttcttaaaccgtaaggtttcgttaaaccgcggttttaaaacctttccctttaaggtacgtttacggttttacttaccggttaccccgtttaagccgtaacccgttaccgggtacggggtacccttaaccgggg

SEQ ID NO: 50482 - DNA, 520 bp, Homo sapiens
  misc_feature: GYAE6OF02GKS1E.37.83.H06.1.454.CMB.1.raw
  modified_base (229)..(229): a, c, t, g, unknown or other
  misc_feature (229)..(229): n is a, c, g, or t
  modified_base (386)..(386): a, c, t, g, unknown or other
  misc_feature (386)..(386): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttanacagctccaacaataagaactacttagcttggtatcagcagaaaccagggcagcctcctaaactgctcatttactgggcatctacccgggagtccggggtccctgacagattcagtggcagcgggtctggggacagatttcactctcaccatcaacngcctgcagggctgaggatgtggcgtatttattactgtcagactagtaatttataattactcctccgacgttcgaccaagggaccaagggtcggaaatcgaaacgtaacgtagtcggactgaccactatcttacg

SEQ ID NO: 50483 - DNA, 599 bp, Homo sapiens
  misc_feature: GYAE6OF02GY2CB.37.83.H06.1.454.CMB.1.raw
  modified_base (173)..(173): a, c, t, g, unknown or other
  misc_feature (173)..(173): n is a, c, g, or t
  modified_base (294)..(294): a, c, t, g, unknown or other
  misc_feature (294)..(294): n is a, c, g, or t
  modified_base (351)..(351): a, c, t, g, unknown or other
  misc_feature (351)..(351): n is a, c, g, or t
  modified_base (355)..(355): a, c, t, g, unknown or other
  misc_feature (355)..(355): n is a, c, g, or t
  modified_base (399)..(399): a, c, t, g, unknown or other
  misc_feature (399)..(399): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcggtgtgtttctaggtggctatttaaaggngtcagtgtgagtgcagctgctgagtctgggggagcttggtacaggtccggggggtcctggaagactctcctgtgagcctcgtggattcacctttgacaagttgtcgccatgacctgggccncgagctccgagggagggctgggagtgggtctgagttattagtggtagtaggtaggtncaangtattacgcacgacgtccgtagaacggggtccgttcgaaccctntcgtaccgaagacgactaacttaccaaagccgacgtacgcttagttacttcgtactactagtacgaacgacgacgtagacgacgacggacggacgacgactatatagttattagtagtacgttaacgtttctttacgttacgttacgttacgttaccgttaccgttacgttacgtaccgtacggtacggtaccggtacgg

SEQ ID NO: 50484 - DNA, 576 bp, Homo sapiens
  misc_feature: GYAE6OF02GEYYZ.37.83.H06.1.454.CMB.1.raw
  modified_base (158)..(158): a, c, t, g, unknown or other
  misc_feature (158)..(158): n is a, c, g, or t
  modified_base (173)..(173): a, c, t, g, unknown or other
  misc_feature (173)..(173): n is a, c, g, or t
  modified_base (293)..(293): a, c, t, g, unknown or other
  misc_feature (293)..(293): n is a, c, g, or t
  modified_base (358)..(358): a, c, t, g, unknown or other
  misc_feature (358)..(358): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtgtgtttctaggnggctatttaaaggtntcagtgtgagtgcagctgctggagtctgggggaggcttgggtacaggccgggggggtcctgagactctcctgtgaagcctctggattcacctttgacaagtgtgccatgacctgggtccncaggctccgaggggaagggccggagtggggtctcgtagttagttagtgggtagtggtagtagcanagattacgcagactcgtgaacgggccgttacaccatctccagagacattccaacagcacgctgtattgacacatcgaactagcctagagagccgaagggaccacggccagtactattattgtagaccgtaaacgtttcgtttcgtaactttgggttaactttaacgtccccgttaaggttcggaaccctacggtacggggtcccgaagggtaccccgg

SEQ ID NO: 50485 - DNA, 562 bp, Homo sapiens
  misc_feature: GYAE6OF02FR90J.37.83.H06.1.454.CMB.1.raw
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
  modified_base (405)..(405): a, c, t, g, unknown or other
  misc_feature (405)..(405): n is a, c, g, or t
  modified_base (493)..(493): a, c, t, g, unknown or other
  misc_feature (493)..(493): n is a, c, g, or t
  modified_base (499)..(499): a, c, t, g, unknown or other
  misc_feature (499)..(499): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtgtcgttttctaggtggctatttaaaggtgtcagtgtgaggtgcagctgctggagtcgtgggggaggcttggtacaggccgggggggtccctgagactctcctgtgaagcctctggattcacctttgacaagtgtgccatgacctgggtcccgccaggcctccgaggggaaggggctgggagtggggtctcgtagttattaggtggtagtggtagtagcanagattacgnagactcgtagaacgggtccggttcaccgtntctcagagactaatccaacagtcacgtctgtactttgctacagtagaacacgcctgacgaggccgaggacaccggctaatataacttnttagtnaccgtaatttccttagtacgttgttattacctccctagtccgaccacggtcgggacctacggg

SEQ ID NO: 50486 - DNA, 540 bp, Homo sapiens
  misc_feature: GYAE6OF02I6ITZ.37.83.H06.1.454.CMB.1.raw
  modified_base (365)..(365): a, c, t, g, unknown or other
  misc_feature (365)..(365): n is a, c, g, or t
  modified_base (389)..(389): a, c, t, g, unknown or other
  misc_feature (389)..(389): n is a, c, g, or t
  modified_base (462)..(462): a, c, t, g, unknown or other
  misc_feature (462)..(462): n is a, c, g, or t
  modified_base (466)..(466): a, c, t, g, unknown or other
  misc_feature (466)..(466): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtctgggggaggcttggtacagccggggggtccctgagactctcctgtgaagcctctggattcacctttgacaagtgtgccatgacctgggtccgccaggctccgagggaggggctgggagtgggtctcagttattagtggtagtggtagtagcacagattacgnagactccgtgaaggccgttcaccntctcagagacaattccaacagcacgctgtattgcacatagacagcctgagacgcgagacacggcagtatattntgtntacgtaacgtttccttttagacgttggttaacttacgtacccgttagtcgaccgtacggtcgggccctaacggg

SEQ ID NO: 50487 - DNA, 530 bp, Homo sapiens
  misc_feature: GYAE6OF02F9UNH.37.83.H06.1.454.CMB.1.raw
  modified_base (237)..(237): a, c, t, g, unknown or other
  misc_feature (237)..(237): n is a, c, g, or t
  modified_base (412)..(412): a, c, t, g, unknown or other
  misc_feature (412)..(412): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttctttagcttggtaccagcagaaaccacgacagcctacctaagctgctcgtttactgggcctcgtacccgggaatcccggggtccctagaacgattcgagtggcggcgggtctgggacagatttcactctcacatcagcagcctgcggctgaagntggtggtcgtttattacgtgtcagctagttattatgttactcctctacgtagtttcggccgagggaccagcgtggagagtcgacgtaacgaacgttggtacggctcgacacctattcg

SEQ ID NO: 50488 - DNA, 536 bp, Homo sapiens
  misc_feature: GYAE6OF02FTKDY.37.83.H06.1.454.CMB.1.raw
  modified_base (395)..(395): a, c, t, g, unknown or other
  misc_feature (395)..(395): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtggctttttctgtggctattttaaaaggtgtccagtgtgaggtgcagctgctggagtctgggggagcttggtacaggccgggggggtccctgagactctcctgtgaagcctctggattcacctttgacaagtgtgccatgacctgggtcccgcaggctccgagggagggctggagtgggtctcgagttattaggtggtagtggtagtagcacagattacgcagactcggtgaacgggccgttcaccatcncagagacaatccaacagcacgctgtatttgcacatgaacagcctagagagccgagacgacgacatatattattgagacgtaacttctttagacgttagttacttactcccgttagtacgaccacggtcgggacctaacggg

SEQ ID NO: 50489 - DNA, 513 bp, Homo sapiens
  misc_feature: GYAE6OF02H1PAP.37.83.H06.1.454.CMB.1.raw
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttatacaactccaagaataagagttcttagcttggtaccagcagaaaccacgacagcctacctaagctgctcgtttactgggcctcgtacccgggaatccggggtccctgaacgatcagtggcggcgggtctgggacagatttcactctcaccatcagcagcctgcgggctgagatgtggcgtttattactgtcagctagtattataatactcctcgtacgttcggacaaggacaggtagaatcgaaacgtactgtgctgacaccatctcgtcttactac

SEQ ID NO: 50490 - DNA, 575 bp, Homo sapiens
  misc_feature: GYAE6OF02G2L81.37.83.H06.1.454.CMB.1.raw
  modified_base (241)..(241): a, c, t, g, unknown or other
  misc_feature (241)..(241): n is a, c, g, or t
  modified_base (317)..(317): a, c, t, g, unknown or other
  misc_feature (317)..(317): n is a, c, g, or t
  modified_base (400)..(400): a, c, t, g, unknown or other
  misc_feature (400)..(400): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgaggagggccacgatcaactgcaagtccagccggtagtgttttanacaactccaaagaataagagttcttagcttggtaccagcaagaaaccacgacacgcctctaagctagctcgttacnggcctcgtaccgggatccggggtcctagacgtattcgaggtggcggcggtctgggacagtactttcactctcacatcagtacnctgcacgcctgattgatttgactacttattactgtacagactaacgtaatacgtagggtagtaacgttccggaccgggaacggtaaccgtaggggttacgtacgaataccgaaaacggttacgaggtcggacttacggacctaaccgagtttacccgtagttaccttactaaccg

SEQ ID NO: 50491 - DNA, 511 bp, Homo sapiens
  misc_feature: GYAE6OF02G00MF.37.83.H06.1.454.CMB.1.raw
  modified_base (238)..(238): a, c, t, g, unknown or other
  misc_feature (238)..(238): n is a, c, g, or t
  modified_base (508)..(508): a, c, t, g, unknown or other
  misc_feature (508)..(508): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaagaataagagttctttagcttggtaccagcagaaaccacgacagcctcctaagctgctcgtttactgggcctctacccgggaatccgggggtccctgaacgattcagtggcggcgggtctgggacagatttcactctcaccatcagcagcctgcgggctgaagatggtggcggtttattactgtcagcagtattattgttactcctctactagttttcggccgaggggaccagcgtggagatcgcacgatgtggctgcacntcg

SEQ ID NO: 50492 - DNA, 523 bp, Homo sapiens
  misc_feature: GYAE6OF02HO3Z8.37.83.H06.1.454.CMB.1.raw
  modified_base (237)..(237): a, c, t, g, unknown or other
  misc_feature (237)..(237): n is a, c, g, or t
  modified_base (310)..(310): a, c, t, g, unknown or other
  misc_feature (310)..(310): n is a, c, g, or t
  modified_base (317)..(317): a, c, t, g, unknown or other
  misc_feature (317)..(317): n is a, c, g, or t
  modified_base (337)..(337): a, c, t, g, unknown or other
  misc_feature (337)..(337): n is a, c, g, or t
  modified_base (346)..(346): a, c, t, g, unknown or other
  misc_feature (346)..(346): n is a, c, g, or t
  modified_base (412)..(412): a, c, t, g, unknown or other
  misc_feature (412)..(412): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggatgttttanacaactccaagaataagagttctttagcttggtaccagcagaaaccacgacagcctctaagctgctcgttacngggcctntacccgggaagtccggggtncctgaacgnttcgagtggcggcggtctgggacagtatttcgactctcaccatcagcagtcctggcggctagaagntggtggcgtttatactgtcagcagtattatgtttactcctcacgttagtttggccgagggacccagtccgtggagtactcgacgaacgtacgtggtcggctagtcacctag

SEQ ID NO: 50493 - DNA, 724 bp, Homo sapiens
  misc_feature: GYAE6OF02F5MCV.37.83.H06.1.454.CMB.1.raw
tcagtagtgtagatcacgaccggtgctcgatttagatcacgtgcgtcggcgggggagagaggagcccagccctgggattttcaggtgttttcatttggtgatcaggactgaacagagagaactcaccatggagtttgggctgagcgtggtcttttctagtggctaattttaaaggtgtccagtgtgaggtgcagctgctggagtcgtgggggagcttgggtacagggcccgggggggtccctggagtactctccgtgtgaacgcctcgtggtattcctacctttgactaaggtgtcgtccagttcgaccgtggggtcccgccgacggcctcccggagggggaacggggctgggaggtgggtctcgtagttattggtagggtaggtaggtagtagaccaacgagtaagttacggctaacggacgttcccggtagggaaaccgggggtcccggtttacaacccgtatcccgtaccgaaggaacgtaacctaacgttacccaaaacgtgacctaaccggtcttaggttactttggaaccaactagtacggaaactacgtacccgtaggaacggacggacccggaaggaccgaccgggaccctaattaattacgtttaactggtaccgtaaccgttaaacccgtttttccgttagttaccgttaggttttaactacccgtttacccgtagttacccgaccggtacggtccgggggaccctaaccgggg

SEQ ID NO: 50494 - DNA, 573 bp, Homo sapiens
  misc_feature: GYAE6OF02GF430.37.83.H06.1.454.CMB.1.raw
  modified_base (265)..(265): a, c, t, g, unknown or other
  misc_feature (265)..(265): n is a, c, g, or t
  modified_base (374)..(374): a, c, t, g, unknown or other
  misc_feature (374)..(374): n is a, c, g, or t
  modified_base (392)..(392): a, c, t, g, unknown or other
  misc_feature (392)..(392): n is a, c, g, or t
  modified_base (407)..(407): a, c, t, g, unknown or other
  misc_feature (407)..(407): n is a, c, g, or t
tcagtagtgtagatcacgaccggtgctcgatttagatcacgtgcgtcgcggggggagagaggagcccagccctggggatttttcaggtgttttcatttggtgatcaggactgaacagagagaactcaccatggagtttgggctgagctggctttttcttgtggctattttaaaaggtgtccagtgtgaggtgcagctgctggagtcgtgggggaggcttgggtacaggccggggggggtccctggagactctcctgtgaagcctntggattcacctttgacaagtgtgccatgacctgggtcccgccgaggctccgaggggaagggggcgtgggaggtgggtctctagttattaggtggtagtggtagtagcanagattacgcagactcggngacgggccgttcacntctcagagacaattccaacagcacgctagtattgacacatagaacacgcctgagacgccgagaccaccggcaatatattattgtacgacgtaacgtttcctttagacttggtttaacttaccgttccccttaggtaccgacctacggtacggggaccctaacgggg

SEQ ID NO: 50495 - DNA, 594 bp, Homo sapiens
  misc_feature: GYAE6OF02GPFF1.37.83.H06.1.454.CMB.1.raw
  modified_base (237)..(237): a, c, t, g, unknown or other
  misc_feature (237)..(237): n is a, c, g, or t
  modified_base (360)..(360): a, c, t, g, unknown or other
  misc_feature (360)..(360): n is a, c, g, or t
tcagtagtgtagatcacgaccggtgctcgatttagatcacgtgcgtcgcgaggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacaactccaagaataagagttcttagcttggtaccagcagaaaccacgacacgcctacctaagctgtccttcgtttacgtcgggccctacgtaccccgggaagtcccggggtcctagaacgtnttcgaggtgggcggcgggtcgtagggactagtactttcacttctaccaccatccgagccacgccgtggccggtcgtaggaagtagtggtcggttacgtttatacgtgtactagtacgtagttattaacgtaacttacctccgtcgtacgttccggacgtaacgggaccagggtacgtaaactaaccgaaacgtacgtggtacgtctacgacctacctagttcctagtccttacg

SEQ ID NO: 50496 - DNA, 260 bp, Homo sapiens; identical to SEQ ID NO: 50456
  misc_feature: GYAE6OF02G3RRP.37.83.H06.1.454.CMB.1.raw
  modified_base (254)..(260): a, c, t, g, unknown or other
  misc_feature (254)..(260): n is a, c, g, or t

SEQ ID NO: 50497 - DNA, 701 bp, Homo sapiens
  misc_feature: GYAE6OF02ILXPV.37.83.H06.1.454.CMB.1.raw
  modified_base (466)..(466): a, c, t, g, unknown or other
  misc_feature (466)..(466): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtgtcgtttctaggtggctaattttaaaggtgtccagtgtgaggtgcagctgcgtggagtcgtgggggagtcgttggtacagggccgggggggtccctgagactctcctggtgaacgcctcgtggattcacctttgacagtgtgccagtcgccgtcgggtcccgaccgtaggccgtccggaaggggacggggtcgtggcggttggtctgtagtttagttagtggttaggtggttagtaagctaacgagtattacgcaagtacgtccggtgggaaccggtccggtacaccgatcctaccgaggacaacgtaattacccaaacncgacaccgtacttagttacttagcaacgtagtaacgaacacgcctagacgacgaccggtaacggaacccgaccggtacctaaagttacttaagttttgtaacggtaccgttaaccgtttaaacccgtttttcgtttaaccgtaacgttttaacggttttaaactttacccgttacccccgtttaaggtccgtaaacccggttccggtacccgggggtacccgtaaaccccggggg

SEQ ID NO: 50498 - DNA, 708 bp, Homo sapiens
  misc_feature: GYAE6OF02GH5YY.37.83.H06.1.454.CMB.1.raw
  modified_base (239)..(239): a, c, t, g, unknown or other
  misc_feature (239)..(239): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagttgttttanacagctaccaacaataagaactactagcttggtatcagcagaaaccagggcagcctcctaaactgacctctactttacgtgggacctagtccgtacccgggacggtcccggggtccctacggacccgtattccgaaggttcggacgtaacggccggggttacgtacggggaactacggtacttttccgacttccgtacctaaccgattacccgaaacgacggtccctacggaccgtaacgggccgttaggacggacgttcgggtacgggtacccggttaattttttaacggttacttacggttactacggtaccgttaagttaacttttaaacgttaaacgttccctttaacccgttacccggttaccggtttaccgggaaccgtaaaccgggtaaccggtaaacggtaacgggtaaacctacgaaaaccgtacgttacggacggtaccgttacgacccgtactaaccg

SEQ ID NO: 50499 - DNA, 638 bp, Homo sapiens
  misc_feature: GYAE6OF02I2H2V.37.83.H06.1.454.CMB.1.raw
  modified_base (435)..(435): a, c, t, g, unknown or other
  misc_feature (435)..(435): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggctttttcttgtggctatttaaaggtgtccagtgtgaggtgcagctgctggagtctgggggagcgttgggtacaggccgggggggtccctgagactctcctgtgaagcctctggattcacctttgacaagttgtacgcctatcgaccgttgggtcccgccgacgggtcctccggaacggggaaggggcgtgggaacggttggggtctcgtaggtttacttaggtggtagttggtagtagcacgagtacttacgcgagactccggtaggaacgggtccgttacaccatcnccagagacaattaccaacagacacgactagtacttcgacacatgaacagcctgacgacgaccggacggacaccgggactaacgttaactaattagttacgtagtaccgtaaaccgtttccgttttagtaacctttgggtttaactttaccttaccccgttagttaccggtaccgtaccggttaccggggaccctaacccgggg

SEQ ID NO: 50500 - DNA, 168 bp, Homo sapiens
  misc_feature: GYAE6OF02HUOE3.37.83.H06.1.454.CMB.1.raw
  modified_base (164)..(168): a, c, t, g, unknown or other
  misc_feature (164)..(168): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgggctggcaaggcgcatagnnnnn

SEQ ID NO: 50501 - DNA, 670 bp, Homo sapiens
  misc_feature: GYAE6OF02G64CY.37.83.H06.1.454.CMB.1.raw
  modified_base (428)..(428): a, c, t, g, unknown or other
  misc_feature (428)..(428): n is a, c, g, or t
  modified_base (448)..(448): a, c, t, g, unknown or other
  misc_feature (448)..(448): n is a, c, g, or t
  modified_base (468)..(468): a, c, t, g, unknown or other
  misc_feature (468)..(468): n is a, c, g, or t
  modified_base (505)..(505): a, c, t, g, unknown or other
  misc_feature (505)..(505): n is a, c, g, or t
tcagtagtgtagatcacgaccggtgctcgatttagatcacgtgcgtcgcgagggagagaggagcccagccctgggattttcaggtgttttcatttggtgatcaggactgaacagagagaactcaccatggagtttgggctgagctggtctttttcttgtggctattttaaaaggtgtccagtgtgaggtgcagctgctggagtcgtgggggaggtcgttgggtacgacgggcccggggggggtcccctggacggacctcctccgtgtgaacgtcctcgtggattcctacccgttttgaacctaagttgtgcccaagtcgtaaccgtcggggtcccgcccgaggcctccgaagggggaacgggcgtgggaggttgggtctcgtagttagttagtggtagtggtagtagcacagtatacgcagactccgnggacggtccgttcaccatcnccagacgtaacaattccaanacgcacgacttgttactttgaccaactatacgaaacncgtcctagggaagccggaccggaacggaccgaccgacctaattaacgttaatttacgttcggtagtaacccggttaaacttttccgttttaggacgtttacggtttaactttaccccttacccgttaggttaccggtaccccgtagggttcccggggaaccccgg

SEQ ID NO: 50502 - DNA, 519 bp, Homo sapiens
  misc_feature: GYAE6OF02HABGR.37.83.H06.1.454.CMB.1.raw
  modified_base (236)..(236): a, c, t, g, unknown or other
  misc_feature (236)..(236): n is a, c, g, or t
  modified_base (359)..(359): a, c, t, g, unknown or other
  misc_feature (359)..(359): n is a, c, g, or t
  modified_base (489)..(489): a, c, t, g, unknown or other
  misc_feature (489)..(489): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggatgtttanacaactccaagaataagagttctttagcttggtaccagcagaaaccacgacagcctcctaagctgctcgtttactgggcctcgtacccgggaatcccggggtcctgaacgattcagtggcggnggtctgggacagtctttcactctacaccatcagcacgcctggcgggctgaacgagtgtggtcggtttattacgtgtcagcagttattatcgtttactcctctacgtgtttgccgtagggaccagctgganagtcgcacgtacgtgtcggctgccacatcg

SEQ ID NO: 50503 - DNA, 536 bp, Homo sapiens
  misc_feature: GYAE6OF02FYRVB.37.83.H06.1.454.CMB.1.raw
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
  modified_base (311)..(311): a, c, t, g, unknown or other
  misc_feature (311)..(311): n is a, c, g, or t
  modified_base (341)..(341): a, c, t, g, unknown or other
  misc_feature (341)..(341): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagngggccagatcaactgcaagtccagccgagtgttttanacaactccaagaataagagttctttagcttggtaccagcagaaaccacgacagcctactaagctgctcgtttacnggtcctctaccgggatccgggtcctgacgnttcagtggcggcggtcgtgggactagatttcactctcaccatcagcagtcctggcggctagaagtgtgtggtacgtttattacgtgtcagctagttattatcgttactcctacacttggtttcgacgtacgggtactagtctaggtagacttcggcctaacgtaagtggtcggtacgtcggacctaccgattccg

SEQ ID NO: 50504 - DNA, 648 bp, Homo sapiens
  misc_feature: GYAE6OF02IDS2I.37.83.H06.1.454.CMB.1.raw
  modified_base (174)..(174): a, c, t, g, unknown or other
  misc_feature (174)..(174): n is a, c, g, or t
tcagtagtgtagatcacgaccggtgctcgatttagatcacgtgcgtcgcgggggagagaggagcccagccctggggattttcaggtgttttcatttggtgatcaggactgaacagagagaactcaccatggagtttgggctgagcggtcgtgttctaggcggctatttaaaggngtcagtgtgaggtgcagctgctggagtgtgggggagcgttaggtacgacggcccgggggggtcctggagactctcctgtgcagcctcttggtttcattcttacgcaaactcgccatcggagctacgggtccgcacggcctccggaaggggaacggggtcgtgggcgtgggtcctacaggtacttagtagggtacgtaggtaataaccgtctaacgtaactccgatacgtactaccggtcggacggtccggtactccgtaactccgagaacgactaacgtaccaacgtacgtacggtactatcgtaagaatacggaacagcgtagaagacggaccgacggaccgaccggtacccttacgttacgtacgttacgtcgtaccggaggaacgtacacggtaacggtaacggaacgtttaagacgtacgtaccgagtaacggtcttaccgacgtaacggtaccggtcggtaaccccggg

SEQ ID NO: 50505 - DNA, 520 bp, Homo sapiens
  misc_feature: GYAE6OF02GMCMY.37.83.H06.1.454.CMB.1.raw
  modified_base (238)..(238): a, c, t, g, unknown or other
  misc_feature (238)..(238): n is a, c, g, or t
  modified_base (366)..(366): a, c, t, g, unknown or other
  misc_feature (366)..(366): n is a, c, g, or t
tcagtagtgtagatcacgaccggtgctcgatttagatcacgtgcgtcgcgggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttanacagctccaacaataagaactacttagcttggtatcagcagaaaccagggcagcctcctaaactgctcatttactgggcatcgtacccgggagtccggggtccctgaccgattcagtgcgagcgggtntgggacagatttcactctcaccatcaacagcctgcaggctggaggatgtggcgtatttactactgtcagctagttattataatactcctccgtacgttcggccaagggacaagggtgaaactacgaaacgtactaggtacgcgtcgacactacg

SEQ ID NO: 50506 - DNA, 719 bp, Homo sapiens
  misc_feature: GYAE6OF02G966X.37.83.H06.1.454.CMB.1.raw
  modified_base (297)..(297): a, c, t, g, unknown or other
  misc_feature (297)..(297): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggcttttctgtggctattttaaaaggtgtccagtgtgaggtgcagctgctggagtcgtgggggagcttggtacaggccgggggggtccctgagactctcctgtgaagcctcgtggattcacctttgacaagtgtgccatgaccgtgggtccnccaggctccgaggggagggctgggagtgggtctcgtagttattaggtggtaggtggtagtagcacgagtattacgctagactccggtaggaacggggtcccggttacacccgtattcccgtacccgaagacgaacctaaactttaccccaaacctacgacctacggtccttaggttacgttttacggacctaacgtaacgtacggtaaaccacggtacccgttaggaacgggtacgggacccggaacgggaacccgaaccgggtaccctaaagttaaacgttaaagtttacgtttacggttacgtaaccggtttaaaaccgttttcccgtttttaaggtaaccgtttacggtttaactttaccgttacccccgttaggttaccgtaacccgtacggttaccgggggacccgtaaacccgggg

SEQ ID NO: 50507 - DNA, 704 bp, Homo sapiens
  misc_feature: GYAE6OF02IB447.37.83.H06.1.454.CMB.1.raw
  modified_base (241)..(241): a, c, t, g, unknown or other
  misc_feature (241)..(241): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgaggacgggccacgatcaactgcaagtccagccggagttgtttanacaactaccaagaataagtagttcttagtcgttaggtaccagactagaaaccacgacacgacctactagctgtcttcgttacgtcgggtcctaccgtaccgggtagtcccgggggtacctaggaacgtacttcgaggtcgggcggtcgggtcgtcgggaactagtactttaccgacgttcctaccacctactacgacgtaccgacggtccgtacgggaccgggtacgtaggaaacgtgttacgggttacgggttacggtttttacttacggttggtacgacgtaccgttaaggtttactttaacgttcgtttaaccgttccgttacgtaaccgttttacggtttaccgggaaccggtaacggggaaccctagggtaccggttaggacggtaccgtaccggaaccgtaaccggttaacggttcggttacgggtccgttacggtaccctacccgttacttaccgg

SEQ ID NO: 50508 - DNA, 530 bp, Homo sapiens
  misc_feature: GYAE6OF02HPN2P.37.83.H06.1.454.CMB.1.raw
  modified_base (228)..(228): a, c, t, g, unknown or other
  misc_feature (228)..(228): n is a, c, g, or t
  modified_base (302)..(302): a, c, t, g, unknown or other
  misc_feature (302)..(302): n is a, c, g, or t
  modified_base (357)..(357): a, c, t, g, unknown or other
  misc_feature (357)..(357): n is a, c, g, or t
  modified_base (400)..(400): a, c, t, g, unknown or other
  misc_feature (400)..(400): n is a, c, g, or t
  modified_base (407)..(407): a, c, t, g, unknown or other
  misc_feature (407)..(407): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgtttanacagctccaacaataagaactacttagcttggtatcagcagaaaccaggcagcctctaaactgctctatttacngggcatctacccgggagtacggggtccctgaccgtattcgagtggcaggcggtcngggacagtattcactctcacatacaacagcctgcaggctgagntgtcggntattttatactgtacagtctaagttatagtaactactccgtcgacgttcggacaagggaccaaggttaggaaactccgaaaacgtacgtggtacgactagccgaaccgtacttcgtagttacc

SEQ ID NO: 50509 - DNA, 533 bp, Homo sapiens
  misc_feature: GYAE6OF02JHHVX.37.83.H06.1.454.CMB.1.raw
  modified_base (396)..(396): a, c, t, g, unknown or other
  misc_feature (396)..(396): n is a, c, g, or t
  modified_base (426)..(426): a, c, t, g, unknown or other
  misc_feature (426)..(426): n is a, c, g, or t
  modified_base (434)..(434): a, c, t, g, unknown or other
  misc_feature (434)..(434): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggcttttcttgtggctatttaaaaggtgtccagtgtgaggtgcagctgctggagtctgggggaggcttggtacaggccgggggggtccctggagactctcctgtgaagcctctggattcacctttgacaagtgtgccatgacctgggtccgccaggctccgagggaaggggctggagtgggtctcagttatagtggtagtggtagtagcacagatacgcagactcgtgaagggtccgtcaccatctcaganacaattccaacagcacgctgtatttgctanatagaacngcctagacgagccgagacacggcctatatattatgtcgacgtaaccttctttagacttggttattacgtccctagtcgaccacgtcggggcctaacggg

SEQ ID NO: 50510 - DNA, 559 bp, Homo sapiens
  misc_feature: GYAE6OF02HMQ7M.37.83.H06.1.454.CMB.1.raw
  modified_base (231)..(231): a, c, t, g, unknown or other
  misc_feature (231)..(231): n is a, c, g, or t
  modified_base (239)..(239): a, c, t, g, unknown or other
  misc_feature (239)..(239): n is a, c, g, or t
tcagtagtgtagatcacgaccggtgctcgatttagatcacgtgcgtcgcggggacaacaggcaggcagggggcagcaagatggtgttgcagacccaggtcttcatttctctgttgctctggatctctgttactacaggtgcctacggggacatcgtgatgacccagtctccagactccctggctgtgtctcgtgggcgagagggccacgatcaactgcaagtccagccggngtgtttanacaactccaagaataagagttctttagcttggtaccagcaagaaaccacgacagcctacctaagctgctcgtttactgggcctcgtacccgggaacttccgggggtccctgaacgacttcgaggtgggcggcgggtctgggacagtatttcactctcaccatcagcacgcctgcgggctagaagtatggtggtcggtttattacttgtcagtcgtaagtattattagttaccttcctctacgttggtttcgccgtacgggacctaggtcgtgggacgtagcggtcgaacgtacgtggtcggcgtcggactaccgattccg

SEQ ID NO: 50511 - DNA, 674 bp, Homo sapiens
  misc_feature: GYAE6OF02IIET4.37.83.H06.1.454.CMB.1.raw
  modified_base (247)..(247): a, c, t, g, unknown or other
  misc_feature (247)..(247): n is a, c, g, or t
  modified_base (266)..(266): a, c, t, g, unknown or other
  misc_feature (266)..(266): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgccgtacggggacatcgtgatgacccagtctccagactccctggctgtgtctcgtgggcgagagggccacgatcaacgtgacaacgtccaggccggtagttgttttaanacaactcaaagtaataagngttcttagcttaggtaccagcaagaaaccacgacagcctacgaagcctagcttccgtttacgcggtcctacgtaccggtacgtcccgggtcctagaaccgtgtacgaggtcgggcggtcggtacgtacggaactagacttttcgaccttacgtcacctagtacgtacgctaacgccgtcggacggtacgtaggtaacgtagtacgggttacggttacggttttagttacgtacgtcgacgtaccgttaagttaacgttagtttaccgtttaccgtccgttacgttaacgttcggttttacggaaccggtaacggggaccgtaacggtacgttacgggaagtaccgtaccggtaccgtaaccgtacggttacggtcggaccgttaccggaaccttaccgtactttccgg

SEQ ID NO: 50512 - DNA, 644 bp, Homo sapiens
  misc_feature: GYAE6OF02HA8OB.37.83.H06.1.454.CMB.1.raw
  modified_base (171)..(171): a, c, t, g, unknown or other
  misc_feature (171)..(171): n is a, c, g, or t
  modified_base (254)..(254): a, c, t, g, unknown or other
  misc_feature (254)..(254): n is a, c, g, or t
  modified_base (291)..(291): a, c, t, g, unknown or other
  misc_feature (291)..(291): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcggtgtgttctaggtgctatttaaaggntcagtgtgagtgcagctgctggagtcgtggggagcttggtaacaggccggggggtccctggacgactctcctgtagagcctgngtatctaccttgacagtgcgccagtcgacctggcccnccgagctaccgagggtagggcgtaggcggtggtcctagtagttattaggtgtacgtggtagtacgctagagtacttacgcgaacgacgttcgaggaacgggtcccgttaccaaaccgtcttaccgtacgaacggtagaacctaaacttccccaaagtcgaccgcgtacgtcgttacttgcctaatatacacgagtctagacgtaccggacgtacgaccgtaccgtactaagttacttacgttacgttacgtacgtaaccggtttaaccttttaccgtttaggaaccgtttagtttaaccttacccgttacccgttacgtaccgtacccggtcggttacgggacccgtaacggg

SEQ ID NO: 50513 - DNA, 675 bp, Homo sapiens
  misc_feature: GYAE6OF02F3ADY.37.83.H06.1.454.CMB.1.raw
tcagtagtgtagatcacgaccggtgctcgatttagatcacgtgcgtcgcggggacaacaggcaggcaggggcagcaagatggtgttgcagacccaggtcttcatttctctgttgctctggatctctggtgcctacggggacaccgtgatgacccagtctccagactccctggctgtgtctctgggcgagagggcctccatcaactgcaacgtccagcccagtaccttgttttactacacgcctaccaaacaataagaactacttagcttggtatcagcagaaccagggcagacctcctaaactgctctatttaccgtgggccagtcccgtacccggggacgtcccgggggtcccctggtaacccgtattcgaggtggcgacggtcgggtctagggacagtagtttccacgttcctcgaccatacaacacgtccctggcctacgggctaggtacggtagtcggtagggtaccgttaagtttttacgttacgttcgtaccgtaagttccgtaaagtttactttaagttaacttcccgttaccgttacccggtacggtttacccgggaaccgtaaacggggtacccgtaaggggtaacggaaaacgttaaccgtaaaacggtaccggtaggtaccggtcgtacggaaccctaccgtacgtttccgttacgtttacccg

SEQ ID NO: 50514 - DNA, 617 bp, Homo sapiens
  misc_feature: GYAE6OF02GD836.37.83.H06.1.454.CMB.1.raw
  modified_base (285)..(285): a, c, t, g, unknown or other
  misc_feature (285)..(285): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtcgtggggggaggcttggtacgaggccggggggggtccctggagactctcctgtgagcctctggattcacctttgacaagtgtnccatgacctgggtccgccaggctccgaggggaaggggctgggaggtgggtctcgtagttattaggtggtagtggtagtagcacagtattacgcagactccgtaggaacgggtccgttcacctactcctaccgagacgactaacttacccaacacgcacgcttagtatttcgacacatacgaacagcctgacgacggaccgaggaccgaccggaccaatattaattagttgtacgtacgttaaaccgttttccgttttagtacgtttaggtttaactttaccgttaccccgttaggtaccgtacccgtaccggtcggggacccgtaaccgggg

SEQ ID NO: 50515 - DNA, 576 bp, Homo sapiens
  misc_feature: GYAE6OF02HO94P.37.83.H06.1.454.CMB.1.raw
  modified_base (238)..(238): a, c, t, g, unknown or other
  misc_feature (238)..(238): n is a, c, g, or t
  modified_base (436)..(436): a, c, t, g, unknown or other
  misc_feature (436)..(436): n is a, c, g, or t
  modified_base (467)..(467): a, c, t, g, unknown or other
  misc_feature (467)..(467): n is a, c, g, or t
  modified_base (499)..(499): a, c, t, g, unknown or other
  misc_feature (499)..(499): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtggcttttctgtggctattttaaaaggtgtccagtgtgaggtgcagctgctggagtctgggggaggcttggtacaggccgggggggtccctgngactctcctgtgaagcctctggattcacctttgactaagtgtgccatgacctgggtccgccaggctccgaggggacggggctgggagtgggtctcaggtttattaggttggtagtgggtagtagcacaggattacggacagacgtcggtaggaaggggtcccggttacaccatcctacagacgtacaattcccaaacngacacggctagttatttgctacatcgaaacngcctgagagaccgaggaccacggacaacttanattgtagtgacctaactttctttagtacttaggtttatacgttccctagtacaccgtacgttcgggacctaacgggg

SEQ ID NO: 50516 - DNA, 613 bp, Homo sapiens
  misc_feature: GYAE6OF02J1CGT.37.83.H06.1.454.CMB.1.raw
  modified_base (242)..(242): a, c, t, g, unknown or other
  misc_feature (242)..(242): n is a, c, g, or t
  modified_base (278)..(278): a, c, t, g, unknown or other
  misc_feature (278)..(278): n is a, c, g, or t
  modified_base (288)..(288): a, c, t, g, unknown or other
  misc_feature (288)..(288): n is a, c, g, or t
  modified_base (322)..(322): a, c, t, g, unknown or other
  misc_feature (322)..(322): n is a, c, g, or t
  modified_base (438)..(438): a, c, t, g, unknown or other
  misc_feature (438)..(438): n is a, c, g, or t
  modified_base (460)..(460): a, c, t, g, unknown or other
  misc_feature (460)..(460): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgccgtacggggacatcgtgatgacccagtctccagacctcccgtggctgtgtctcgtgggcgagagggccacgatcaactgcaagtccagccggtatcgtttanacaactcaagaatagattcttagcttggtatcgagnaacgaaaccngggaccagcctacgtaactgctactagtttacgngggaccacgtccgtaccggggtacgtccggggtaccctagaccgtatccgaggttcggctacgggtccgggtcgtacgggactagttacgttcaacttctacgacctatacgaacncgctcgctacgcgtagacggtntcggagtaccgttatttactacgtagtccgagtacgttagttaattaactaaccgtaccttcccgtacgtacgttaccggaccgaacgggtacgaaggttaacgaactaaccgtaaacgcgttacggtcggccttacgacctacctagttccg

SEQ ID NO: 50517 - DNA, 628 bp, Homo sapiens
  misc_feature: GYAE6OF02F0JU5.37.83.H06.1.454.CMB.1.raw
  modified_base (240)..(240): a, c, t, g, unknown or other
  misc_feature (240)..(240): n is a, c, g, or t
  modified_base (342)..(342): a, c, t, g, unknown or other
  misc_feature (342)..(342): n is a, c, g, or t
  modified_base (395)..(395): a, c, t, g, unknown or other
  misc_feature (395)..(395): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccagatcaactgacaagtccagccggtagtgttttanacaactccaagaataagagttcttagcttggtaccagcagaaaccacgacagcctcctaaggctgctcgtttactgggcctcgtaccgggatcccgggtccngaacgattcaggtcggcggtcggtcgtgggactaggatttcacgtctcaaccnctaccgagccgaagtccctgggccggctaaggtaacgtaggttggttacgggttacggttttagtttaccgttacggtacgacgtacgttaaggtttattacgtttacgtttaccttccttacgtaacgtttaggttttcgggaccgttacggggaacctaggtcgtagggtacggtacgtccggaaccgtaacgtacgtcggtacggtcctacggacccgtacctatttccg

SEQ ID NO: 50518 - DNA, 608 bp, Homo sapiens
  misc_feature: GYAE6OF02F5ZW7.37.83.H06.1.454.CMB.1.raw
  modified_base (297)..(297): a, c, t, g, unknown or other
  misc_feature (297)..(297): n is a, c, g, or t
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
  modified_base (452)..(452): a, c, t, g, unknown or other
  misc_feature (452)..(452): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtctgggggaggcttggtacaggccgggggggtccctgagactctcctgtgaagcctctggattcacctttgacaagtgtgccatgacctgggtccnccaggctccgagggagggctggagtgggtctcgagtttattaggtggtagtggtagtagcanagattacgnagactccggtagaacgggtccgttcacctatcctacagagactaattccaacagccacgctagtatttgacactatacggaacncgccgttaggaacgacggtacccggaagggtaaccgaccgggacctaagttacttaagttacgttgtacgtaccgtaaacgttttccgttttagacgtttggtttaactttacgtacccgttagtccgaccgtacggttcggggaccctaacgggg

SEQ ID NO: 50519 - DNA, 541 bp, Homo sapiens
  misc_feature: GYAE6OF02FRB0F.37.83.H06.1.454.CMB.1.raw
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
  modified_base (435)..(435): a, c, t, g, unknown or other
  misc_feature (435)..(435): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtcgtggggggaggcttggtacaggccggggggggtccctggagactctcctgtgaagcctctggattcacctttgacaagtgtgccatgacctgggtccgccaggctccgaggggaagggctggagtgggtctcagttattagtggtagtggtagtagcacagattacgcagactcgtagagggccgttcaccatccncaganacaattccaacagcacgctgtattgcacatnaacagcctgagagccgaggacacgaccatatattattgtagactaacgtttctttacgtacgttgttacttacgttccctagtacacctacgtcgggcctaacggg

SEQ ID NO: 50520 - DNA, 601 bp, Homo sapiens
  misc_feature: GYAE6OF02H4OZT.37.83.H06.1.454.CMB.1.raw
  modified_base (384)..(384): a, c, t, g, unknown or other
  misc_feature (384)..(384): n is a, c, g, or t
  modified_base (395)..(395): a, c, t, g, unknown or other
  misc_feature (395)..(395): n is a, c, g, or t
  modified_base (425)..(425): a, c, t, g, unknown or other
  misc_feature (425)..(425): n is a, c, g, or t
  modified_base (526)..(526): a, c, t, g, unknown or other
  misc_feature (526)..(526): n is a, c, g, or t
tcagtagtgtagatcacgaccggtgctcgatttagatcacgtgcgtcgcgggggagagaggagccaagccctgggattttcaggtgttttcatttggtgatcaggactgaacagagagaactcaccatggagtttgggctgagcgtggtcttttctgtggctattttaaaaggtgtccagtgtgaggtgcagctgctggagtcgtgggggaggcttggtacagggccgggggggtccctggagactctccgtgtgaagcctctggacttctacctttgactaagtgtcgcctatcggaccgtgggtcccgccgaggccgtaccggaggggtaaggggctagggaggtcgggtctcgtagttataggtggtagtggtagtagcanagtattacganagacgtcgtaggaacggtcccggttcaccntccgtacgagaacgaactaaccttacaacgcgaccaacgtcttagttaacttcggactaacgtaatacgactacgccgtaggacgtacgcggagacgacgntaatatatattgctacgtaacttctttagcgttgttacttacgtaccctagcgacccaggtcggaccgtaaccgg

SEQ ID NO: 50521 - DNA, 711 bp, Homo sapiens
  misc_feature: GYAE6OF02GTTW5.37.83.H06.1.454.CMB.1.raw
  modified_base (243)..(243): a, c, t, g, unknown or other
  misc_feature (243)..(243): n is a, c, g, or t
  modified_base (258)..(258): a, c, t, g, unknown or other
  misc_feature (258)..(258): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgccgtacggggacagtcgtgatcgacccagtcctccagacctccctggctgtgtctcgtgggcgagagggccagatcaactgacaagtccagccgagttgtttanacactcaagataagngttcttagctttggtaccagctaagaaccagacagcctactaacgctagccttagtttaccgcgggtacctacgtaccccgggaagttccccgggggtccctaggaaaccgtcgtttacgaggtcgggtaccgggcggggttccgtagggggactaaaggtacgttttaccgaccttaccgttcaaccacgttacgacgacgtaacgcctcggtcggccgttaggaacgacggtaggtcggtacggtttactttacgttacgtacgtagacgtacgttaagttaacgttacgtttaaccttaccgttaaccgttaccgttaacgttttacgggtaccgtaacgggggtaaccctacgggtacgtacgggttaacggaacttccggtaaaccgtacggttaaaccgtacggttacggtaccgttacggtaccctacggtaaccgtttaacccgg

SEQ ID NO: 50522 - DNA, 632 bp, Homo sapiens
  misc_feature: GYAE6OF02JHH4T.37.83.H06.1.454.CMB.1.raw
  modified_base (529)..(529): a, c, t, g, unknown or other
  misc_feature (529)..(529): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggcttttcttgtggctattttaaaaggtgtccagtgtgaggtgcagctgctggagtctggggaggcctcgtccagcctggggggtccctgagactctcctgtgtagcctctgaattccccttaggcttattggatgagctggtccgcaggtctccgagggaagggctggagtgggtcggaccaacgagtaaagcaaagactaggaaagtaagaaggtagtagtggtaggactcgagtaggaacggggccgtttacaccgattcctaccgagacggaaccaaccgccaaacgaaccgttcccgtggacctatccgtaggaccaaaagttcgaaaacctgtactagacgaggccgaaggactaccgggtacttagtttaacttacncggtacgacgtaaggagaacggtaccgttaaggggtccgttttacggaacttaccggtcggggacctaacgggtaacccctgggtacccaccggtctacccgg

SEQ ID NO: 50523 - DNA, 542 bp, Homo sapiens
  misc_feature: GYAE6OF02GYTIP.37.83.H06.1.454.CMB.1.raw
  modified_base (238)..(238): a, c, t, g, unknown or other
  misc_feature (238)..(238): n is a, c, g, or t
  modified_base (387)..(387): a, c, t, g, unknown or other
  misc_feature (387)..(387): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
  modified_base (435)..(435): a, c, t, g, unknown or other
  misc_feature (435)..(435): n is a, c, g, or t
  modified_base (538)..(538): a, c, t, g, unknown or other
  misc_feature (538)..(538): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagttgtttanacaactccaagaataagagttcttagtcttggtaccagcagaaaccacgacagcctacctaagctgctcgttactgggctcgtaccggatccggggtacctgaacgtatcagtggcggcggtctgggacaggtctttcactctcacctntcagcagccngcggntgagtatgtggtcgtttatactgtcatctagtnttatcggtttacctctctacttacggtttcggaccgtacggggaacctagtacgtagggacggtacgtcgaacgtacgtaactggtcggtctacgcctacgtnttcg

SEQ ID NO: 50524 - DNA, 638 bp, Homo sapiens
  misc_feature: GYAE6OF02F229L.37.83.H06.1.454.CMB.1.raw
  modified_base (199)..(199): a, c, t, g, unknown or other
  misc_feature (199)..(199): n is a, c, g, or t
  modified_base (330)..(330): a, c, t, g, unknown or other
  misc_feature (330)..(330): n is a, c, g, or t
  modified_base (370)..(370): a, c, t, g, unknown or other
  misc_feature (370)..(370): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagnggccagatcaactgacaagtccagccggtagttgttttaacaccaacctccaaagtaataagtagtttctttaaggctttaggtaccagtacagaaaccacgacagcctactaagctcgtctcgtttacgngggcctacgtacccgggtacgtcccggggtcctagaactnttcaggtcggcgggtacggtcgtggactgtacttctacgtctaccactatcgacgtacgcgtaccgtggaccgggtacgtaggaagtacgttggtcgggtttacggtttactttacgtcgtactaggtactaagttactttagttcgttacctaccgttatacgtttacgtttcggaaccggtacgggacctacggtccgttaggacggtacgtacccggtactaacggtaacgttggacgttccgtaacgacccgttactcgttccg

SEQ ID NO: 50525 - DNA, 677 bp, Homo sapiens
  misc_feature: GYAE6OF02FI4VA.37.83.H06.1.454.CMB.1.raw
  modified_base (346)..(346): a, c, t, g, unknown or other
  misc_feature (346)..(346): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtgtgtttctaggtcggctatttaaaggtgtccagtgtgaggtgcagctgctggagtcgtgggggaggcgttggtaacgaggccggggggggtccctggaggacctctccgtgtgaacgtcctgttggattccacctttgacgaagttgcgccatggaccgtgggtccgccgacggctccggaaggggtaacggggctaggnggtgggtctcgagtttagttagtcgggttaaggtggtagtggcacgtagtacttacgacacgacttccggaggaacggggtcccggttacaccgtatccgtcaagacgactaacttccaaacgtacgacgaccgtcttaggtactttacggactacctataccggaactacggtaccttagggaacggacggacccggagggaccgaccgtacccgtaattaattaaccgtttagttagttacgaaccggttaacctttcggtttacgacgtttaggttacttactaccccgttgtaaccgtacccgtacggtcgggtacccgtaaccggg

SEQ ID NO: 50526 - DNA, 622 bp, Homo sapiens
  misc_feature: GYAE6OF02JFYKZ.37.83.H06.1.454.CMB.1.raw
  modified_base (147)..(147): a, c, t, g, unknown or other
  misc_feature (147)..(147): n is a, c, g, or t
  modified_base (171)..(171): a, c, t, g, unknown or other
  misc_feature (171)..(171): n is a, c, g, or t
  modified_base (215)..(215): a, c, t, g, unknown or other
  misc_feature (215)..(215): n is a, c, g, or t
  modified_base (259)..(259): a, c, t, g, unknown or other
  misc_feature (259)..(259): n is a, c, g, or t
  modified_base (289)..(289): a, c, t, g, unknown or other
  misc_feature (289)..(289): n is a, c, g, or t
  modified_base (311)..(311): a, c, t, g, unknown or other
  misc_feature (311)..(311): n is a, c, g, or t
  modified_base (313)..(313): a, c, t, g, unknown or other
  misc_feature (313)..(313): n is a, c, g, or t
  modified_base (321)..(321): a, c, t, g, unknown or other
  misc_feature (321)..(321): n is a, c, g, or t
  modified_base (341)..(341): a, c, t, g, unknown or other
  misc_feature (341)..(341): n is a, c, g, or t
  modified_base (348)..(348): a, c, t, g, unknown or other
  misc_feature (348)..(348): n is a, c, g, or t
tcagtagtgtagatcacgaccggtgctcgatttagatcacgtgcgtcgcgggggagagaggagcccagccctgggattttcaggtgttttcattttggtgatcaggactgaacagagagaactcaccatggagtttgggctgagcgngtgttctaggtgctatttaaaggngtcagtgtgagtgcagtctgctggagtcgtggggagcttggacnggccggggggtcctgagctctccgtgtgagcctctggtacttcnccttgacaaggtgtcaccatcgctggtccnccaggctccgaaagggtggcgngngtggcgtngtatgtgtgtgtagtagcanagatacncatcgccgtgaaggcggtcacactctccagagaactaataccacacgacacgtaccgtattagttacggacttaccgtacgtaacgaacgaaccgtacgtacgaacgaccggacccgggacgaccgtaccgtaccgtaacgttaacgttaacgttacgtttacgttacgtaaccgtttaaccgtttaccgtttacgttacgttacgtttacgtttaccgttacccgttaccggttaaccgtaaccgtaaccggttaccgggtacccggtaccgg

SEQ ID NO: 50527 - DNA, 708 bp, Homo sapiens
  misc_feature: GYAE6OF02F6XBZ.37.83.H06.1.454.CMB.1.raw
  modified_base (237)..(237): a, c, t, g, unknown or other
  misc_feature (237)..(237): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagacctccctggctgtgtctctgggcgagagggccacgatcaactgcaagtccagccgagtgtttanacactcaagaataagagttcttagctttggtaccagcagaaaccacgacagcctacctaagctagctcgttactggcctctacccgggaatccggggtaccctgaacgtacttcgacggtggccggcgggtctggggactagtactttcgaaccttctaccgaaccatccaacgtcacgtccgtagggccgggtactaggaaagtacgtggttacgggttacggtttttaagtttaccgttacgggttacctaaggtccggttaaagtttaacgtttaacgtttaccggttttaccctttaccccgttaccgttaaccgtttaacgggttttttaccgggtaacccggtaaccggggggtaaccctaacgggttacccggttaggggtaaacggttacccgtaacggtacccgtaaaccggtaacgttacgggtacgggtcccctagggaaccctaacccgttagttcccg

SEQ ID NO: 50528 - DNA, 260 bp, Homo sapiens
  misc_feature: GYAE6OF02I57ZU.37.83.H06.1.454.CMB.1.raw
  modified_base (255)..(260): a, c, t, g, unknown or other
  misc_feature (255)..(260): n is a, c, g, or t
tcagtagtgtagatcacgaccggtgctcgatttagatcacgtgcgcgcgggtctgggacagatttcactctcaccatcagcagcctgcgggctgaagatgtggcggtttattactgtcagcagtattatgttactcctcactagttttggccaggggaccaagctggagatcgcacgaactgtggctgcaccatctgtcttcatccttcccgccatctgaatctacactactgagcggctggcaaggcgcatagnnnnnn

SEQ ID NO: 50529 - DNA, 793 bp, Homo sapiens
  misc_feature: GYAE6OF02GBU1M.37.83.H06.1.454.CMB.1.raw
  modified_base (245)..(245): a, c, t, g, unknown or other
  misc_feature (245)..(245): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagacgggccacgatcaactgacaagtccaggccggtagttgttttaanaccaactaccaagaataagtagttcttagctttaggtaccagcaagaaaccacgacagcctacctaagcctgtccttcgtttacgcgggtacctccgtaacccggggtaacgttccccgggggtaccctaggtaaaccgtacgtttaccgaaggttcgggaccgtacggggtcccggggttacgtacgggggaacctaagggttaactttttacccgaacccgtttccctaaccgtaacccgtacgttaacccaaaaccgtacggtaccccgtacggtaccgaacgggtaccgtacgggaagggtacgttggggtacggtaccgtttaagtttttaacgttacgttacggttaccaacggtactaaggtttaactttaaagtaacctttaccctaccccgtttaccggtaaccggtttaccgggaacccggaaacggggttacccgaaaggggttaacggaaaaccttaaccggtaaaaacggtaccgttagggtaccggtaccgttaacgtaccccgaaccttaccggttaccgttacggtttaccc

SEQ ID NO: 50530 - DNA, 741 bp, Homo sapiens
  misc_feature: GYAE6OF02JYYT1.37.83.H06.1.454.CMB.1.raw
  modified_base (247)..(247): a, c, t, g, unknown or other
  misc_feature (247)..(247): n is a, c, g, or t
tcagtagtgtagatcacgaccggtgctcgatttagatcacgtgcgtcgcgggggacaacaggcaggcaggggcagcaagatggtgttgcagacccagggtcttcatttctctgttgctctggatctctgttactacagttgccgtacggggacatcgtgatcgaccagtcctccagacctccctggctgtgtctgtgggcgaggagggccacgatcaactgacagtccaggccggtagttgttttanacaacgtaccaagtaataagtagttactttagcttacggacctagacgaacggaacccacgaactacggccctacctaatcgtacgtcctttccggttacggtcgggtacccttaccgggtacccgggtaacgttccccgggggtacccttaggaaccgtacttcggacggtcgggccgggtacgggtcgtaggggacctaggtactttaccgaccttcccgtaccaacccgtataccgacgacgtccctacgacggacgaggtcgtaacggtgtacgtacgggttcttaagtttactttaacgtgttaccgagtaaccgttaggttaacttaacgttaaactcccgttaaccgtaccggttaacccgggtttacggaaaccggtacggggaacgtaagggttaacggtaaacgttaacccggaaacgtaacccggttagggttaccgacgttacgtaccctaaccttggtacctttaccggtctttaacccgg

SEQ ID NO: 50531 - DNA, 749 bp, Homo sapiens
  misc_feature: GYAE6OF02HK14P.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggtctttttcttgtggctaattttaaaaggtgtccagtgtgaggtgcagctgctgggagtcgtggggaggcgttggtacgaggccgggggggtccctggacgactctcctgtgaacgcctctggtattcaccgtttgactaagtgtacgcatcgaccgtgggtcccgccgtaggccgtaccgaggggaacggggctaggggaggttggtctacgtagtttagttaggttggtagtggtacgtagacacgagtacgttacgactacggtaacctcggtaggaacgggtcccggttacaccgtaactcccgtaaccacgtacgtaactaaacttacccgaaacgtacggaccgtaccgtccgttaggtttaactttcgggaacctaaacgtaacgttaacggaaaccacggtacccgttagggaaccggaacgggacccgggaacggaacccggaaccggtacctaacgttaaatacgtttagttacggtacgtaaccgtttaaccgttttacccttttaggtaaccgtttagggttttaacttacccgttaccccgtttaaggaccgttaccccggtaggttcccgggggtaccaaaccccgggg

SEQ ID NO: 50532 - DNA, 673 bp, Homo sapiens
  misc_feature: GYAE6OF02I1I87.37.83.H06.1.454.CMB.1.raw
  modified_base (223)..(223): a, c, t, g, unknown or other
  misc_feature (223)..(223): n is a, c, g, or t
  modified_base (271)..(271): a, c, t, g, unknown or other
  misc_feature (271)..(271): n is a, c, g, or t
  modified_base (286)..(286): a, c, t, g, unknown or other
  misc_feature (286)..(286): n is a, c, g, or t
  modified_base (294)..(294): a, c, t, g, unknown or other
  misc_feature (294)..(294): n is a, c, g, or t
  modified_base (343)..(343): a, c, t, g, unknown or other
  misc_feature (343)..(343): n is a, c, g, or t
  modified_base (359)..(359): a, c, t, g, unknown or other
  misc_feature (359)..(359): n is a, c, g, or t
  modified_base (445)..(445): a, c, t, g, unknown or other
  misc_feature (445)..(445): n is a, c, g, or t
  modified_base (596)..(596): a, c, t, g, unknown or other
  misc_feature (596)..(596): n is a, c, g, or t
  modified_base (608)..(608): a, c, t, g, unknown or other
  misc_feature (608)..(608): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtgtcgttttctaggtcgctaatttaaaggtgtccagtgtgaggtgcagctgctggagtcgtggggagtcttggtacgngggtcccggggggtcctggagctctccgtgtcgcacgctctggttacnttcttagacaactcncatcggancgtgggcctcgacgcgtcggagggagggcgtggacggtcggtcgtacgnggtagttggcgtacgnggtaggtgacgtacacgtactacgacacgtacgaacgtccggtacggtaacggggtcccttccgaacctatcccgtacccaagganaacgtaaccgttaaccaacgtaccaccgtctactccttagaactaaacgtcgaaacctaccgaggaagaccgaccgaacggtaccgtacccggttactactttaaccggtaagttacccggaaaatttaaccccgggtaaaccggtaacgnggtttaaaaccncgtaaccttaggttacggttacccgggtaaagttccgtaacgtcgttaccgttaccggtccgggg

SEQ ID NO: 50533 - DNA, 607 bp, Homo sapiens
  misc_feature: GYAE6OF02FKWHL.37.83.H06.1.454.CMB.1.raw
  modified_base (243)..(243): a, c, t, g, unknown or other
  misc_feature (243)..(243): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagacgggccacgatcaactgacaagtccaggccggtagtgttttanacaactccaagaataagtagttctttagctttaggaccagacaagaaaccacgacacgcctaccgtaagctgtccttacgtttacgtcgggacctacgtacccgggaacgtcccgggggtaccctaggaaccgtattccgaggtcgggcgggtcgggtcgtaggggactagtactttccacgttctacaacctatccagccacgccgtggcgggctagaagtagtggtaggttcggtttattacgtgtcagtcgtagttattagtcgttacctcctactacgttaggtttcggacgtacgggtaccagtcgtaggaaggtactacgacgaacgtaacgtgtacggtacgtcgactactagtccg

SEQ ID NO: 50534 - DNA, 601 bp, Homo sapiens
  misc_feature: GYAE6OF02FOFAQ.37.83.H06.1.454.CMB.1.raw
  modified_base (384)..(384): a, c, t, g, unknown or other
  misc_feature (384)..(384): n is a, c, g, or t
  modified_base (405)..(405): a, c, t, g, unknown or other
  misc_feature (405)..(405): n is a, c, g, or t
  modified_base (453)..(453): a, c, t, g, unknown or other
  misc_feature (453)..(453): n is a, c, g, or t
  modified_base (459)..(459): a, c, t, g, unknown or other
  misc_feature (459)..(459): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggcttttcttgtggctattttaaaaggtgtccagtgtgaggtgcagctgctggagtctgggggaggcttggtacaggccgggggggtccctgagactctcctgtgagcctctggattcacctttgactaagtgtgccatgaccctgggtcccgccaggcctccgaggggagggctgggagtgggtctcgtagttattaggtggttaggtggtaagtagcacagattacgcagactccgngaacgggtccgttcaccatcnccagacactaactccaacagcacgctgtatttcgactacatacgaacncgtccnggagacgccggagaccgaccggtaccaattactaatttacttggttacaacgttaaccttttcccgtttataccgtttggtttaactttaccgttcccgttagtaccggtacccacggttaccggggacccgtaacccgggg

SEQ ID NO: 50535 - DNA, 584 bp, Homo sapiens
  misc_feature: GYAE6OF02GHYBF.37.83.H06.1.454.CMB.1.raw
  modified_base (425)..(425): a, c, t, g, unknown or other
  misc_feature (425)..(425): n is a, c, g, or t
  modified_base (455)..(455): a, c, t, g, unknown or other
  misc_feature (455)..(455): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtgcgtttctaggtggctatttagagtgtcagtgtgacgtgcaactggtggagtctgggggaggcttggtccagcctggggggtccctgagactctcctgtgcagcctctgattcaactttggtagctattggatggactggggtcccgccagtcctccgaggggaacggggctggaggtggggtaggccaaacgataacgaggggaggtaggtggtaaacgaaaaactagtgtacggtactcgtagtcggcgggggtccagttccacctatcctacaagngacgaacgaccaaaaacgtcaactgtactntcgacaagtggacgcgtagagactacgagacgacggtcgtgtcgttattagttgtagtacgacgtagtattagtactaacgtaaagtttcgaagtagtacgtaggtacgtagtatagtacgttatacgg

SEQ ID NO: 50536 - DNA, 847 bp, Homo sapiens
  misc_feature: GYAE6OF02GYS07.37.83.H06.1.454.CMB.1.raw
  modified_base (221)..(221): a, c, t, g, unknown or other
  misc_feature (221)..(221): n is a, c, g, or t
tcagtagtgtagatcacgaccggtgctcgatttagatcacgtgcgtcgcgggggagagaggagccagccctgggattttcaggtgttttcatttggtgatcaggactgaacagagagaactcaccatggagtttgggctggagcggtcgtgtttctaggtcggctaatttaaaggtgtcagtgtgagtgcagctgctggagtcgtggggagcgttggacgngccggggggtccctgaggactctcctgtaggaactccgatgactctacctttgactaagtgtcgcctagtcgtaccgttgggtacccgacgtacggccgttaccggaaggggtaagggtcccgttggggaaccggtggggtaaccttcggtaacgtttaaacgtttacggtgggttacgggttaggttaacggttacgacggaactaacgggtagtttaccggacaaacgtacgtaccgtacgggttaaaccgggccgggtttacaacccggtactttaccgacccggtaggaaccgtaacctaaactttacccggaaacttaacggccaacgggtaccttagggtaacctttaggacctaaaccggttaggtacctaaacgacgttacccggtacggtaagtacgggacccggttaaacgggaaacccgttccggggtaaccccgaactttaaaaggtttccgttaaagttttaacccggggtttacgttaacccgttttaacggtttttccggttttaaccggttaaccgggttttaacggtttaacgtttaaccccgtttaacccgttacgggttaacccgggttacccggtaagggttcccggggtaaaccggtacccgggg

SEQ ID NO: 50537 - DNA, 626 bp, Homo sapiens
  misc_feature: GYAE6OF02F98N9.37.83.H06.1.454.CMB.1.raw
  modified_base (242)..(242): a, c, t, g, unknown or other
  misc_feature (242)..(242): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggcccacgatcaactgacaagtccagccggagttagtttanacaactaccaagaataagtagttcttagcttaggaccagacagaaaccacgacagcctactaagctgtactcgtttacgcggcctaccgtacccgggactcccggggtacctagacgtattcgagtggcggacggtcgtaggacagtactttccgaactcctacacgatacagtacagccgtggcggcgtagaagtacgtggttcggttacgtttattacgttacgtactaggtactaagttattagttacgtttaccttccgtacgttaccgttaaggttttccggaacggtaacggggtacctaggccggtaggtaacgtacgtaccggaccgttaacgtaacgttcggtacggtaccgtacgtaccgtaccgtagttccgg

SEQ ID NO: 50538 - DNA, 729 bp, Homo sapiens
  misc_feature: GYAE6OF02GA0LR.37.83.H06.1.454.CMB.1.raw
  modified_base (238)..(238): a, c, t, g, unknown or other
  misc_feature (238)..(238): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttanacaactccaaagaataagtagttctttagcttaggtaccagacaagaaaccacgacagcctacctaagctgcttcgtttactcgggccttcgtaccccgggaacgtcccgggggtcctaggaacgtattcgaggtgggcggtcggggtctggggactaggtactttcaccgtctaccaccactacgacgcctacgccgtcggacggggtccgttaggaaacggtagttcgggttacgggttccgggtttttaattaccggttacgtccgtaaggtaccgtaagtttaacgttttaagtttaccggttttaccttacccgttaccgttaacggttttaacgggtttttcgggaacccgggttaacggggggtaaccccttaagggtccggttacgggtaaacggtaccggtttaccggaacccgttaaaccggttaacggttcgggttacgggtaccgttaccggaccccgtaacccgttacgtttccccgg

SEQ ID NO: 50539 - DNA, 1030 bp, Homo sapiens
  misc_feature: GYAE6OF02GFC3J.37.83.H06.1.454.CMB.1.raw
tcagtagtgtagatcacgaccggtgctcgatttagatcacgtgcgtcgcggggacaacaggcaggcaggggcagcaagatggtgttgcagacccaggtcttcatttctctgttgctcgtggtacttctcgttacgttaactacggtaggtccgtaccgggtaacgggaactacgtcggtagtacgtacccgacccgtacgttccctaccgaaccgtaccccgttcccggtcggtcgttggttccgttccgttcgggtcgggacggaacgggacccggaaccgtaacgtacctaaccgtacgtacgaaccgtaccgtaccgacggtacggttagttttacgtttaaccaaacctaccgtaaacgaaaataacggttaagttacgttttacgttacgttcggtttaaccgaccgtaacgaactaaaaccgaaccgaacgaccgtacccgtacccgtaaccgtacgttccgtccgttaccgttttaccgtttacgggtcccggtaccccgttaaccccgggtaaccgggttacccgggttcccccggtaccgtaacggtaaccgttacgtacgggtacggggtcggggtccggggtaccgggttacggtacggtaacgtaagttttacccgttacccgtaccgttacccgtaacccgtaaccgttaccgtaaccggtaccgtaaccccggtccggttacccggttaccgggttaccgttaaacggtaaacgggtagttacggggttttaccggggttttaccgggtttttaaacgtttttaacccgtttcgttaaccgggtacgggtaaaccctttaggttttaaaacgtttttacggtttacgtttttaccccgtttaacccccgtttattaacccgggttttaacggtttttaccggggttacccgggaaacccggggttaccgtaaaccgtcgggtacggtaaccggtacgtaacccggtaccgaaaccgtttaacggttcggttcggtaccgtaccggtacccgtaaaccgttccgtacgttttaccgg

SEQ ID NO: 50540 - DNA, 931 bp, Homo sapiens
  misc_feature: GYAE6OF02IZ640.37.83.H06.1.454.CMB.1.raw
tcagtagtgtagatcacgaccggtgctcgatttagatcacgtgcgtcgcgggggagagaggagcccagcccctgggattttcaggtgttttcatttggtgatcaggactgaacagagagaactcaccatggagtttgggctgagcgtggtctttttcttgtggctaattttaaaaggtgtcagtgtgaggtgcagctgctggagtcgtgggggaggcgttggtacgacggccgggggggttccctggacgtactccgttcctggtacgtaacggccctcgtcggtacttccgtaccgttttagaaccgtaaaggttcggtacgtaccccgtaattaccggtacccgtcgggggtaccccgaccccggtaacgggtccccgtaccggaaggggggtaacggggtcggtggggaaggttcgggggtaccttacgtaaggttttaacggttttaggttacggggttaaggttaggggtttaacggtaaggttacccaaaggtaacggttaacgtttaaccggacgtaacggtaaccgttacccgggtaacggggtaaaacggggttcccccgggttttaccgaaacctaccgtttacgtaacccgtaaggaaaccgtaaaccctaaattaccccgaaaactaccgaccgtaaccgtaccgtttacgtttaacgtttcgaccgaaccgttaagtaacgtaacccgacgtccgtagggaaacgaccggtaaccgggaacgggaaccgtacccgggtaacctaaacgttaactttaaagttttagttaacggttaccgtaaccggtttttaaaccgttttacccggtttttaacgtaacggttttaccgggttttaacttttaacccggttacccgtttaacggttacggtaacccccggttacggttacccgggggtaccgttaaaaccccggggg

SEQ ID NO: 50541 - DNA, 573 bp, Homo sapiens
  misc_feature: GYAE6OF02G3ST8.37.83.H06.1.454.CMB.1.raw
  modified_base (359)..(359): a, c, t, g, unknown or other
  misc_feature (359)..(359): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggctttttcttgtggctattttaaaaggtgtccagtgtgaggtgcagctgctggagtctgggggaggcttggtacaggccgggggggtccctgagactttcctgtgaagcctctggattcacctttgacagtgtgccatgacctgggtccgccaggctccgaggggaggggctgggagtgggtctcagttattaggtggtagtggtagtagcanagattacgcagacctccggtaggaagggtccggttcaccatcctccagagacaattccaacagcacgctgtattcgcacatagaacagcctgagacgaccggaggacacggccatatattagttgtacgacgttaaactttccgtttagtacgttaggtttaacttacgttacccttaggttcacccgacgtcgggggaccctagggtaccccg

SEQ ID NO: 50542 - DNA, 647 bp, Homo sapiens
  misc_feature: GYAE6OF02IE7GK.37.83.H06.1.454.CMB.1.raw
  modified_base (299)..(299): a, c, t, g, unknown or other
  misc_feature (299)..(299): n is a, c, g, or t
  modified_base (457)..(457): a, c, t, g, unknown or other
  misc_feature (457)..(457): n is a, c, g, or t
tcagtagtgtagatcacgaccggtgctcgatttagatcacgtgcgtcgcggggacaacaggcaggcaggggcagcaagatggtgttgcagacccaggccttcatctctctgttgctctggatcactggtgccgtacggggacatcgtgatcgacccagtctccagacctcccgtggctgtgtctcgtgggcgaggacggcccaccatccaactgacaacgtccagccagtaccttcttttgtcagtccgtacgaacaaataaagtaacttactttgcttacggtaaccaacgaagaaancgaggacacgtccttaccgttaagttcgccttactactttacgcggactacgtcccgaccggtactacggtcccggggtacctggacccgtattcgacgcggacgacggccgggttcgacggactagttacttcgacctctaccactactacgagccncgtacctgaccgaggtactaggaacgtagtggtcgtacgttagtttactttcgtgttcgtgtacgttagtttagtttacggtaccgttccggttccggttacgttccgggaccggtacggtaacgggtaacgtaacgggtggaactagtaccgtaacggtacgtaacggtcggtcggtacgtcgtaaccc

SEQ ID NO: 50543 - DNA, 743 bp, Homo sapiens
  misc_feature: GYAE6OF02GSZHA.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtggcgttttctaggtggctatttaaaggtgtcagtgtgagtgcagctgctggagtcgtggggagcttggtacagggccggggggtcctggacgtacgtctacctgtagaacgcctacgtggtacttaccgtacctttgaacctaaggtgtacgcctaatcggaacccgttcggggtcccaccgtaggtacctaccggaaggggaacgggccgttagggacggtcggggtctacgagtttaagttaggtaggtagttacgggtaagtacgacgaacgtagtaacgttaccgacgtacggaaccttaccgggtaggtaaaccggggttcccggttaccaaaccggtacttaccgtacccgaaggtaacgtaaccgtaaactttaacccgaaacgtaccggtactaacccggtcgttaacgtcgtttacggactaacgtagtacgaaacgtcgtaccgtagacgacgaccgaacgggaccacggtacctaagttactaagtttatacggtacgtaccgttaaacgttccgtttagaacgtttacgtttaacttaccgtacccgttaggaccgtacccgtagtacggggtacctaacccggg

SEQ ID NO: 50544 - DNA, 748 bp, Homo sapiens
  misc_feature: GYAE6OF02IKCKG.37.83.H06.1.454.CMB.1.raw
  modified_base (344)..(344): a, c, t, g, unknown or other
  misc_feature (344)..(344): n is a, c, g, or t
tcagtagtgtagatcacgaccggtgctcgatttagatcacgtgcgtcgcgggggagagaggagcccagccctgggattttcaggttgttttctatttggtgatcaggactgaacagagagaactcaccatggaggtttgggctgagcgtggtctttttcgtttggtggtcttaagttttaaaaggtgtcctagttgtggaggtgcagctgcgtggtagtcggtgggggaggtcgttgggtaccgagggtccgggggggtccctggacgtactcgtccgtggtagaaccgcgtctcggtacttcctaccgtttgactaggtgtacgccagtcgaccgtcgggccnccgacgctccggaggggtagggcgtgggtaggtcggtctcgtagttagttggtggtagtggtagagtcagagtatacgcgagtaccgtcggtaggaacgggtcccgtaactaccgtactcgtccgaagtaccgaacctaacgttacccaaaacgtcgaccgtaaccgtgttacgtttacgttctaaacgtactaacgtaaccgaaacgtacgtcccgtaagtaacgggaccgacccgggtaaggtaacccgacgtaaccgttaataaactttcgttaagtccggagttaaccttaaacccttttccggttttgaaccgttttggtttaaacccttttccgttaaccccggttaggttaacccgtaacccggttacggggtaccgggtaaccccggtaaccgggg

SEQ ID NO: 50545 - DNA, 684 bp, Homo sapiens
  misc_feature: GYAE6OF02I764D.37.83.H06.1.454.CMB.1.raw
  modified_base (397)..(397): a, c, t, g, unknown or other
  misc_feature (397)..(397): n is a, c, g, or t
  modified_base (424)..(424): a, c, t, g, unknown or other
  misc_feature (424)..(424): n is a, c, g, or t
  modified_base (459)..(459): a, c, t, g, unknown or other
  misc_feature (459)..(459): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggccgagagggccacgatcaactgcaagtccagccggatgtttaatacaactccaagaataagagttcttagcttaggtaccagcaagaaaccacgacagcctaccgtaagcctcgaccttcgtttaccgtcgggcccttccgtacccgggtaactccccggggtaccctagaaccgtattccgaggttcgggcgggacgggtcncggggacagtactttcactctccaccngtacagcacgccgtggccggggtctacgggaaagngttagggttcgggttacggttttacgttacgttggttaccctaacgggtctaaggttttaacttaatttcgtttaaccctacctttaccgtacgttttaaccggttttacgggacccggaagggggtaccccaagtcccgttaggggaccgtaagttaccggaccgtaacccggtaaccggttaggtaccgggttaccctgggtaccctacccggtaactttccg

SEQ ID NO: 50546 - DNA, 698 bp, Homo sapiens
  misc_feature: GYAE6OF02FKODE.37.83.H06.1.454.CMB.1.raw
  modified_base (444)..(444): a, c, t, g, unknown or other
  misc_feature (444)..(444): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagacctccctggctgtgtctcgtgggcgagacgggccacgatcaactgacaagtccaggccggtagttgttttaacaccgaacctaccaaagaataaggagtttactttagctttaggaccagcaacgaaaccacgacacgccctacctaagctgcgttcgtttacgtcgggtcctccggttaaccccggggaacgttccccgggggtaccctcggtaaaccgtcgtttacgaggtcgggtccgggtcggggtacgtgggacacggtactttcnccttactcctaaccagtaccacgacacgtccgtcggcggtaccgtaggtaacgtacggtcggttacgggttaccggttttatttacgtcgttcgagtaccgtaacgtttaagtttacgtttaccggtttaccttacccgttaacgttaccgtttacggtttacggacccgtaaccggggaacctacggtacgtaggtaacggtcgtaccggacctaacggacgtcggtcgtccgtacggccgtaccgtattccg

SEQ ID NO: 50547 - DNA, 772 bp, Homo sapiens
  misc_feature: GYAE6OF02JN7EP.37.83.H06.1.454.CMB.1.raw
  modified_base (249)..(249): a, c, t, g, unknown or other
  misc_feature (249)..(249): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgccgtacggggacagtcgtgatgacccagtctccagactcccgtggctgtcgtctcgtgggcgaggacgggccacgatacgaactgcaagtccgagccgtagttgttttanaacaactaccaagtaataagtacgtttacttaagcttaggtaccagtacaacgaaaccgacgtaaccacgtaccctacccgttaagccgttacgtaccgtttaccggtttacgtcgggtccccttaccggttaaccccgggggaacgtttcccccgggggtaccctacggtaaaccgtacgttacggtacggtcggggccggggttcggggtaccgtaggggtaaacctacggtttacgtttaccaacccgttctaccgtaacctacgtaccgacgtcgaccggtccgtacggccgggtacgtacggaagtacgtcggttacgggttacgtttaacgttacgtacggtcgtacggtacgttaacggttactttaacgtttccggtttaccttacccgttacgttaaccgtttaggtttaccgggaaccggttaccgggaaccgtacggtaccggtaggtaacgtacgtaccggtacgtaaccgtacggttcggtacggtaccgtacgtacctacgtgttaccg

SEQ ID NO: 50548 - DNA, 902 bp, Homo sapiens
  misc_feature: GYAE6OF02GQEIF.37.83.H06.1.454.CMB.1.raw
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagaggccacgatacaactgcaacgtccagccggagttgttttatacaactaccaaagaactaaagtagtttactttacgcgtttcggtaaccacgtacgaacgaaaaccctacggacaggccctacctaacgctgcttccggttttactcgggcccttaccgttaaccccggggaacgttccccggggggtaccctaggaaaccgtactttaccgaacggtcggggaccggggtcggggttccgttacggggaacctaaggttacgttttaccgaaccttcccgttacccaaacccgacgtttacgaaccggtaccgtaaacggccccggtttacggggacccggggtcgtttaacgggaaaacgggttaacttcggggtttacgggggtttaacccggtttttaaacgttttaaccgtcgggttaacccgtacggttaaccgtaaacggttttaaagtttaaacgtttaaacccgtttaacccgtttaccccgttacccgggtttaaacccgggtttaacccgggaacccgggttaaaaccggggaacccggttaaaaacggggttacggggtaaaaaaccgttttaacccggaaaaaccgggttaaaaccgggtttaccggttaacggggtaccgtttacggaaccccgttacccggttaaagtttcccggttaacggtttttaccctacgtttaaacccccg

SEQ ID NO: 50549 - DNA, 716 bp, Homo sapiens
  misc_feature: GYAE6OF02JMP8H.37.83.H06.1.454.CMB.1.raw
  modified_base (575)..(575): a, c, t, g, unknown or other
  misc_feature (575)..(575): n is a, c, g, or t
  modified_base (633)..(633): a, c, t, g, unknown or other
  misc_feature (633)..(633): n is a, c, g, or t
  modified_base (696)..(696): a, c, t, g, unknown or other
  misc_feature (696)..(696): n is a, c, g, or t
tcagtagtgtagatcacgaccggtgctcgatttagatcacgtgcgtcgcgggggagagaggagcccagccctgggattttcaggtgtttcatttggtgatcaggactgaacagagagaactcaccatggagtttgggctgagctggcttttcttgtggtctattttaaaggtgtccagtgtgaggtgcagctgctggagtcgtgggggaggcgttggtacaggccgtggggggggtccccttggacggtaccgtccgtcccgttggtcggacgacggtcccttcgttgggactttccgaaccgttttgggtaacgtccttaagtttcgggagttcgggtaacgttcggggtacccgtacccgtaaggttcccttcccggaagggggtaaagggggtcccgtaggggtaggttcgggggttccgtacgtacgtcccgtaaggtttacggtacgggttaaggtcggggttaactttacgaacgtttaagtaccgttaacgctaaggtacctacaggttaggacggggtccgtaatttccgacctagtcctccgagaacgacaacggaccaaagtacncactgttactctcggacaaattgaacctagcccgtagaaccgtagacccggacgaacnccgggtctaaggtgttaacttacgaggtcgaacggtacacgtccccgtaccaccgttccgacnccgtaagccgaggtcgtacg

SEQ ID NO: 50550 - DNA, 677 bp, Homo sapiens
  misc_feature: GYAE6OF02JKH0W.37.83.H06.1.454.CMB.1.raw
  modified_base (189)..(189): a, c, t, g, unknown or other
  misc_feature (189)..(189): n is a, c, g, or t
  modified_base (204)..(204): a, c, t, g, unknown or other
  misc_feature (204)..(204): n is a, c, g, or t
  modified_base (272)..(272): a, c, t, g, unknown or other
  misc_feature (272)..(272): n is a, c, g, or t
  modified_base (390)..(390): a, c, t, g, unknown or other
  misc_feature (390)..(390): n is a, c, g, or t
  modified_base (397)..(397): a, c, t, g, unknown or other
  misc_feature (397)..(397): n is a, c, g, or t
  modified_base (405)..(405): a, c, t, g, unknown or other
  misc_feature (405)..(405): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagcttgggctgagctggctttttcttgtggctattttaaaaggtgtccagtgtgaggtncagctgctgagtcgnggggaggcttggtacgagccgggggggtccctgacgacgtctcgtagtcgaagtcctcgtggaattcncctttagactaagtcgtcgccagtcgaccgtcgggtccgcctacgggctaccggacgggtaaggggccgttgggagttcgggtctacgtagttagttaggtgggtagtgggagtacgnactaagnttacgcgngtacgtcggtagacgggccgttcgactcgttcctaccgacgagaactaacttaccgaacacgcaccgtacgtcgttagttctacaactatacgaactacgacgttaggacgacgacgacggaccgaacggtaccgtaattaacctaatttacgttacggtactacgttaaacgttttccccgttttaagttacccgtttacggtttacgtttaacccgtttccgtaacccggttaacggtacccgtacccgggttacgggtaacccccgggg

SEQ ID NO: 50551 - DNA, 637 bp, Homo sapiens
  misc_feature: GYAE6OF02GP9SX.37.83.H06.1.454.CMB.1.raw
  modified_base (241)..(241): a, c, t, g, unknown or other
  misc_feature (241)..(241): n is a, c, g, or t
  modified_base (281)..(281): a, c, t, g, unknown or other
  misc_feature (281)..(281): n is a, c, g, or t
  modified_base (326)..(326): a, c, t, g, unknown or other
  misc_feature (326)..(326): n is a, c, g, or t
  modified_base (370)..(370): a, c, t, g, unknown or other
  misc_feature (370)..(370): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctctgggcaggagggccaacgatcaactgcaagtccagccggagttgttttaanacgaactccaagtaataagtatttcttagcttaggtaccngacaagaacctacgacacgcctacctaagcctgctacgttttacncgggtcctacgtaccccgggagtcccggggtacctacgaacgtnttcgaggtcggcggtccggtgtcgggactaggtacttcgactcgtaccacgtatcacgtcgacgtccgtcggcggtacgtaggaacgtagtggttacggttacggtttattacgtgtacagtactacgttagttacgttcttaccgttacctaccgttacttacggtttacggaccgtaccgggtaactacgtacgtacgggtaacgtacgtaccgtaccgaacgtaacggtcgtacggtaccgtacgtacgtaccctagttacccg

SEQ ID NO: 50552 - DNA, 745 bp, Homo sapiens
  misc_feature: GYAE6OF02FGCMM.37.83.H06.1.454.CMB.1.raw
  modified_base (244)..(244): a, c, t, g, unknown or other
  misc_feature (244)..(244): n is a, c, g, or t
  modified_base (291)..(291): a, c, t, g, unknown or other
  misc_feature (291)..(291): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctcgtgggcgagagggccacggattcaacctgctaagtccagccagtactgttttanacagctcaacataacgactacttagcttaggtatcagctaacgaacnggacagcctactaactgactactatttacgcgggactacgttaccgtacccggggtacggtcccggggttaccctacggaccgtactttccgaaggttccgggacgaacggtccggggttagtacgggggtacctagggtacctttccgaaccgtttcgacctaaccgtataccctaacgaccgtcccgtagaccgtaaggtccgttaggacggtacgttacgggtacggttacgtaagtttttacttaacggttctaaccggaacgtaccgttaaggttttaacttaaccgttaaacctttaccggtaccccgtttccgggtaacccggtttcccgggaacccggtaaaccggggttaaccggtaaagggttaaccggaaaaccgtttaacccggtaaacgggtaacccgttagggttaaccgggtacctttaccgggaacccttaaccccgg

SEQ ID NO: 50553 - DNA, 272 bp, Homo sapiens
  misc_feature: GYAE6OF02HB7DZ.37.83.H06.1.454.CMB.1.raw
  modified_base (261)..(272): a, c, t, g, unknown or other
  misc_feature (261)..(272): n is a, c, g, or t
tcagtagtgtagatcacgaccggtgctcgatttagatcacgtgcgtcggcgggtctgggacagatttcactctcaccatcagcagcctgcgggctgaagatgtggcggtttattactgtcagcagtattatgttactcctcacagttttggccaggggaccaagctggagatcgcacgaactgtggctgcaccatctgtcttcatccttcccgccatctagaactctacactactgacgcggctggcaaggccgcaatagnnnnnnnnnnnn

SEQ ID NO: 50554 - DNA, 717 bp, Homo sapiens
  misc_feature: GYAE6OF02G3U43.37.83.H06.1.454.CMB.1.raw
  modified_base (242)..(242): a, c, t, g, unknown or other
  misc_feature (242)..(242): n is a, c, g, or t
tcagtagtgtagatcacgaccggtgctcgatttagatcacgtgcgtcgcggggacaacaggcaggcaggggcagcaagatggtgttgtagacccaggtcttcatttctctgttgctctggatctctgttactacaggtgcctacggggacatcgtgatgacccagtctccagactccctggctgtgtctctgggcgaggagggccacgatcaactgacaagtccagccagtacttgttttanacagtctaccaaacaataagaactacttagtcttggtatcgagactaagaaaccgagggacacgaccctacctaaaaccgtcgacctacgtaatttaacgtcgggactacgtaccggtaacccggggtacggttcccggggtaccctacggaaccgtattaccgaggtcggtcgtaacgggtcgggtcgtacgggactaacggtacttttaccaccgttacctaccgaacctaatacccaaacgtcgacccgtagaccgtacgggtacctaggaacggtagttggacggtacgttaacgttttacgtacgttgtacctagtacttaagttaacttaacttaactacccgttacccgtaccggtaccggtttaccgggaaccgtaaacggggtaaccgtaagggtaacggtaaaaccgtaaccgtaaaaccggttacgttacgggtaccggtactacggtaaccctaccgttaacg

SEQ ID NO: 50555 - DNA, 770 bp, Homo sapiens
  misc_feature: GYAE6OF02HN8K9.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtggtctttttcttggtggcttaagttttaaaaggtgtccagtgtgaggtgcagctgctggagtcgtgggggaggtcgttgggtacgacgggccggggggttccctggacgtacctcctccgtggtacgaacgtcctcgtggtacttcctaccgtttagaacgaagttgtcgcctaagtcgaaccgttcgggtcccgaccgaggtcccgtaccggaaggggaacggggtccgtagggtaggtcgggtctacgtagtttagttaggtacggtaggtaggtagtagcagagtatacgcaacgtacgtcggtaggaacgggccgttacacctagtccgtaccagaacgtaactaaaccgttaccgaaacgtacgaccgtaaccgtcgttaacgttatttacggactacgtaacgtaacgaaacgtacgtaccgttaggaacggacggaccggaacggaaccgaaccgggtaacctaaagttaacttaagtttaacgttcggtaaccgttaaccgtttaaaccgttttcccgttttacggtaacgttttaaccggtttaatttacccgtttaccccggttaagtacccggttaaccgtaacgggttcccggggacccgttaaacccgggg

SEQ ID NO: 50556 - DNA, 891 bp, Homo sapiens
  misc_feature: GYAE6OF02JTI28.37.83.H06.1.454.CMB.1.raw
  modified_base (135)..(135): a, c, t, g, unknown or other
  misc_feature (135)..(135): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacnggtgcctacggggacatcgtgatgacccagtctcagacctcccgtggctgtgtcgtctgggcgaggaggggaccacgagtccaacgtcgacaacggtcccaggccggtagttgttttaacactaactaccaaagaacttaaaggacgtttacgtttaacgtcgtttacggtaaccctaggacctaaacggaaacccaacgaacgtaacggaccctacctaacgtcgtagtcccgttacggttttaaccgcgggtccttacccggacccggggtaatccccggggggttccctacggaaacgttactttcgacgggttacgggccggtcgggggtttacctaggggacctaacggttacgttttaccgaacctttccgtaacccgaccccgttagtaccggaacgtcccgtaaggtaccccgttcgggtaccggggtccgttagggaaaacgttcggtcggtttaccggggttaccggtttttaaacgtttaccggtttacgtacgtaaccgggtacgttaaacggtttacgtttaaaggtttcccggttaaacttttccccggttaacgttaccgttttaaccgggttttaacggggtaacccgggtaacggggggtaaccccttaaccgggtaggttaaaccggggtacgttaaaccgggttccgtaaacccggttaaccggtaaaccggtttacggggtacccgggttaccgttaacccgggtaaccgttaccccgttaacgttttaacccggg

SEQ ID NO: 50557 - DNA, 927 bp, Homo sapiens
  misc_feature: GYAE6OF02FKDVV.37.83.H06.1.454.CMB.1.raw
tcagtagtgtagatcacgaccggtgctcgatttagatcacgtgcgtcgcgggggagagaggagcccagccctgggattttcaggtgtttcatttggtgatcaggactgaacagagagaactcaccatggagttgggctgagctggctttttctgtggctatttaaaggtgtcagtgtgagtgcagctgctggagtcgtgggggaggtcgttggtacgagggccggggggggttccctggtacgactactccgtgtgaacgtcctacgtggacttcctaaccgtttgaaccgtaagttgtcgtaccagttcgtaaccgttcggggttacccgccgtaacgggccgttacccggaagggggaacgggggtccgttaggggtacggttaggggggttcctacgtaaggttttaacggtttaggtagggttacgggttaacggggttagttacggaccgtaaccggtaaggtaacgtttaaccggacgtaaccgggttaccgttacccgggttaagggaaaccgggggtttccccggggtttaccgaaccccgttaacgtcccggtttacccgaacggtaaacggtaaacccgtaaaccgttttaaccccgaaacggtaccggtaacccgtaccggtacgttaacggtttaacgtttcggaacctacgtaagttaccggaaactacggtacccgttacgggtaaacgaccgggtaacccgggtaacgggaacccggtaaccgggtaccccttaagttaaaggtttaaccttttaacggttaaggttacccgggttaaacccttaaaaccggtttttccgttttaaccgggttaacggtttaacggttttaaccttttaacccgttacccggttacggttacccggtaacccgtacccgggttacgggggtacccccgttaaacccgggggg

SEQ ID NO: 50558 - DNA, 755 bp, Homo sapiens
  misc_feature: GYAE6OF02JTEX7.37.83.H06.1.454.CMB.1.raw
  modified_base (176)..(176): a, c, t, g, unknown or other
  misc_feature (176)..(176): n is a, c, g, or t
  modified_base (325)..(325): a, c, t, g, unknown or other
  misc_feature (325)..(325): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggtcttttcttgtggcttaattttaaaggtntccagtgtgaggtgcagtctgctggagttcgtgggggagtcgtttggacgagggtcccgggggggttcctggagtacctctccgtaggtgaacgtcctctagacttccacttttagactaacgtgttcgcctatcgaccgtcgggtccnccagggctacccgagggtaagggcctggacggtggtcgacttagttacgttaagtgggttagtggttaagttagacgtagtacgagtttccggataaggtaacccttcgggtacggtaaacgggggtccccggttacacccgtaggttaccttaccgaacgggtacgtaaacgaaaccgttttaccgaaaccttaacggacccgtaacgtaccggtttacgtacgttttaccggacgttaaaccgtacgttaaccggaaaccgtaacgcccggttagaacggtacggacccggagaaccgtaccggactaacgtaacgtaattacgttgaccgttaacgtaaacttttccggtttacgtacgttaggtttaaccttattaccccggttaataccggtaacccgtacggttacggggaccccgtaaccggg

SEQ ID NO: 50559 - DNA, 732 bp, Homo sapiens
  misc_feature: GYAE6OF02JCV8Z.37.83.H06.1.454.CMB.1.raw
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgctacggggacatcgtgatgacccagtctcagactccctggctgtcgtctcgtgggcaggagggccacgatcaacgtgaccaagtcccgaagccggtagttgttttacaacgtaaccgtccaaaggtaataaggtagtttcgtttagtctttacgggtaccaggtctaacgaaaccgtagaccgtacgtaccctccgtaaggcctaggccttcgtttaaccgcggggtcctaccggtaaccccgggtaagtccccgggggtaccctaggaacctgtttccgaggtgggaccgggcgggttcgtaggggacctagtacgtttcgacctctaccgaacgtactcgacgtcgtacgccgttcgggccgggttacgtacggaaagtacgtcgggttcggttacgggttttaacttacggttcgtacgtacgtacgtaacgttagtttacgtacgttttaccgtacccttacgttaccgttaggtttacggacccggtagggtaaccgtacggtccggtaggtaacgtaacggtaccgtaaccggtaaccgtaaccggttggttacggtaccgtcgggtaccctaaccgtgttaacccg

SEQ ID NO: 50560 - DNA, 653 bp, Homo sapiens
  misc_feature: GYAE6OF02GZC60.37.83.H06.1.454.CMB.1.raw
tcagtagtgtagatcacgaccggtgctcgatttagatcacgtgcgtcgcggggacaacaggcaggcaggggcagcaaagatggtgttgcagacccaggtcttcatttctctgttgctctggatctctgttactacaggtgccgtacggggacatcgtgatcgacccagtctccagtacctcccgtggctgtcgtcctcgtgggcgaggacggccacgactcgaactgacaacgccaggccggtaattgtttaacacaacgtaccaagaataacgtagtttcttaagtcgttacgtacacgacaacgaaccacgacacgacctacaacgctcgctcgttacgcggtccctaccggtaaccggacgttccgggtaccgtgtaacgtacgttcgaggtcggcgggtacggtgtacgggactagtacttcgactcacctacacgtcgacgtcacgccgtcggacggtcgtacggagtagtacgtcggttacgtttacgtagttcgtcacgtcgtaacgttattacgttacttcctaccgtagtacgttcggttttaccggaccggtacgggaaccgtacggtcggtacgggtaactacggacgtacccggacgtaaccgttcggacgtaccgtccgtaaccgtaccgtagttaccgg

SEQ ID NO: 50561 - DNA, 734 bp, Homo sapiens
  misc_feature: GYAE6OF02GF4VS.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccatggaggtttggctgagcttggtctttttcgttggtggtacttaatttttaaaaaggttcgtaccgtagtgtggaggtgcagctgcgtggtagtcggtgggggaggtcgttgggtacgaggggcccgggggggttccctggacgtacctcgtcctggtagaacgtccctgtggtacttccgtacgtttcgacgtaagtgtcgaccgtagtcgtaccgttgggtccccgtacgacggtcctaccggagggggacgggtacgtaggaacgtcgggtctcgacgtcgtacgttaggtacgtaggtaggtaggagacgtacgtactacgtcgtcgtaccgtcggtaacggacgggtcccgttccgccctcgtacgacgactaacccacctaaccgaaactaaccgacgtcgttcggtacctccgttaacgaccgttaaacctaaacgtaccgtccgtaagaacggaacggtaacgacggaaccgtaccgggaactttaataccgtttcgaggttgaaaccgggtaagtaccgggttcaacgtcgggtaacgccgttacccgtacggttaacccctccgtaaatcttaccgagtaccggtcggtacggtaagg

SEQ ID NO: 50562 - DNA, 697 bp, Homo sapiens
  misc_feature: GYAE6OF02F98O9.37.83.H06.1.454.CMB.1.raw
  modified_base (266)..(266): a, c, t, g, unknown or other
  misc_feature (266)..(266): n is a, c, g, or t
  modified_base (301)..(301): a, c, t, g, unknown or other
  misc_feature (301)..(301): n is a, c, g, or t
  modified_base (321)..(321): a, c, t, g, unknown or other
  misc_feature (321)..(321): n is a, c, g, or t
  modified_base (344)..(344): a, c, t, g, unknown or other
  misc_feature (344)..(344): n is a, c, g, or t
  modified_base (348)..(348): a, c, t, g, unknown or other
  misc_feature (348)..(348): n is a, c, g, or t
tcagtagtgtagatcacgaccggtgctcgatttagatcacgtgcgtcgcggggacaacaggcaggcagggcagcaagatgtgttgcagacccaggtcttcatttctctgttgctctggatctctgttacacaggtcgcctacggggacatcgtagactcacccgagtctccagacctccctaggcctgtgtctcgtcggggacgaaggacgggcctaacgtactaccaacgtgaccaacgtccaggccaagtacttgttttacacngacctacaaataataacgactacttaagcttagtntacagacgaacgaaaccggngggacacgtaccctacgtaaacncgtnttacctagtttacgcggactacgtaccggtaccggggtacgtccgggtacctacgacccgttatccgtaggtccgaacgtcgggacggtccgagggactacgtacgttccacgtcgtactaacacgtacaaactacggtcctacgcgaacggtcgtaggtacgtacggtcgtacgggttaacttattttaaacgttcgtacgtacgtaataaccgttaaggttaacttaaccgtaacttaccctaccggtttacgaccggtttacgaaccgggtaacggtaaccgtaaggttaaccggtaactaaccgtaacggttacgttaccgggagtaccggtacgtaacctaccg

SEQ ID NO: 50563 - DNA, 819 bp, Homo sapiens
  misc_feature: GYAE6OF02I7LHI.37.83.H06.1.454.CMB.1.raw
  modified_base (192)..(192): a, c, t, g, unknown or other
  misc_feature (192)..(192): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagttgggctgagctggcttttcttgtggctattttaaaaggtgtccagtgtgaggtgcagcnggctggagtcgtgggggagtcgttggtacgagggcccggggggtccctgacgacgtctccgtgtagacgccgtgtcggacgttcaccctttgaaccgtaggtacgtgcccagttgaccgtgggtcccgcgaccggtactccggaaggggtaagggccgtagggacgtggggttacctacgagttagttacggtcggtaggttggacgtacggacacaggtaacgtacgacgacgtaaccgtaccggtaggtaaaccgggtcccgtttaccgacccgtagttacccgtacccgtacggtaacgtaaccgtaaagtttaccccaaacgtaccgtaaccgtaccgggtaccgttacgttaacgttttacgtaccgtaacaacgtttacggaaaactacccggtacgttaacggtaaccggtacgggaccccggtaaccggggaaccgtacccggtaacgaaaccgtttaaacttaaccgtttaaagttttcgggtaccgtaacgttaaacccgtttacccggttttaccgttaaaccgttaccggtttaaacgtttaacccgttaccccggttaacggttaccgaacccggtaaccggggttaccggggaaccccggttaaaccccgggg

SEQ ID NO: 50564 - DNA, 869 bp, Homo sapiens
  misc_feature: GYAE6OF02HB1ZG.37.83.H06.1.454.CMB.1.raw
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactcccgtggctgtgtctcgtgggcgagagggccacgatcaactgcaagtccagccggtagttgttttaacacgaacctaccaaagtaaacgtaagtacgtttcgttaagtccgttaggtaaccctaaggccaaacggtaaaaccccaacgaacctaaccggcccttaacccgttaaaggtccttacggtacccgtttaccccgggttttttaaccgccggggggtaccccctttacccgggttaaaccccccggggtaaacggttttaccccccggggggttacccccgttaacgggtaaaacccgttacggttttacccgggaaacggggtttcgggggaccccgggggttaccgggggtttcccggttaacgggggtaacctaacggggttaaccgtttttcccggaacctttaccgtacctaaccgtactaccgacgaccgtaacggtccccgtagggcccgggtacgtagggtaaacgtacgtttacggggttccgggttaacggtttttacgttacccggttgtacccgtagtacgtaacggtttaatttacggtttacgttacctccttaacgtacgtttaacggtttaccggacccggtaacgggttaccctaacggtcgttaacggaacgtcgttaacggacctaacggtaaccgttggacgtcgtcgaaccgttaccgtcgttaccg

SEQ ID NO: 50565 - DNA, 718 bp, Homo sapiens
  misc_feature: GYAE6OF02FXF83.37.83.H06.1.454.CMB.1.raw
  modified_base (242)..(242): a, c, t, g, unknown or other
  misc_feature (242)..(242): n is a, c, g, or t
  modified_base (443)..(443): a, c, t, g, unknown or other
  misc_feature (443)..(443): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatcgacccagtctcagacctccctggctgtgtctcgtgggcgaggacggccacgactcaactgcaagtccagccggagttctttanaacaacgtcaaagaataacgacgtttacttagccttaggtaccagtcaaacgaaacctacggaacaacgtccgttaccgtaaagtccgtggtaccttacggtttaccgtcgggtaccttccgtaacccggggtacttccccgggggtacctagaaccgtattaccgtcgggtcgggtaccgggcggttacggacgggtaanacggttagtttccaacgttccgtacacccgtataccgtagaccgtaacgtcccggttacggaccggttaacgtacggtaacgggtaacgtacggtttcgggtaacgggttttttaataccgttacggtacccgtagtaaccgtaagtttagttaacgtttccgtaacgttccgtactaacggttttacgtacggtaccggtacggaacacggtacgtacggtaagccgtacgacgtacgttaggtcggtccggtacgtaccgtcacctagttcgg

SEQ ID NO: 50566 - DNA, 658 bp, Homo sapiens
  misc_feature: GYAE6OF02JAABN.37.83.H06.1.454.CMB.1.raw
  modified_base (267)..(267): a, c, t, g, unknown or other
  misc_feature (267)..(267): n is a, c, g, or t
  modified_base (281)..(281): a, c, t, g, unknown or other
  misc_feature (281)..(281): n is a, c, g, or t
  modified_base (391)..(391): a, c, t, g, unknown or other
  misc_feature (391)..(391): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggtctttttctgtggcttaattttaaaaggtgtccagtgtgaggtgcagctgctggagtcgtgggggagtcgttggtacgagggtccggggggtccctgacgtactctcctgtgacgtcctntggattctactttnacgtagtgtgccatcgaccgtggtcccgcgaggcctcggaggggtacgggcgtggaggtcggtctgtagtttagttggtaggttgtggtagtagccgtaatagtatacgntacgaccgtcggaggacgggtcccttacaacctgtccaccgagtacgtaacctaacttaccgaaacacgctaccgtctgttaacttcgactatataacgaactgtacccgtagacggacgccggacgaaccgtacgacctaatattacgttagttgtacgtaaccggtttaacttttccggttttaagtacggttttaggtttaacccttacgttaccccgttaggtacccgttaacccggtacgtaccggggtccctaaacccggg

SEQ ID NO: 50567 - DNA, 697 bp, Homo sapiens
  misc_feature: GYAE6OF02FY4XD.37.83.H06.1.454.CMB.1.raw
tcagtagtgtagatcacgaccggtgctcgatttagatcacgtgcgtcgcgggggagagaggagcccagccctgggattttcaggtgtttttcatttggtgatcaggactgaacagagagaactcaccatggagtttgggctgagctggtctttttcttgtggcttaattttaaaaggtgtccagtgtgaggtgcagctgctggagtcgtgggggaggtcgttggtaccgacgggcccgggggggtccctggacgactcctctgtgaacgtcctcgtggcttcctaccgtttgaactaagttcgtcgcctagtcgacccgtggggtccccgcgtacggcccgtaccggaagggggaacgggggtcgttaggggacggttcggggttactacgtagttttaacgtttagggtaggttaggttggtaagtaggaccaacgagtaactacgcgaagtaccgtcggtagggaacggggtcccgttaccacctactccgtaccgagaactaactaacttaccaaacacgacgacgtctgttacgttcgacatacgtacgaacacgtcgagaagaccgacggaacgaccgacggactaattattattacgttgtacgtaccttaaccgttttcgtttagtacgtttagttacctttacgtccccgttagtaccgtaccgtacggttaccgggaccgtaaccggg

SEQ ID NO: 50568 - DNA, 622 bp, Homo sapiens
  misc_feature: GYAE6OF02GSZGB.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggtctttttcttgtggctattttaaaaggtgtccagtgtgaggtgcagctgcgtggagtcgtgggggaggcttggtacagggccggggggtccctgagactctcctgtgaagcctcgtggacttcacctttgactaagtgtgccatcgaccgtcgggtcccgccgaggccgtaccggaggggaacggggcgtgggaggtcggtctacgtagttagttaggtggtagtggtagtagcagagtactacgactacgacgtccgaggtaacgggccgtacaccactccgaccgagacaactaactaccaaacacgaccacgtcttagttacttcgacctaacatacgaacacgtccgtagaacgacgccggaacggaaccacggacctaatattagttacgtgtagtacgtaacttttcgtttagtacttgtttaactccgttaccgtagttaccgaccgtacggtcgggacctaaccggg

SEQ ID NO: 50569 - DNA, 932 bp, Homo sapiens
  misc_feature: GYAE6OF02HKLK8.37.83.H06.1.454.CMB.1.raw
tcagtagtgtagatcacgaccggtgctcgatttagatcacgtgcggtacggcggggacaacaggcaggcacggggcagcaagatggtgttgcagacccgaggtcttcagtttctctgttgctctggatctctgttaactacgaggtcgccgtacggggacattcgtgatcgaccctagtctccagacctcccgtggctgtcgtctggtcgggcgaggacgggccaacgtataccaacgtacggactaacggtaccacgggccggtaattagtttactaaccaaaccttccgaaaagtaaagttaagtacgttttaacgtttacgccgtttacggttaaccgaaggtaccgaaaacgtaaaacccgaacgaaccggtacctaccccggttaccgtaacggtccgtaacggtcccgtttaccggtttttaaccggccgggggtacccttacccggggtaaaccccggggggttacgttaccccccggggggttacccttaaacgggtaacggttaacttaacccggggtagggggttaccgggggtccggggttaggggggtttccccgaagggggttacccgttaaaacgggtttcctttttaaccccggaaacctttccccgtaaaccgacccgtttaaacgttaccgaacggtcccgtaacggtaccccggtacgggtaaccggcggtaacggtaagtaacggttagggttaccgggttaccgttttaaacgttccgtacgtacgtagttacggttaaacgtttaacgtttaccggtttacgtttaccccgttcgttaaccgtttaacgttacggtttaccggaacgggtaaccggtaccggtaacggtcgttagggaacgttacggtaccggaacggtacgtaacgggtcggttacggtacgtcccgtaacgaccgtttacgtttacccg

SEQ ID NO: 50570 - DNA, 828 bp, Homo sapiens
  misc_feature: GYAE6OF02FQPMS.37.83.H06.1.454.CMB.1.raw
tcagtagtgtagatcacgaccggtgctcgatttagatcacgtgcgtcgcgggggagagaggagcccagcccctgggatttttcaggtgttttcattttggtgatcaggactgaacagagagaactcaccatggagtttgggctgagcgtggtctttttcttgtggctaagttttaaaggtgtccagtgtgaggtgcagctgcgtggagtcgtgggggaggtcgtttagggtacgacggggcccggggggggttcccctggacgtaccgtcctcccgttggtacggaacggtcccttcgtcggtactttacccgtacccgttttagaaccgtaaaggttcgttacggacccctaacgttcggtaccccgggtttacggggtcccccggacccgtaccggggtccccgttacccgggaaggggggaaccggggggtcggtacggggtagggttcggggtttaccgttaccgtttaagggttttagttttaacggggtttagggtttaaggggtttacggggtttaaggttaaccggtaccgaaacgtaggttaaacgttaccggaacgtaacgtacccggttccgggtaacgggtaaccgggggtcccgttacccgtacccgtacgttccaccgacggaacaaccgtacttaacccgaacgagacctaccggtcttagtacgttacgcctagtactaccgaacgacgccttaggagacggaccgtacgtacgacgactaatcttaattagttcgtactacgttaaccgtttcgttacgtcgtttagttccttaccgtccgttacgtcgaccacggttacggcgtaaccgg

SEQ ID NO: 50571 - DNA, 699 bp, Homo sapiens
  misc_feature: GYAE6OF02IDW52.37.83.H06.1.454.CMB.1.raw
  modified_base (147)..(147): a, c, t, g, unknown or other
  misc_feature (147)..(147): n is a, c, g, or t
  modified_base (171)..(171): a, c, t, g, unknown or other
  misc_feature (171)..(171): n is a, c, g, or t
  modified_base (173)..(173): a, c, t, g, unknown or other
  misc_feature (173)..(173): n is a, c, g, or t
  modified_base (175)..(175): a, c, t, g, unknown or other
  misc_feature (175)..(175): n is a, c, g, or t
  modified_base (178)..(178): a, c, t, g, unknown or other
  misc_feature (178)..(178): n is a, c, g, or t
  modified_base (182)..(182): a, c, t, g, unknown or other
  misc_feature (182)..(182): n is a, c, g, or t
  modified_base (195)..(195): a, c, t, g, unknown or other
  misc_feature (195)..(195): n is a, c, g, or t
  modified_base (222)..(222): a, c, t, g, unknown or other
  misc_feature (222)..(222): n is a, c, g, or t
  modified_base (239)..(239): a, c, t, g, unknown or other
  misc_feature (239)..(239): n is a, c, g, or t
  modified_base (243)..(243): a, c, t, g, unknown or other
  misc_feature (243)..(243): n is a, c, g, or t
  modified_base (294)..(294): a, c, t, g, unknown or other
  misc_feature (294)..(294): n is a, c, g, or t
tcagtagtgtagatcacgaccggtgctcgatttagatcacgtgcgtcgcgggggagagaggagcccagccctgggattttcgaggtgttttcatttggtgatcaggactgaacagagagaactcaccatggagtttggctgagcggngtcgttctaggtcgctaattaagncngntgngtancgagctgctgagngtgggcgcttggacacggccggggtcngagtctctacgtgagcncgtntcgtgttctccgtttagacaaggtcttagaaccttgctactagggtccccncgtacggaccgtacggaacgggtaggcgtaggtaggtcgtactagtaagttacgtaggtcggtagtaggtatccgatacgaagtacacgacgaacgtcggttaccggtacggacgggtaccgttaaccaccgttaacgtaccggtaacgaacgaaccgttaacccgaaacccttacccggaataccgggacgttaacgtacgtagttaccgtataccggtaacgtactaacggtaccgaaccgttagtaccgggaacggaaccggcgaaaacgggaccttacgaacttaaaccgtatttaacgtactacgtacgtaacgtttaacccgttcgtttaacggtacgttagttaaccgttcgacccgttaagtaccggtacccgaagggtaccggtaaccgtaacggg

SEQ ID NO: 50572 - DNA, 799 bp, Homo sapiens
  misc_feature: GYAE6OF02H1GZT.37.83.H06.1.454.CMB.1.raw
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgccgtacgggacatcgtgatcgacccagtcctccagacctccctggctgtgtctcgtgggcgaggcggccacgactcaacgtcgacgtaacgtccgaacggtccggtaagttttcgttttaacaacctaaactacccgtaaaggtaaattaaacggtacgttttactttaaaggtccgttacggtaaccaaggtaccaaacggaaacctacggacaacgtacctaccgtaagcgtacgtccgttacgttacgtccgggtacctaccggacccggtaacggttcccggggtacctacgacgtacttccgagggttccgggacgggtcggttacgtagggaactagttactttccgcgtacctacgaacctacgtacgacgcggacgttccgtcgggaccgtacggttaggtaaacgtgttaccggggttacggtttaaccggtttaactttaccgtcggtactacggtaacgtttacggttaaccgtttacgttacccgtttacccttaccgttacccgttaaggttttacccgggtttaaccgggccggaaccgggttaaccgtacggttccggttagggaacgttaccgtaccgggtaacccggttaaccgtagttccgggtaccggtacctaccggtaccctaccgtttgttaccccgg

SEQ ID NO: 50573 - DNA, 850 bp, Homo sapiens
  misc_feature: GYAE6OF02G878E.37.83.H06.1.454.CMB.1.raw
  modified_base (560)..(560): a, c, t, g, unknown or other
  misc_feature (560)..(560): n is a, c, g, or t
tcagtagtgtagatcacgaccggtgctcgatttagatcacgtgcgtcgcggggacaacaggcaggcagggcagcaagatggtgttgcagacccaggtcttcatttctctgttgctctggatctcgtgttacacgaggtcgccgtacgggacagtcgtagactcgaacccgtagtcctaccgagaccttccccgtggcgttcgtcgttcctcgtacgggacggtagacgggaccaacggactaccgaaacttcggaccaacggtaccgaacggtcccggtaagtttacgttttaacaacctaaacgttaccgtaaaagtaaaacgtttaaacggttacgtttccgtttaacgtaccggtttaacggtaaaccccgagtaaccgaaacggaaaacccaaccgggtaaccaacggtcccttaaaccgtaacgtcgttacgaacccgtttcggtttaaccggacgggtccttaacccgggtaaccccgggttaacggttcccccggggtaaccttaacggaaccgttccgtttacgacggggttacgcggggtacccggtttanaccggactacgtacttcaacgtcttaacgaacgtcacgtaacgcgtactacgcgtacgtcgtaggaggtacgtacggtcggtaacgttacgttacgtttactacgtagtacgttacgtaacgttaacgtttaagtaacgttaccgtaccgttaaccgtaaccggttacccggaacggtaaaccgggtaccgtaaggaaacggtaacgtaaaccggaaaacggttaacggtaacggtacgggtaataccggtaaccgtaaccgttacgtccgttaccgttacgttaacccg

SEQ ID NO: 50574 - DNA, 597 bp, Homo sapiens
  misc_feature: GYAE6OF02JILX6.37.83.H06.1.454.CMB.1.raw
  modified_base (322)..(322): a, c, t, g, unknown or other
  misc_feature (322)..(322): n is a, c, g, or t
  modified_base (436)..(436): a, c, t, g, unknown or other
  misc_feature (436)..(436): n is a, c, g, or t
  modified_base (445)..(445): a, c, t, g, unknown or other
  misc_feature (445)..(445): n is a, c, g, or t
  modified_base (456)..(457): a, c, t, g, unknown or other
  misc_feature (456)..(457): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagcgtggtcttttcttgtggctaattttaaaggtgtccagtgtgaggtgcagctgctggagtcgtgggggaggcttgggtacgacggccgggggggtccctggacgactctcctgtagacgtcctctggacttccgtacctttgaccgtaagtcgtcgccagtcgaccgttcggggtcccnccgacggcctccggaaggggaacgggcgtagggaggtcgggtactcgtagttagtggtaggtaggtaggtagagcacgagatacgcagactcggtaggacggtccggtcacctntctacaganacataccaacnncacgtctagtatgcacatacgacacgctagagacgacgaggaccacggcctaagtattagtagttgataccgtacgttcctttgtacgttagttacttactacccgttagtccgaccggtacgtccgggccgtaaccggg

SEQ ID NO: 50575 - DNA, 829 bp, Homo sapiens
  misc_feature: GYAE6OF02H8HCD.37.83.H06.1.454.CMB.1.raw
  modified_base (200)..(200): a, c, t, g, unknown or other
  misc_feature (200)..(200): n is a, c, g, or t
tcagtagtgtagatcacgaccggtgctcgatttagatcacgtgcgtcggcggggacaacaggcaggcaggggcagcaagatggtgttgcagacccaggtcttcatttctctgttgctctggatctcgtgttactacaggtgccgtacggggactagtcgtgatcgacccagtctccagtacctccgtggctgtgtctcgngggcgaggacgggccacgatacgaactcgactacgtccgacggccggtagttacgtttaacacctaactaccaaagtaacgtaagtcgtttacgtttacgcgttacggtaaccgagtaccgaaacgaaaccgacgaacctacggtaccccttaccgtaacggtccgttcggtacgttaccggtttaccgtcgggtacccttacccggtaacccggggtaacggttccccggggtacccttaggaaccgttagttaccggtaggttccgggggaccgggttcggggtaccgtaggggaacttacgggttacctttaccgaccgtttaccgtacctaacgtaccgttacgaaccggtaccgtaccgggtaccggtccgggtacggtacgttaacgggaacggttacgggttaccgggttacgggtttaacgttttaaccgtaccgtttacggtacgacgttaacgttaggtttaaccgttttacgtacccgtttaacccgttccggttaaccttagggttttaccgggttaccggaacgggtacggtaaccgacgtccggttacggacgttacgccggtaaccgtacggtacgggttcgacgtcccgtagacccgttaccggtattcccgg

SEQ ID NO: 50576 - DNA, 796 bp, Homo sapiens
  misc_feature: GYAE6OF02I8RPT.37.83.H06.1.454.CMB.1.raw
  modified_base (295)..(295): a, c, t, g, unknown or other
  misc_feature (295)..(295): n is a, c, g, or t
tcagtagtgtagatcacgaccggtgctcgatttagatcacgtgcgtcgcgggggagagaggagcccagccctgggattttcacggtgttttcatttggtgatcaggactagaacagagagaactcaccatggtagtttgggctgagtctcggtcttttttcgttagtggacttaatttttaaaagggtcgttccagtgtgtaggtgcgagtctgccgtggtagtcgtagggggacgtcgttaggacgtacgggccggggggtcctagacgacctctcctggtcgaacgtcccttntcgtaacctttccccttacggtcttagttcggattacgacgtcgtcggtccgccgacggtccgtacggacggggacgggtccgtagggtaccgggtggggtaccgaaccgaactaaagtaaacgggacgtaaagtacggttaacgggaaaggtaaacggtaaaggtaggttaacgtgggtaccggtaagttccgtaggtaccggtaagggtaccgttttaccaccgtaccgttaccgtaccgtaggaacgaaccgaacgaaccgaaacgtaaccgtaccgtagtacgtaactacgtacgtaacgtaaacgtaacgaacgtacgttacgttaacggagtaaccggacggaaccggacgttaaccggtaacgtttaaccgttacgttactccggacggacgaacgtacggtaacgggtacggttaggggttaccggtaccgttacggtaacggtaccggaccggtaccggaaccgtccgtaccgtacccgtcgtccgtacccg

SEQ ID NO: 50577 - DNA, 950 bp, Homo sapiens
  misc_feature: GYAE6OF02HQ3IF.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaacctcaccatggtagtttgggctgagccgtggtctttttcgtagtgacttaagtttaaaggtgtccgagtgtgacggttgacagctgccgtaggagttcgtaggggacggtacttgggtacacgggtccggggggtacctaggagtacctccgtaccgtggtacgtacgccgtgtaggtacttccgtaaccgtttgaactaaggttcgaacgccgtagtacggtaaccggtcggtacccggccgtacgggccctaccgggtaaggggaaccggggtctcggggttacgttacgggtaccttacggttaaggtttacgttaggttaacgggttgtacgggttaacgttacggtactaacgtaacggtaacgtttaaccggacgtaacggtttaacccgtaccggggttaaggtaaccggggggtacccgtttttaaccggaacccttaaacccggtttacccggtaaacccggttaaggtaaacccgttaaccgttaaaccgtttaaccccggaaaaccggtttaacgaccccggttaaacgtttacccggtttaaggtttaacccgtttacggaaaccctttaacccgaagttaacccgggttaaaccgaaacggttccccgtaaggtaaacggtcccgggtaaacccgggaaaccgttacccggtaacccggaccgtttaaaacttaccggttttaaacgtttaacggttacggtttacccggaacgtttttaaacccgttcgtttttaccgggtaacctttacgggttaacttaccgtacccgttaagtttacccgacgggtttaccgtaccgggacccgttaccgggg

SEQ ID NO: 50578 - DNA, 656 bp, Homo sapiens
  misc_feature: GYAE6OF02JQNXI.37.83.H06.1.454.CMB.1.raw
  modified_base (634)..(634): a, c, t, g, unknown or other
  misc_feature (634)..(634): n is a, c, g, or t
tcagtagtgtagatcacgaccggtgctcgatttagatcacgtgcgtcgcgggggacaacaggcaggcaggggcagcaagatggtgttgcagacccaggtcttcatttctctgttgctctggatctctgttactacaggtcgccgtacggggacatcgtgatcgaccagtctccagactccctggctgtcgtctcgtcggggcgaggacgggccacgactacaacgtgacgaacgtccgacggccggtagttgtttaacaacaactaccgaagtaataagtacgtttcttagtcttacggtaccagacaacgaaaccacgacacgcctacgtaagctcgtccttacgttacgtcgggtccctacggtaaccgggtacgtcccggggtacctgaacgtcgttacgaggtcgggccgggtcggtacgtcgggactagtacttacctactcctcacctagtcacgcgacgtccgtgggcggtatacggtacgtacgttcgggtacgggttcttttaacttcgcgtacagtcttagttaacgtttctacgttaccttcgtaacttacggttcgttacggaccgtaggggtaacctacggtcggtacggtaactacggtcaacggtcgtagtcgggtacnccggtacgacctcgtagttccg

SEQ ID NO: 50579 - DNA, 722 bp, Homo sapiens
  misc_feature: GYAE6OF02GEXZH.37.83.H06.1.454.CMB.1.raw
  modified_base (548)..(548): a, c, t, g, unknown or other
  misc_feature (548)..(548): n is a, c, g, or t
tcagtagtgtagatcacgaccggtgctcgatttagatcacgtgcgtcgcgggggagagaggagcccagccctgggattttcaggtgttttcatttggtgatcaggactagaacagagagaactcaccatggtagtttgggctgagctggtcttttcttgtgtcttattttaaaaggtgtccagtgtggaggtgcagctgctggagtcgtgggggagtcgttggtacgacggccggggggtcctggaagctctccgtgtacgagcctgtggtacttcctacctttagactaaggtgtcgaccatcgaccgtgggtcccctccggaggtcctccggagggggacgggcgtgggtaggtggtcgtgtacgtttatagggtacggttggttagtaagttcgacgagtacggtattaccggactaaggaccgtccggtagggtaacgggcccggtttacaccgtacgtccctacggaactacggaaacctaacgttacccgaaaacgcgtaccctactcggttagtttaccttcgactataacgtacgtaacncggtacgtacggacggtaggtccggaacggacccgtaaccgggacctaaggttacttaagtttcgtacggtacgttaaccgttaaccttttcggtttacgtaccggtttactttaagttacccgttccggttacgtaccgtacccgtacggtccggggtaaccctaacccgggg

SEQ ID NO: 50580 - DNA, 859 bp, Homo sapiens
  misc_feature: GYAE6OF02FPUYJ.37.83.H06.1.454.CMB.1.raw
  modified_base (448)..(448): a, c, t, g, unknown or other
  misc_feature (448)..(448): n is a, c, g, or t
tcagtagtgtagatcacgaccggtgctcgatttagatcacgtgcgtcgcggggacaacaggcaggcaggggcagcaagatggtgttgcagacccaggtctttcatttctctgttgctctggatctctgttactacaggtgcctacggggacatcgtgatcgaccagtctccagactccctggctgtgtctcgtgggcgaggacggtcctcactacaactgaccaacgtccacggccagtacttagtttactacgagtccttaccaaacctaataacgtaaccttacgttaagtctttaggtactacacgtacaacggtaaaccgagggaccacggtccctaacctaaacgtgtaccttacgtattttaccggagggtacctaacgttacccggtacccggggtaacggttccccggggtaccctacgggtaaccgttacgtttaccgnggtccggtaacggagggtacccgggtagtacggggaaccttacggttctttacaccgtttacctaccgtaaaccgtaccttaaccgaacggtaccggtaccctttacgggaccggtaaccgggttccgtaaaggggtacgggttaaactttccgggggttactttaacgggtttttacctttttaacggttaaaccggttcggttaacccggtaagttaaccggttacggtttttaaactttaaacgttaaccccgttttaacccgttccccggtttaacccggttacgggtttaaccccgggtaacccgggttaaacgggttaaaccgggtaacgggttaaccgtaaacggtaacgtaaaccggttaccgttaacgggtacgttaccggtaaccttacccggttaacccg

SEQ ID NO: 50581 - DNA, 616 bp, Homo sapiens
  misc_feature: GYAE6OF02JIBPX.37.83.H06.1.454.CMB.1.raw
  modified_base (170)..(170): a, c, t, g, unknown or other
  misc_feature (170)..(170): n is a, c, g, or t
  modified_base (184)..(184): a, c, t, g, unknown or other
  misc_feature (184)..(184): n is a, c, g, or t
  modified_base (197)..(197): a, c, t, g, unknown or other
  misc_feature (197)..(197): n is a, c, g, or t
  modified_base (232)..(232): a, c, t, g, unknown or other
  misc_feature (232)..(232): n is a, c, g, or t
  modified_base (240)..(240): a, c, t, g, unknown or other
  misc_feature (240)..(240): n is a, c, g, or t
  modified_base (457)..(457): a, c, t, g, unknown or other
  misc_feature (457)..(457): n is a, c, g, or t
  modified_base (483)..(483): a, c, t, g, unknown or other
  misc_feature (483)..(483): n is a, c, g, or t
  modified_base (541)..(541): a, c, t, g, unknown or other
  misc_feature (541)..(541): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctactggatctcttgttactacgaggtcgccgtaggggacacttcgtgatcgaccngtcctcagcctccngtctgtgtctcgnggcgagcggcagatcaacgtgacagtcacgcggtnttcgttanactaactacaagtaatacgtacgtttcttacggtcttacggtacacgactaaacgaaccgacacgactccgagtacgtctacgtcctttcgtacgtcggtcctaccgtaccgggtacgtcccgggtacagtacctgttcgaggtcgggcggtcggtagcggtactagtccttacgacctcgtacgtcagctacgcgtcgtccgtaggcgtgagtacngtacggttgtacgtttacgcgtgacngttacgtagttacgtactcgttactcgtgttacgttcggtacgtacggacgtaaccgnggtaccgtagtcggtatccggtaacgttaacgtcttacgggaccgtccttaaccggccggtaacttacggtttcc

SEQ ID NO: 50582 - DNA, 748 bp, Homo sapiens
  misc_feature: GYAE6OF02HKO2J.37.83.H06.1.454.CMB.1.raw
  modified_base (188)..(188): a, c, t, g, unknown or other
  misc_feature (188)..(188): n is a, c, g, or t
  modified_base (195)..(195): a, c, t, g, unknown or other
  misc_feature (195)..(195): n is a, c, g, or t
  modified_base (335)..(335): a, c, t, g, unknown or other
  misc_feature (335)..(335): n is a, c, g, or t
  modified_base (359)..(359): a, c, t, g, unknown or other
  misc_feature (359)..(359): n is a, c, g, or t
tcagtagtgtagatcacgaccggtgctcgatttagatcacgtgcgtcgcgggggagagaggagcccagccctgggattttcaggttgttttctatttggtgatcaggactagaacagagagaactcaccagtggtaggtttggctgagcgtggtcttttctgtgcttaagttttaaaggtgtcagtgngaggtgnagctgcgtggagtcgtggggagtcgtttggacgcgggccggggggttccctggacgtacttccgtcgtggtagaaccgtctcgttggtattccgtaccgtttaggaacgagttgcgaccaatcggtaccgtcgggtaccncgtaacggccgtaccggaaggggngggtaccgtgggacggttcggtcctagtttagttaagtttagggtcgggttaaggttaggtagtacgacgacgtaagtaacgttcgacgtaagtacctacggtacgggaaacggtccggttaccaacttactccgaccagaacgtaactaaacgttaaccgaccaaggactacggtaccttagttaacttcgaactacgaagtaacgaacgtacgacgttacgaacgaaccggcggtaaaccggaccgacctacgttaaactagttaaacgtttcgtttagaccggttaaaccgttaccgttttactttacggttactttaacggttctttaacccgttaccctacggtaccgtaaccccggttaggttacccggagggttaaacccgg

SEQ ID NO: 50583 - DNA, 810 bp, Homo sapiens
  misc_feature: GYAE6OF02I6H2S.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggtctttttcttgtggtctaagttttaaaaggtgtccagtgtgaggtgcagctgcgtggagtcggtggggagtcgttggacgagggcccggggggtcctggacgactctccgtgcgcagttccgtcgtggtacttcctacccgttccgtacgtttccgttttacgactagttacggacgtccgggttcggggtaccccggcccggggtaccgtacccggaagggggtaacggggttcgtaggggtacggttcgggtacctacgtacgttaccagttacgttaacgttaactacgtacggtaaaccaaacctataacgtactacgacgtaagttagtttaggtacggaacggtccctcgttacctacctaacttccgaaccgtaagtaacgtaaccttaaccgtaaccaaaccgacgtaccgtaccgtcgtttaacgttagtttaccggaactaacgttacgtaacgaaccgtaacgtccgtaacggcggtaaccggacccggtaacggaacccgttaacccgggaccttaaagttaaccgtttaagtttacgttacggttacgttaacccgtttaacgtttttcccgtttaaggtaccgttttacgtttaaccgttacccgtttaccgttacggtaacccggttacggtaccgggttacccgggg

SEQ ID NO: 50584 - DNA, 880 bp, Homo sapiens
  misc_feature: GYAE6OF02JX6TY.37.83.H06.1.454.CMB.1.raw
  modified_base (241)..(241): a, c, t, g, unknown or other
  misc_feature (241)..(241): n is a, c, g, or t
  modified_base (384)..(384): a, c, t, g, unknown or other
  misc_feature (384)..(384): n is a, c, g, or t
tcagtagtgtagatcacgaccggtgctcgatttagatcacgtgcgtcgcgggggagagaggagcccagcccgtgggattttcaggtgttttcatttggtgatcaggactgaacagagagaactcaccatggagtttggctgagctggtctttttcttgtggtctagttttaaacggtgtccagtgtgaggtgcgtagcgtgacgtcggtagtcggtaggggtcggtcgttagggaaccggngggtccccgggggggttccttaggacggtaccgtccgttccgttggtacgtaacgcccgttcgtacgggtaactttcccgtaccgttttacggaacgtaacgtcggtaccgtcctaagttcggtaacccggtcggggtacccncccgtagggtcccgtaccggaagggacgggtccgttaggggaacgttcgggtcgtacttaggttacggttaaggttcgggttagtagggtactacggtacgagtaacgtacgttagacgtacgacgttccggtagaaccggggttccgttacacccgttatttacccgacgtaacggtaacgtaaccctaacggtttaccaaccgttaagaccgtaaccgttacgttacggtttaacgtcgtaccgtaaagttaccgtaacgtaaaccgtacgtaacgttacgaacggtccggtaaaccggtaaccggtaggaaccccctaggttaaccgttaaacgtcgtttaaagttacccggtacggtaccggtttttaaaccttaccggtttttacggtacgtttaacccgggtttaaccgttacccggtttacccggtttaaaccgggttaccaacccgggggtttacggttaccccgggggacccgtttaaaccccgggg

SEQ ID NO: 50585 - DNA, 648 bp, Homo sapiens
  misc_feature: GYAE6OF02F9L72.37.83.H06.1.454.CMB.1.raw
  modified_base (449)..(449): a, c, t, g, unknown or other
  misc_feature (449)..(449): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacgaggtgccgtacggggacatcgtgatcgacccagtctccagacctcccgtggctgtgtcctcgtgggcgaggacgggcccacgactacaactgacaacgtccgagccggtagttacgtttaacacaacctaccaaagtaataagtagttactttagcgttaggtaaccagacaacgaacccacgacagccctacctaagctgtacttcgttacgcggcctaccggtacccggacgtcccgggtcctagacgtactgagtcgggcggtcgggtcgagggacagtacttcactctaccgactatcagcgacgtccgnggacgggtctagtaaggtacgtggttacggttacgtttacgttacgttgtacagtactaaggttattacgttacgtttaccgttcctacgtacgttacggtttacggaccggtaacgggtaccgaggtacgtggtaagtaaccgtccggaaccgtacggtaacgttggacggtcgtaacctccgtacgtacgttaccgg

SEQ ID NO: 50586 - DNA, 616 bp, Homo sapiens
  misc_feature: GYAE6OF02G86XK.37.83.H06.1.454.CMB.1.raw
  modified_base (424)..(424): a, c, t, g, unknown or other
  misc_feature (424)..(424): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgcctacggggacatcgtgatgacccagtctccagactccctggctgtgtctcgtagggcgagagggccacgatcaactgacaagtccagccggtagttgttttaacacgtaactccaagaataagtagttcttagcttaggtaccagacagaaccacgacacgtcctactaagctacgcttacgttactcgggtcctccgtaccgggtacgtcccggggtacctgaacgtattcgagtgggccggtcgggtcgtgggacagtactttcactcctacacatacgacncacgcgtgcggtcagaagagtggtcggttacggttttacttacgtgtcgagctagttattacgttaactcctccgtacgttacggttacggacgtaacgggaccgtaaggtacggaaactacggtaaaccgaacgttggacggttacctacggtcctaaccggttactacgttcgtttaccctcgttacccg

SEQ ID NO: 50587 - DNA, 741 bp, Homo sapiens
  misc_feature: GYAE6OF02H99S4.37.83.H06.1.454.CMB.1.raw
tcagtagtgtagatcacgaccggtgctcgatttagatcacgtgcgtcgcggggacaacaggcaggcaggggcagcaagatggtgttgcagaccccaggtcttcatttctctgttgctctggatctcttgttacctacaggtgcctacggggacatcgtgatcgacccagtcctccagtacctccctggctgtcgtcttcgtgggcgaggcgggaccctagactacaacgtgacaacgtccacggccggttagttcgttttacacctaactaccgaagtaaattaagtagttttacttaagcgtttacggaactagacaacgtaaaccacgtacacgtaccctactaacgctcgtaccttccgttacgtcggtacctccgtaaccccgggtacgttcccggtacccgtaagtaaccgatttccgaggtccgggcggtaccggtcggtacgggtacctgttaacctttccgccttccctacgtaacccaagtaccacggtcccgtaaaccggtccgtacgggtaccgggtacgtacggtaaacggtagttcgggttaaccggtttacggttttacgttacgttcgtacgtacgtacgtaacgtttagttaaccgttcgttacccttacccgtcgtaaccgtttggtttacggaccggtaacggacctacggtacgtgggtactaccggtcgtacgtaaccgttcgtacggttccgtaccgtcgtacccctacgtcgttacccg

SEQ ID NO: 50588 - DNA, 937 bp, Homo sapiens
  misc_feature: GYAE6OF02GHJ8J.37.83.H06.1.454.CMB.1.raw
tcagtagtgtagatcacgaccggtgctcgatttagatcacgtgcgtcggcgggggagagaggagcccagccctgggattttcaggtgttttcatttggtgatcaggactgaacagagagaactcaccatggaggtttgggctgagcgtggtctttttctgtggcttaagttttaaaggtgtccagtgtgaggtgcagtctgctgggagttcggtgggggagtcgttgggtaccgacgggccgggggggttcccctaggacgtaccgttcctaccgtgttaggaacgtcctcgtaggtacttcgtaccgtttgaacgtaaggtgtcgtaccgtagttaccgaccggttcggggcccgtaccggtacggtcccgtacccggggaaagggggtaaccggggtcgtcgggtaacgggttacggggtaccttcggttaaaggtttacggttaaggttcgggttaagggttacggggtttaagaccggtacgtaacgtaacggggtaacttaccggacgtaaccggtaccgttccggggtaaacggggtaccgggtaccccggtttaccgaacccggtaccgttaaccggttacccgaaaggttaaccgtaaaccgttaaaccgttaacccgtaaaccgggtaccggacccgtttaaacggtcgtttacggggtttacctttccggaaacctaacgggtttaacaaccgggtaaacccgaccgggttaccgaacgggttaacggtaacccgggtacccggggaaaccgttccccgaaaccgggttccccttaacgttttaacgtacccgggttagggttaacggtaccgggttaaaggacggttaacccggttacggaaacggggttaccggttaaaacgttccggaaacggttacccgaagggtaacctttaacccgggtacttacccggttaaacccgggg

SEQ ID NO: 50589 - DNA, 770 bp, Homo sapiens
  misc_feature: GYAE6OF02HXKL1.37.83.H06.1.454.CMB.1.raw
  modified_base (206)..(206): a, c, t, g, unknown or other
  misc_feature (206)..(206): n is a, c, g, or t
  modified_base (609)..(609): a, c, t, g, unknown or other
  misc_feature (609)..(609): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccagtggagtttgggctgagcgtggtctttttcttgtggtcttaattttaaaaggtgtccagtgtgaggtgcagctgctggngtcggtgggggagtcgttggtacgacgggtcccgggggggtccctaggagtcctcctaccgtgtagaccgtcctcgtaggtacgttcctaccgtttagaactagtcgtacgcctagtcgaccggttcgggtcccgcccgtacggtccgtacccgggaagggggtaacggggtcgttaggggtacggttcgggtccgtttacgttaggttttaaggtttagggttagggttaggttacgggttagtacggacaacgtaacgtaagttaccgacgacggaccgttaccgggtagggaccgggtcccgtaccacccgtactccgacgaacggacgtaacctaaaccttaccgaaacgaccgccgtacgtcgttacgtttacgttcgaacctacgtactagaaaccncggtaccctagggaacggtaccggaccgaaggaccgaccgtactattagttaatttacgtacggtacgtaaccgtttaaccgtttcgtttacgtacggtttacgttactttacccgtccgttactaccggtaaccgtacgggtccgggaaccgttacccgg

SEQ ID NO: 50590 - DNA, 756 bp, Homo sapiens
  misc_feature: GYAE6OF02JM2CO.37.83.H06.1.454.CMB.1.raw
  modified_base (196)..(196): a, c, t, g, unknown or other
  misc_feature (196)..(196): n is a, c, g, or t
  modified_base (204)..(204): a, c, t, g, unknown or other
  misc_feature (204)..(204): n is a, c, g, or t
  modified_base (453)..(453): a, c, t, g, unknown or other
  misc_feature (453)..(453): n is a, c, g, or t
  modified_base (565)..(565): a, c, t, g, unknown or other
  misc_feature (565)..(565): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggaggtttgggctggagcgtggtcttttcttggtgctaattttaaaggtctccagtgtgaggtgcagntgcgtggngtcggtgggggagtcgttggtacgacgggccgggggggttccctggacggtccttccgtccgtaggttcggaaccgtccgtcggtacggtacttcctaccgttttaggaaacctaaggttgttcgaccgtaagttcggacccgttcggggcccgtccggaccgtcgtacccgggagggggtaacgggcctaggggtaggttcgggtcctagttaacgttggttaagggtggttaggtaggtagtacganaacgagtaagtcgatacggtacgtcggtaggaccgggtaccttacggacctagtccacgagaacgtactaaccgtaccaacgataccgtacgtaccttagttagttacgacncttaacacgaaccgtactaccggtagacgtcggaccgaacggtcgaaccggtacctgtaattacgttggtacgtacgtaaccggttttaaccctttcggtactttcggttaaccggtttattaaccccgggttaccgttaaccgtccgggttaacctaccggggttacccggggtcccgttaaacccgggg

SEQ ID NO: 50591 - DNA, 672 bp, Homo sapiens
  misc_feature: GYAE6OF02JPO1V.37.83.H06.1.454.CMB.1.raw
  modified_base (242)..(242): a, c, t, g, unknown or other
  misc_feature (242)..(242): n is a, c, g, or t
  modified_base (252)..(252): a, c, t, g, unknown or other
  misc_feature (252)..(252): n is a, c, g, or t
  modified_base (487)..(487): a, c, t, g, unknown or other
  misc_feature (487)..(487): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctctgttactacaggtgccgtacggggacatcgtgatgacccagtctccagactccgtggctgtcgtctcgtcgggcgaggacggccacgatacaactgcagtcgagcggtagtgtttanacactacaanaatacgtattcttacgcgttgtactagacaacgaaccacgacacgtacctacctaacgtctcgactttacgtttaccgtcggtacccttccggtaacccgggacggttcccggggtaccctacggtaaccgtacgttacgtacgggtcgggaccgggtccgggtcggtacgggaactaacgtcttaccgtaacctccgtaccactagtaccgacgctaacgcccgtggccggtanaggtaacgtcgtagggttcggttaacgttttacgtacgtacggtctaaggtcttaaaggttcttacgtcgttactccgtacgttacgttcgggttacgacggtacgggtaccacggttcgtacggtacgtcgacggtaaccgtacggtacgttcggtcggtacgttaccgacctcgtacgttccg

SEQ ID NO: 50592 - DNA, 668 bp, Homo sapiens
  misc_feature: GYAE6OF02IIQAV.37.83.H06.1.454.CMB.1.raw
  modified_base (307)..(307): a, c, t, g, unknown or other
  misc_feature (307)..(307): n is a, c, g, or t
  modified_base (477)..(477): a, c, t, g, unknown or other
  misc_feature (477)..(477): n is a, c, g, or t
  modified_base (488)..(488): a, c, t, g, unknown or other
  misc_feature (488)..(488): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttgggctgagctggtctttttcttgtggcttaattttaaaaggtgtccagttgtgaggtgcagctgctggagtcggtgggggaggtcgttggtacgacgggccgggggggtccctggacgtacctctccgtgtacgaacgtcctcgtggtacttcctacctttgacaagtggtnaccatgacctgggtcccgcctaggcctccgagggggacgggcgtgggaggtgggtctgtagtttataggtggtagtggtagagcacgagtatacgacagtaccgtcggtggaacgggtccggttacaaccgtatccgtaccaaggacgtaacctaaagttacccaaacgngaccaccggtnttacggttattcgaactacgaagttacgaaactcgacctaggacggaacgccggtaaggaacccgacggacctaaagttacttaacgttattacggtacgacttaaacgttttcctttaggactttcggtttaataccgttcccgtaagtccgaccgtacggttccgggactaacccggg

SEQ ID NO: 50593 - DNA, 769 bp, Homo sapiens
  misc_feature: GYAE6OF02FYG1S.37.83.H06.1.454.CMB.1.raw
  modified_base (271)..(271): a, c, t, g, unknown or other
  misc_feature (271)..(271): n is a, c, g, or t
  modified_base (606)..(606): a, c, t, g, unknown or other
  misc_feature (606)..(606): n is a, c, g, or t
  modified_base (659)..(659): a, c, t, g, unknown or other
  misc_feature (659)..(659): n is a, c, g, or t
  modified_base (697)..(697): a, c, t, g, unknown or other
  misc_feature (697)..(697): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggagtttggctgagctggtctttttcttgtggcttaattttaaaggtgtcagtgtgacggtgcagctgcgtggtagtcgtgggggagcgttggtacgacgggtccggggggtccctggacgtactctccgtgtgaacgtcctntcggtattcctaccgtttacgactaacggtgtcgcctatacggtacccgtcggggtaccccgccgtacgggtcccgttacccggaacgggggaacggggtccggttagggagggttcggggtccttacggtaggtttaagttagggttaggttaggttacggttaacgtacccgtacgtaacgttaaccgtacggtacaacgtcccgtaccccgggtacgggacccgggggttcccggtttaacccgaccccggtttactacccgggaagaaaccgtaacgttaaacctttcccgaaaaggttaaccgttaacgggtcttaagtccgaaggtaanacggaacttcgacgtgagacgccggaagacccgtaccgcccgttatacgttcnggtacgagtacgacgtagtacgacggtacgaaggtttnaaccgacgtacgacgacgttacccgttagaaccgttacccggtacggggtaccccgggaccctaaccccggg

SEQ ID NO: 50594 - DNA, 616 bp, Homo sapiens
  misc_feature: GYAE6OF02GMOOC.37.83.H06.1.454.CMB.1.raw
  modified_base (140)..(140): a, c, t, g, unknown or other
  misc_feature (140)..(140): n is a, c, g, or t
  modified_base (248)..(248): a, c, t, g, unknown or other
  misc_feature (248)..(248): n is a, c, g, or t
  modified_base (470)..(470): a, c, t, g, unknown or other
  misc_feature (470)..(470): n is a, c, g, or t
  modified_base (482)..(482): a, c, t, g, unknown or other
  misc_feature (482)..(482): n is a, c, g, or t
  modified_base (566)..(566): a, c, t, g, unknown or other
  misc_feature (566)..(566): n is a, c, g, or t
  modified_base (576)..(576): a, c, t, g, unknown or other
  misc_feature (576)..(576): n is a, c, g, or t
  modified_base (599)..(599): a, c, t, g, unknown or other
  misc_feature (599)..(599): n is a, c, g, or t
  modified_base (610)..(610): a, c, t, g, unknown or other
  misc_feature (610)..(610): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctggatctcctgttactacaggtnacctacgggacatcgtgatgacccagtctaccagactccctggctgtgtctcgtgggcgagacgggcctacgatcaactgacaagtccaggccggtagttgttttaanactaactccaaagtaataagtagttactttagcgttaggtaaccagaccaagaaacccacgaccaagcccttacctaagtcctacggtcttaccggttttacgtccgggacccttaccgtacccgggtaaacgttccccgggggtaccctacggaaaccgttacttcgagtcgggccgggtccgggtacggtcgggactagtactttcgacctctccaacgntccagcactcgnggcggcgtagagagtggttaggtcgttttatccgttgccgtagtctaggttacttagtacgttctcctagtacttgttcgacgngtacacgtgnggtacatcgacacgtctgtacgntcggacctacncttacg

SEQ ID NO: 50595 - DNA, 826 bp, Homo sapiens
  misc_feature: GYAE6OF02G9RXU.37.83.H06.1.454.CMB.1.raw
tcagtagtgtagatcacgaccggtgctcgatttagatcacgtgcgtcgcgggggagagaggagcccagccctgggattttcaggtgttttcatttggtgatcaggactgaacagagagaactcaccatggtagtttggctgagcgtggtcttttctgtgcttaagtttaaaggtgtccgagtgtgaggtgcagcgtgcgtggagtcggtggggagtcgttacgggtacgacggggtcccggggggttaccctaggacgtaccgtccgttccgtaggtacgaaccgtccgttcgtacggttacttaccgttaccgttttacggaaaccgtaacggttcggtaaccgtaccgtagttaccgggtaccccggttccggggtaccccgtacccggaacgggtccccgtaacccggggaacggggggaaccgggttccggtaaggggttacgggttcgggtttacccgttacgttaaggtttaacgttttacgggtaagggttacggttacgggttaacgtacgtaaccgaacgttaacggtaccggtttaacgaccgttacggtaccggtaccgggtacgggaaccgggtttccccgtaacaacccgtctaaccgaccgtaggtaacgtaaacccgtacgttaacccgacgtaaccggtacaccgttcgttagttaccttggaaacctacgtctaacgaacgtacgcggtaagcgacggtacccgagaccgacgtactagtatacttgtcgtacttaccgttaatttcggttacgttagttcgttaacttcccgtaacgtaccggcacccgtgggaccgtaccgtccggg

SEQ ID NO: 50596 - DNA, 684 bp, Homo sapiens
  misc_feature: GYAE6OF02JW3FL.37.83.H06.1.454.CMB.1.raw
  modified_base (558)..(558): a, c, t, g, unknown or other
  misc_feature (558)..(558): n is a, c, g, or t
tcagtagtgtagatcacgaccggtgctcgatttagatcacgtgcgtcgcgggggagagaggagcccagccctgggattttcaggtgttttcatttggtgatcaggactgaacagagagaactcaccatggtagtttgggctgagcgtgtcttttcttgtggtcttattttaaaggtgtctagtgtgaggtggaggtgttggagtcgtggggagtcgttggtcggccgtgggggtcctgagactctcctgtgcacgtcctacgtagtaactaacttcttagacaaactcgaccagttcgacttcgtcggtccctaccgtggtaccgtaccggaggggtaacgggcgtacgggtacggtcgggtcctacgacgtaccgtaggtttccggacgtacggttcggggtgggtcgaccgaacgttccgaactaccgacacggtaaccctcgggtaaggtaacccggggtccgttaccgtacccgtaccgtaccgaggtaactacgtaaaccgttcgaaaacggtacctacttacgtatactccgaataacgtaactaacgacgntcttagacgcgaccgagacgtacgactattaacgttacttagcgtacgaaccgtaacccggaccgtacggtacaacgtcctaattccggatttccgttagaccttggccggaacgtaggccctacg

SEQ ID NO: 50597 - DNA, 677 bp, Homo sapiens
  misc_feature: GYAE6OF02F80GT.37.83.H06.1.454.CMB.1.raw
  modified_base (360)..(360): a, c, t, g, unknown or other
  misc_feature (360)..(360): n is a, c, g, or t
  modified_base (491)..(491): a, c, t, g, unknown or other
  misc_feature (491)..(491): n is a, c, g, or t
  modified_base (657)..(657): a, c, t, g, unknown or other
  misc_feature (657)..(657): n is a, c, g, or t
  modified_base (664)..(664): a, c, t, g, unknown or other
  misc_feature (664)..(664): n is a, c, g, or t
tcagtagtgtagatcacgaccggtgctcgatttagatcacgtgcgtcggcggggacaacaggcaggcaggggcagcaagatggtgttagcagacccaggtcttcatttctctgttgctctggatctctgttactacgaggtgccgtacggggacaccggtgatgacccagtcctcgacgactccctggctgtacgtctgtgggcgacgacggcctcatacactgacgtactaccgagtccagtacgtttagtttaataccagacctaccaaacgtaactaagtaactacttaacgtcgttaggtatacacgtcgaagaaccgaggccagtcctaacctacgcgtctactacgtttaacgnggtactacgtccggtaccgggtacggtacccgggttccgtaacggtacccgttagtacccgaggttacggccggtacggtaccggggtcctaggggtaccaagttacgtttacctacgttccacctaaccncgtaaccaccacgttcccgatccgacgcgtggagtctaggtccgtagtactttagggtactcgactagtacgtagttaacgttaagttaactcccgtagttccggtccgtaacgtaccgaacgggtccggtaaggtaacccgaaagttaccgaacgtacgttacgnggtaccngtaccgcgtaacg

SEQ ID NO: 50598 - DNA, 765 bp, Homo sapiens
  misc_feature: GYAE6OF02I763R.37.83.H06.1.454.CMB.1.raw
  modified_base (125)..(125): a, c, t, g, unknown or other
  misc_feature (125)..(125): n is a, c, g, or t
  modified_base (159)..(159): a, c, t, g, unknown or other
  misc_feature (159)..(159): n is a, c, g, or t
  modified_base (717)..(717): a, c, t, g, unknown or other
  misc_feature (717)..(717): n is a, c, g, or t
  modified_base (746)..(746): a, c, t, g, unknown or other
  misc_feature (746)..(746): n is a, c, g, or t
tcagtagtgtagatcacgaccggtgctcgatttagatcacgtgcgtcgcggggacaacaggcaggcaggggcagcaagatggtgttgcagacccaggtcttcatttctctgttgctctgatcctntgttactacaggtcgccgtacggggacatccgtnacgtcgacccagtcctaccagtacctccctggcttagttcgttctcgtgggacgtaggacgggccacgtactacacgtcgacacggtccacgcgtagttgtttaccactacacgaagaattaagtagtttctttaagtcgtttaccggtaccacgactaaacgaacctaacgaccaccgtccgttaccgtaagtctccggtacctttacggtttaccgtccgggttaccctacccggtaacccggttaccgtccccggggtaccctacggaaccgtacgttccgtagggtccgggtccgggtcgggtacgggtacgggtacgtacggttactttccaccttccgttaccgtacctacgtacgtaccgacgtaaccggccggttcgggaccggttacgtaggaacgtacggttcgggttaggtttcgtttaacttcgtacgtagtacggttacgttaacgttttagttactttaccgttaccttaacccgttaccgttaacttttacgggtttcggaaccgggaggttaccgaggtcgttacgggaacttccggtaccnccggtaaccgttagtccggtacggttacncgtacctaccgtgttaccg

SEQ ID NO: 50599 - DNA, 318 bp, Homo sapiens
  misc_feature: GYAE6OF01B4XRQ.21.38.D05.1.454.CMB.1.raw
  modified_base (314)..(318): a, c, t, g, unknown or other
  misc_feature (314)..(318): n is a, c, g, or t
tcagtcgtcgctcgcacgaccggtgctcgatttagtatctgatagttgggtttgggatctatgggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttcccgcatctgactcgtctctactgagcgggctggcaaggcgcatagnnnnn

SEQ ID NO: 50600 - DNA, 318 bp, Homo sapiens
  misc_feature: GYAE6OF01C7S4M.21.38.D05.1.454.CMB.1.raw
  modified_base (314)..(318): a, c, t, g, unknown or other
  misc_feature (314)..(318): n is a, c, g, or t
tcagtcgtcgctcgcacgaccggtgctcgatttagtatctgatagttgggtttgggatctatgggcatcctacaggatgaccggcatcccagacaggttcagtgccagtgggtctgggacagacttcactctcaccatcaacacactggcgcctgaagattttgcagtgtattactgtcagcaatatgctcacccccgatcaccttcggccaagggacacgactgcagatgaaacgaactgtggctgcaccatctgtcttcatcttcccgccatctgactcgtctctactgagcgggctggcaaggcgcatagnnnnn

SEQ ID NO: 50601 - DNA, 328 bp, Homo sapiens
  misc_feature: GYAE6OF01B4QNP.21.38.D05.1.454.CMB.1.raw
  modified_base (316)..(328): a, c, t, g, unknown or other
  misc_feature (316)..(328): n is a, c, g, or t
tcagtcgtcgctcgcacgaccggtgctcgatttagtatctgatagttgggtttgggatctatcgggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttcccgccatctgactcgtctctactgagcgggctggcaaggcgcatagnnnnnnnnnnnnn

SEQ ID NO: 50602 - DNA, 319 bp, Homo sapiens
  misc_feature: GYAE6OF01BBQ3C.21.38.D05.1.454.CMB.1.raw
  modified_base (316)..(319): a, c, t, g, unknown or other
  misc_feature (316)..(319): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttcccgccatctgactcgtctctactgagcgggctggcaaggcgcatagnnnn

SEQ ID NO: 50603 - DNA, 319 bp, Homo sapiens
  misc_feature: GYAE6OF01EN3JE.21.38.D05.1.454.CMB.1.raw
  modified_base (315)..(319): a, c, t, g, unknown or other
  misc_feature (315)..(319): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttcccgcatctgactcgtctctactgagcgggctggcaaggcgcatagnnnnn

SEQ ID NO: 50604 - DNA, 324 bp, Homo sapiens
  misc_feature: GYAE6OF01D8GS3.21.38.D05.1.454.CMB.1.raw
  modified_base (316)..(324): a, c, t, g, unknown or other
  misc_feature (316)..(324): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgtaactgtggctgcaccatctgtcttcatcttcccgccattgactcgtctctactgagcgggctggcaaggcgcatagnnnnnnnnn

SEQ ID NO: 50605 - DNA, 318 bp, Homo sapiens
  misc_feature: GYAE6OF01DT2BM.21.38.D05.1.454.CMB.1.raw
  modified_base (314)..(318): a, c, t, g, unknown or other
  misc_feature (314)..(318): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccagggaccaaggtggagatcagacgaactgtggctgcaccatctgtcttcatcttcccgccatctgactcgtctctactgagcggctggcaaggcgcatagnnnnn

SEQ ID NO: 50606 - DNA, 319 bp, Homo sapiens; identical to SEQ ID NO: 50602
  misc_feature: GYAE6OF01AMKBY.21.38.D05.1.454.CMB.1.raw
  modified_base (316)..(319): a, c, t, g, unknown or other
  misc_feature (316)..(319): n is a, c, g, or t

SEQ ID NO: 50607 - DNA, 320 bp, Homo sapiens
  misc_feature: GYAE6OF01D1M1C.21.38.D05.1.454.CMB.1.raw
  modified_base (316)..(320): a, c, t, g, unknown or other
  misc_feature (316)..(320): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttcccgccatctgactcgtctctactgagcgggctggcaaggcgcatagnnnnn

SEQ ID NO: 50608 - DNA, 315 bp, Homo sapiens
  misc_feature: GYAE6OF01EGLFB.21.38.D05.1.454.CMB.1.raw
  modified_base (305)..(305): a, c, t, g, unknown or other
  misc_feature (305)..(305): n is a, c, g, or t
  modified_base (311)..(315): a, c, t, g, unknown or other
  misc_feature (311)..(315): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgcttcatcttccgccattgactcgtctctactgagcggctgcaaggcncatagnnnnn

SEQ ID NO: 50609 - DNA, 503 bp, Homo sapiens
  misc_feature: GYAE6OF01DFKM2.21.38.D05.1.454.CMB.1.raw
  modified_base (215)..(215): a, c, t, g, unknown or other
  misc_feature (215)..(215): n is a, c, g, or t
  modified_base (395)..(395): a, c, t, g, unknown or other
  misc_feature (395)..(395): n is a, c, g, or t
  modified_base (404)..(404): a, c, t, g, unknown or other
  misc_feature (404)..(404): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaanagttactctctcctgcaaggccagtcagagtgttggcatcgacgttgcctggtaccaacaaaacctgccaggctccagtctcctcatctagtggggcatcctacaggatcgaccggcatccagacaggttcagtgccagtggtctgggacagcttcactctcaccatcaacacacgtgcncctgaagtntttgcagttgtattactgtcagtatgtagtggtagtcacgtctacgtttcgcgtagggaccagggtggagatcgagaacgacgtgtggctgctcgtacg

SEQ ID NO: 50610 - DNA, 319 bp, Homo sapiens
  misc_feature: GYAE6OF01C86EY.21.38.D05.1.454.CMB.1.raw
  modified_base (315)..(319): a, c, t, g, unknown or other
  misc_feature (315)..(319): n is a, c, g, or t
tcagtcgtcgctcgcacgaccggtgctcgatttagtatctgatagttgggtttgggatctatggggcatcctacaggatgaccggcatcccagacaggttcagtgtcagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttcccgccatctgactcgtctctactgagcggctggcaaggcgcatagnnnnn

SEQ ID NO: 50611 - DNA, 510 bp, Homo sapiens
  misc_feature: GYAE6OF01B2SBW.21.38.D05.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaanagttactctctcctgcaaggccagtcagagtgttggcatcgacgttgcctggtaccaacaaaacctggccaggctcccagtctcctcatctatggggcatcctacaggatgaccggcatcccagacaggttcagtgccagtgggtctgggacagacttcactctcaccatcaacacactggcgcctgaagtattttgctagtgtattactgtcagattgtatggtaggtctaccgtactaccgttggcctaggggaccaagggtcggagatcgagacgaactgtggatgcactac

SEQ ID NO: 50612 - DNA, 324 bp, Homo sapiens
  misc_feature: GYAE6OF01ASA8I.21.38.D05.1.454.CMB.1.raw
  modified_base (309)..(309): a, c, t, g, unknown or other
  misc_feature (309)..(309): n is a, c, g, or t
  modified_base (315)..(324): a, c, t, g, unknown or other
  misc_feature (315)..(324): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttcccgcatctgactcgtctctactgagcgggctggcaaggcncatagnnnnnnnnnn

SEQ ID NO: 50613 - DNA, 318 bp, Homo sapiens
  misc_feature: GYAE6OF01DMPIK.21.38.D05.1.454.CMB.1.raw
  modified_base (314)..(318): a, c, t, g, unknown or other
  misc_feature (314)..(318): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttccgccatctgactcgtctctactgagcggctggcaaggcgcatagnnnnn

SEQ ID NO: 50614 - DNA, 509 bp, Homo sapiens
  misc_feature: GYAE6OF01DLTZL.21.38.D05.1.454.CMB.1.raw
  modified_base (215)..(215): a, c, t, g, unknown or other
  misc_feature (215)..(215): n is a, c, g, or t
  modified_base (504)..(504): a, c, t, g, unknown or other
  misc_feature (504)..(504): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggctcccagtctcctcatctatgggcatcctacaggatgaccggcatcccagacaggttcagtgccaggtggtctgggacagacttcactctcaccatcaacacactggcgcctgaatattttgctagttgtattactgtcagtatgtagtggtagtcaccgtacacctttggccaggggaccaagggtggagatcgagacgaacgtcggtaggctgcnctacg

SEQ ID NO: 50615 - DNA, 321 bp, Homo sapiens
  misc_feature: GYAE6OF01C0MT7.21.38.D05.1.454.CMB.1.raw
  modified_base (315)..(321): a, c, t, g, unknown or other
  misc_feature (315)..(321): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccagggaccaaggtggagatcagacgaactgtggctgcaccatctgtcttcatcttcccgcatctgactcgtctctactgagcgggctggcaaggcgcagtagnnnnnnn

SEQ ID NO: 50616 - DNA, 529 bp, Homo sapiens
  misc_feature: GYAE6OF01BD8WB.21.38.D05.1.454.CMB.1.raw
  modified_base (215)..(215): a, c, t, g, unknown or other
  misc_feature (215)..(215): n is a, c, g, or t
  modified_base (398)..(398): a, c, t, g, unknown or other
  misc_feature (398)..(398): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaaacctggccaggctcccagtctcctcatctatggggcatcctacaggatgaccggcactcccagacaggttcagtgccagtggtctgggacagacttcactctcaccatcaacacactggcncctagaagtattttgctagtgtattactgtcagattgtatggtagtcaccgtactaccgtttggaccgaggggtacccaagggtcggaagagttcgaaggacgaaacgtggtacggactcggcaaccgtag

SEQ ID NO: 50617 - DNA, 320 bp, Homo sapiens; identical to SEQ ID NO: 50607
  misc_feature: GYAE6OF01EYTGX.21.38.D05.1.454.CMB.1.raw
  modified_base (316)..(320): a, c, t, g, unknown or other
  misc_feature (316)..(320): n is a, c, g, or t

SEQ ID NO: 50618 - DNA, 328 bp, Homo sapiens
  misc_feature: GYAE6OF01DDD0O.21.38.D05.1.454.CMB.1.raw
  modified_base (242)..(242): a, c, t, g, unknown or other
  misc_feature (242)..(242): n is a, c, g, or t
  modified_base (314)..(328): a, c, t, g, unknown or other
  misc_feature (314)..(328): n is a, c, g, or t
tcagtcgtcgctcgcacgaccggtgctcgatttagtatctgatagttgggtttgggatctatgggcatcctacaggatgaccggcatcccagacaggttcagtgccagtggtctgggacagacttcactctcaccatcaacacactggcgcctgaagattttgcagtgtattactgtcagcagtatggaagttcacctctgtcgttcggccaagggaccaaggtagaaatgaaacgaactgnggctgcaccatctgtcttcatcttcccgcatctgactcgtctctactgagcgggctgggcaaggcgcatagnnnnnnnnnnnnnnn

SEQ ID NO: 50619 - DNA, 318 bp, Homo sapiens
  misc_feature: GYAE6OF01CKYL3.21.38.D05.1.454.CMB.1.raw
  modified_base (314)..(318): a, c, t, g, unknown or other
  misc_feature (314)..(318): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtctcatcttccgccatctgactcgtctctactgagcgggctggcaaggcgcatagnnnnn

SEQ ID NO: 50620 - DNA, 804 bp, Homo sapiens
  misc_feature: GYAE6OF01AORHP.21.38.D05.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcacgtcgtacgttcgccgtacggtaaccaaaacctaaaaccgtcggaccgacggtccctacccgtacgttcccttccctactacttaccgttagggtcggggacctaccttaccctaacggacggtagtaccgggacccggactacccgtacccgaagtaaccggttacggttacaggtccgaccgtagggttcggttcggtacgggacgaacgttaccttacctaccttcctaccaacctactaaccaacctacctacggtcggcccgtaccgtaaggtaacgtttacgttttcgacgttaggtttacgtttaacgtttacgttcggttaacgtaaggttaacgtttaggttaacgggtttacggggttaaccggttacccgttaacccggttaacccgtttacccgggtttccgggaacccggggttaaaccgggggtaaacccggttaacggggggttcgggaaacggttacgtaaccgggtaaacgggtaaaacccggttaacggttcggggtaccggtaccggtaccggtaacccctaaccggttaccg

SEQ ID NO: 50621 - DNA, 502 bp, Homo sapiens
  misc_feature: GYAE6OF01B7VC3.21.38.D05.1.454.CMB.1.raw
  modified_base (215)..(215): a, c, t, g, unknown or other
  misc_feature (215)..(215): n is a, c, g, or t
  modified_base (494)..(494): a, c, t, g, unknown or other
  misc_feature (494)..(494): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaaacctggccaggctcccagtctcctcatctatggggcatcctacaggatgaccggcatccagacaggttcagtgccagtggtctgggacagacttcactctcacatcaacacactggcgcctagaagtattttgctagtgtattactgtcagtatgtatggtagtcacgtacaccttggccgtagggaccaaggtggagatcgagacgacgtgtcggntgcactac

SEQ ID NO: 50622 - DNA, 326 bp, Homo sapiens
  misc_feature: GYAE6OF01B0PO1.21.38.D05.1.454.CMB.1.raw
  modified_base (312)..(312): a, c, t, g, unknown or other
  misc_feature (312)..(312): n is a, c, g, or t
  modified_base (317)..(326): a, c, t, g, unknown or other
  misc_feature (317)..(326): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgccaccatctgtcttcatcttcccgccatctgacctcgtctctactgacgcggctggcaaggcncatgnnnnnnnnnn

SEQ ID NO: 50623 - DNA, 507 bp, Homo sapiens
  misc_feature: GYAE6OF01CCWFZ.21.38.D05.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggctcccagtctcctcatctatggggcatcctacaggatgaccggcatcccagacaggttcagtgccagtggtctgggacagacttcactctcaccatcaacacactggcgcctgaacgtattttgctagtgtattactgtcagatgtattggtagtcacgtacacctttggcctaggggaccaagggtggagagtcagacgaacgtgtagctgcaccgtag

SEQ ID NO: 50624 - DNA, 505 bp, Homo sapiens
  misc_feature: GYAE6OF01BZFWH.21.38.D05.1.454.CMB.1.raw
  modified_base (215)..(215): a, c, t, g, unknown or other
  misc_feature (215)..(215): n is a, c, g, or t
  modified_base (502)..(502): a, c, t, g, unknown or other
  misc_feature (502)..(502): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcttcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggctcccagtctcctcatctatggggcatcctacaggatgaccggcatcccagacaggttcagtgccagtggtctgggacagacttcactctcaccatcaacacactggcgcctgaagtattttgctagtgttattactgtcagtatgtatggtagtcaccgtacaccgtttggccgaggggaccaagggtggagatcagacgaatggtggactgcncta

SEQ ID NO: 50625 - DNA, 499 bp, Homo sapiens
  misc_feature: GYAE6OF01DHVL3.21.38.D05.1.454.CMB.1.raw
  modified_base (215)..(215): a, c, t, g, unknown or other
  misc_feature (215)..(215): n is a, c, g, or t
  modified_base (403)..(403): a, c, t, g, unknown or other
  misc_feature (403)..(403): n is a, c, g, or t
  modified_base (450)..(450): a, c, t, g, unknown or other
  misc_feature (450)..(450): n is a, c, g, or t
  modified_base (478)..(478): a, c, t, g, unknown or other
  misc_feature (478)..(478): n is a, c, g, or t
  modified_base (490)..(490): a, c, t, g, unknown or other
  misc_feature (490)..(490): n is a, c, g, or t
  modified_base (496)..(496): a, c, t, g, unknown or other
  misc_feature (496)..(496): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaanagttactctctcctgcaaggccagtcagagtgttggcatcgacgttgcctggtaccaacaaaacctggccaggctccagtctcctcatctagtgggcatcctacaggatgaccggcatccagacaggttcagtgcagtggtctgggacagtacttcactctcaccatacaacacactgcgcctgaatntttgctagtgttattactgtcagtatgtatggtacgtctaccgtacnccgtttggaccaggggaccagggtgagntcgagacgatgngctgcnctg

SEQ ID NO: 50626 - DNA, 711 bp, Homo sapiens
  misc_feature: GYAE6OF01BV47T.21.38.D05.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctctgctactctggctcccaggtgtcaccggagaagttgtcttgacgcagtctccaggccacctgtctctgtctccgaaggggaaangttactctctcctgcaaggccagtcagagtgttgcatcgacgttgcctggtaaccaacaaaacctggaccaggctccgagtcctcctactatctagtcgggactacgtcctacgaggatcgaccggcacgtcccaagactaggttcagtcgacgtaggtggtctagggacagtactcacgtctcgaacctataccaacacctacgtcggtacaccgttagaacgttattttacggacgtaggttacgttaactttacgtacgttacgtaaggttaacgtttacggttaaacggtttacggggttaaacccggttaccgttaaaccccgggttaacccgtttaacccgggttttacgggggaaccccggttaaacggggggtaaaccccgtaaagggggttacggtaaacgggtaacggttaccgaaacgggtaaacccggttaaacggttacgggttacgggtaccgtaccggtacccgtaaacccgtttaacgg

SEQ ID NO: 50627 - DNA, 746 bp, Homo sapiens
  misc_feature: GYAE6OF01DD9G6.21.38.D05.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaanagttactctctcctgcaaggccagtcagagtgttggcatcgacgttgcctaggtaccaacaaaacctggccaggcctcccagtcctcctcatctagtggggcatcctacaggatcgaccggtcatccagactaggttacaggttcgaccgaggttcggggtctacggggactacggtactttccgaaccttcctaccaaccctactaccaaacctaccgtaccgttacggaccgtaccctagggtaacgttagtttttacgacgtaagtttacgtttaacgtttaacgttacggttcgtaaaggttacgtttacggttaagggtttcggggttaaccgggttacccgttaaaccccggtttaccgttaaccccggtttttacggggaaccccgggtaaaccggggggggtaaaccctaaacggggggttacgggtaaaggttaacggttaccgggtaaaacgggtaacccggttaaaaccgggttcgggtaaacgggtccggttaacggacccgtaaacccgttaaccgg

SEQ ID NO: 50628 - DNA, 551 bp, Homo sapiens
  misc_feature: GYAE6OF01AG3A8.21.38.D05.1.454.CMB.1.raw
  modified_base (215)..(215): a, c, t, g, unknown or other
  misc_feature (215)..(215): n is a, c, g, or t
  modified_base (432)..(432): a, c, t, g, unknown or other
  misc_feature (432)..(432): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggcctcccagtctcctcatctagtgggcatcctacaggatcgaccggcactcccgagacgaggttcacgtgccgaggtgggtctggggacagtaccttcactctcaccatccaacacactggcgacctagaagtattttgctagttntattactgtcagtatgtatgggtacgtctaccgttactaccgtttggacccgtaggggtaaccgtaagggtcggagtacgtacgaacgacgtaacgtggtacggctcggcctacgtacg

SEQ ID NO: 50629 - DNA, 326 bp, Homo sapiens
  misc_feature: GYAE6OF01EB8LG.21.38.D05.1.454.CMB.1.raw
  modified_base (318)..(326): a, c, t, g, unknown or other
  misc_feature (318)..(326): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagtacgaactgtggctgcaccatctgtcttcatcttcccgcatctgactcgtctctactggagcgggctggcaaggcgacatagnnnnnnnnn

SEQ ID NO: 50630 - DNA, 318 bp, Homo sapiens
  misc_feature: GYAE6OF01D0OE7.21.38.D05.1.454.CMB.1.raw
  modified_base (315)..(318): a, c, t, g, unknown or other
  misc_feature (315)..(318): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttcccgcatctgactcgtctctactgagcgggctggcaaggcgcatagnnnn

SEQ ID NO: 50631 - DNA, 321 bp, Homo sapiens
  misc_feature: GYAE6OF01AW9Y6.21.38.D05.1.454.CMB.1.raw
  modified_base (315)..(321): a, c, t, g, unknown or other
  misc_feature (315)..(321): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttcccgcatctgactcgtctctactgagcgggctggcaaggcgcatagnnnnnnn

SEQ ID NO: 50632 - DNA, 319 bp, Homo sapiens
  misc_feature: GYAE6OF01C917C.21.38.D05.1.454.CMB.1.raw
  modified_base (315)..(319): a, c, t, g, unknown or other
  misc_feature (315)..(319): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtctcatcttcccgccatctgactcgtctctactgagcgggctggcaaggcgcatagnnnnn

SEQ ID NO: 50633 - DNA, 540 bp, Homo sapiens
  misc_feature: GYAE6OF01BF23V.21.38.D05.1.454.CMB.1.raw
  modified_base (216)..(216): a, c, t, g, unknown or other
  misc_feature (216)..(216): n is a, c, g, or t
  modified_base (530)..(530): a, c, t, g, unknown or other
  misc_feature (530)..(530): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagagtgttggcatcgacgttgcctggtaaccaaacaaaaccgtggaccaggcctcccagtctcctcatctagtcgggcatcctacgaggatcgaccggcactccagactaggttcagtcgccgtaggtcggtcgtgggactacgtacttcactctaccaccataccaacactacgtcggccgctagtaagtattttgactagttgttattactgtacagtattgtagtggtacgtctaccgtactcgttggaccgtagggacaggtgagatacgagacgacgtggacgngtcgcacgta

SEQ ID NO: 50634 - DNA, 669 bp, Homo sapiens
  misc_feature: GYAE6OF01CDV7V.21.38.D05.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagagtgttggcatcgacgttgcctggtaaccaaacaaaaacctggaccaggcctccagtcctcctcatctagtgggactatcctacaggatcgaccggcactacccagacaggttcagtcgccgaggtggtcgtgggacaggtacttcacttctacacataccaacactacgtcggccgtaccgtaggtaacgttattttacgcttaaggttacgttaacgtttacgttacgtacgtaagttacgttaggttaacgttacgggttacggttacccgttaacccggttacgttaacccggttttacgggacccggtaaacgggggtaacccgtaaagggggttacgggtaaacggtacgtttacccggaaacgggtaaacccgtaacggttcgggtacgggtacgtttacggaccgtaacccgttaacg

SEQ ID NO: 50635 - DNA, 316 bp, Homo sapiens
  misc_feature: GYAE6OF01EAKWL.21.38.D05.1.454.CMB.1.raw
  modified_base (314)..(316): a, c, t, g, unknown or other
  misc_feature (314)..(316): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttcccgccatctgactcgtctctactgagcggctggcaaggcgcatgnnn

SEQ ID NO: 50636 - DNA, 776 bp, Homo sapiens
  misc_feature: GYAE6OF01EQ6EO.21.38.D05.1.454.CMB.1.raw
tcagtcgtcgctcgcacgaccggtgctcgatttagtatctgatagttgggtttgggggcagagcctctggagaagagctgcttcagttacggaccagaggaaccatggaaacccagcgcagcttctcttcctctgcttacgtctggcctcccgtagggttcgtcgtaccggagtaagttttgtcgtttgaccgctagttcctccgaggcaccctgtcgtcgtggtccggtccgaggggtaagtcgttacgtccgtcttcctgacaacggtccagtcagagtgttggccagtccgtacgtttcgtccgttggtaccaaactaaaaccgtcggtccgacggcctacccgtagtcctccgtcgagtcgtaggtcgggctacgtccgtaacgaggtacgtcggaccggctacgtaccgtaagtacgtaggttactagtcgaccgtaggttcggtcgtagggaccgtacggtaccttcgacttctaccacctacgtaccaaccgactaccgtcggaccgtaccttacgtaacgttacgttttacgacgttaagttacgttaactttacgtacgtacgtaacgtaacgttacggttaacgttacgggtttacggttacccttaaccggttacccgttacccgggttttcggggaacccgggttaaacgggggtaaacccgttaaaggggtaccgggtaagggtaccggttaaccggtaacgggtaaccggttaacggttcgggttaccgggtaccgttacggacccggtaacccgttaacgg

SEQ ID NO: 50637 - DNA, 320 bp, Homo sapiens
  misc_feature: GYAE6OF01DOWYZ.21.38.D05.1.454.CMB.1.raw
  modified_base (317)..(320): a, c, t, g, unknown or other
  misc_feature (317)..(320): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttcccgccatctgactcgtctctacgtgagcgggctggcaaggcgcatagnnnn

SEQ ID NO: 50638 - DNA, 323 bp, Homo sapiens
  misc_feature: GYAE6OF01B0P8F.21.38.D05.1.454.CMB.1.raw
  modified_base (258)..(258): a, c, t, g, unknown or other
  misc_feature (258)..(258): n is a, c, g, or t
  modified_base (318)..(323): a, c, t, g, unknown or other
  misc_feature (318)..(323): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcagcagactggagcctgaagattttgcaatgtattactgtcagcaatatgctccaccccccgatcaccttcggccaagggacacgactgcagatgaaacgaactgtggctgcaccatcngtcttcatccttcccgccatctgactcgtctctactgagcgggctggcaaggcgcatagnnnnnn

SEQ ID NO: 50639 - DNA, 530 bp, Homo sapiens
  misc_feature: GYAE6OF01CIVIY.21.38.D05.1.454.CMB.1.raw
  modified_base (215)..(215): a, c, t, g, unknown or other
  misc_feature (215)..(215): n is a, c, g, or t
  modified_base (397)..(397): a, c, t, g, unknown or other
  misc_feature (397)..(397): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggctcccagtctcctcatctatggggcatcctacaggatgaccggcatcccagacaggttcagtgccaggtggtctgggacagacttcactctcaccatcaacacactggcnctgaagtatttgctagtgttattactgtcagattggtatggttagtcaccgttactaccgtttggccgtagggggaaccaagggttgggagagtcgaaggtaacgaacgtggtacgggctcggcctacgtacg

SEQ ID NO: 50640 - DNA, 895 bp, Homo sapiens
  misc_feature: GYAE6OF01BXNFF.21.38.D05.1.454.CMB.1.raw
  modified_base (115)..(115): a, c, t, g, unknown or other
  misc_feature (115)..(115): n is a, c, g, or t
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (219)..(219): a, c, t, g, unknown or other
  misc_feature (219)..(219): n is a, c, g, or t
tcagtcgtcgctcgcacgaccggtgctcgatttagtatctgatagttggggtttggggcagagctctggagaagagctgctcagttaggacccagagggaaccatggaaaccccngcgcagcttctcttcctctgctactctggctccaggtgtccaccggagagttgtcttgacgcagtctccaggcacctgtctctgtcncgaggggaancgttacnctctctgcagccagtcagtagtgtagcagtcgacgttgcctcggtaaccaaacctaaaaccgtcggaccgtacggcctacccgtacgttcctccgtacctacgttaccgtacgtcggggtacctacttacccgtacgaacgggtaacgtcggaaccgggtctaaccgttaccccggacggtaaccgttaacgggttaccgtacggtaccgggtacccgtaacggggttcgggttaccgggtacggggaaccgtaacggtaaccgtttaccgtacccgttacctaacccgtaacccgttaacgttaacccgtaaacctaaccgttaacccggttaccgggtacccttacccggtttaaggttaaaccggtttacgtttttacgggaaccgtttaagggtttaccgttttaaacgttttaaccgtttacgggttaaccgtaaacggtttacggtttaacgggttaacgggttttacgggggttaaacccggttacccggttaaacccggttaacccggtttacccgggttaaccgggtaacccgggttaaaccgggggtaaacccgggtaacggggtttacgggggtaactaaaccggtaccgggtaaaccggtaaaccggttaaccggtttcgggtaacggttccccggttaaccggacccgttaccccgttaacgg

SEQ ID NO: 50641 - DNA, 571 bp, Homo sapiens
  misc_feature: GYAE6OF01AMIKQ.21.38.D05.1.454.CMB.1.raw
  modified_base (215)..(215): a, c, t, g, unknown or other
  misc_feature (215)..(215): n is a, c, g, or t
  modified_base (243)..(243): a, c, t, g, unknown or other
  misc_feature (243)..(243): n is a, c, g, or t
  modified_base (416)..(416): a, c, t, g, unknown or other
  misc_feature (416)..(416): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaangttactctctcctgcaaggtcagtcagngtgttgcatcgacgttgcctggtaccaacaaaacctggccaggcctcccagtctcctcactctagtggggctatcctagaggactgaccggcactcccagactaggttcacgtcgccaggtgggtcgtgggacacgactcactctacaccatccaacacctacgtcgggaccnccgtaggaacgttacgtttgacgtagttgttacttactgtacagtacttgtagttggttacgtctaccgtactaccgttggacggtacgggaccgtagggtggaagacggtcgaacggtaaccgaacgttcggtacggtcgcgtaccgacgtacg

SEQ ID NO: 50642 - DNA, 328 bp, Homo sapiens
  misc_feature: GYAE6OF01BA57Z.21.38.D05.1.454.CMB.1.raw
  modified_base (310)..(310): a, c, t, g, unknown or other
  misc_feature (310)..(310): n is a, c, g, or t
  modified_base (316)..(328): a, c, t, g, unknown or other
  misc_feature (316)..(328): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttcccgcatctgactcgtctctactgacgcgggctggcaaggcncatagnnnnnnnnnnnnn

SEQ ID NO: 50643 - DNA, 559 bp, Homo sapiens
  misc_feature: GYAE6OF01B8N8H.21.38.D05.1.454.CMB.1.raw
  modified_base (215)..(215): a, c, t, g, unknown or other
  misc_feature (215)..(215): n is a, c, g, or t
  modified_base (410)..(410): a, c, t, g, unknown or other
  misc_feature (410)..(410): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaaccaacaaaacctggaccaggcctcccagtctcctcatctagtgggcatcctacaggatgaccggcactccagacagttcagtcgccgaggtggtcgtggacagtacttcactctacacatcaacacactggcgctagagtntttcgactagtgttattactgtctagattgtagttggttacgtaccgtacccgtactaccgtttcggacccggtacggggtaaccgtaagggtcgggaagtacgtacgacggaacgtaacgtggtacgggactcggtcctaaccgtacg

SEQ ID NO: 50644 - DNA, 753 bp, Homo sapiens
  misc_feature: GYAE6OF01CU5EC.21.38.D05.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangtttactctctcctgcaaggccagtcagagtgttggcatcgacgttgcctggtaaccaaacaaaaacctggaccaggctcccagtctcctcatctagtggggctatcctacaggatcggaccggcactccagacacggttcagtcgccgtaggtcggtcgtgggacacgtacttacacttctaccacctactaccaaaccacacgtcggaccgtaccgtaggtaacgtacgtttttacggacgttaaggttacgtttaacgttttaccgttacggttaccgtaaggtaacgtttacgggtttaagtttacggggtttaaccgggtttacccgtaaaccccggtttaacccgttaaccccgggtttttacggggaaccccgggtaaacgggggggtaacccgtaaaacggggggtttacggggtaaacgggttaaacggttaaccgggtaaacggggttaaacccgggttaaacccgggttacggggttaccggggttacccggttaccgggtaacccgtaaaccccgtttaaccggg

SEQ ID NO: 50645 - DNA, 325 bp, Homo sapiens
  misc_feature: GYAE6OF01A89TM.21.38.D05.1.454.CMB.1.raw
  modified_base (315)..(325): a, c, t, g, unknown or other
  misc_feature (315)..(325): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttcccgcatctgactcgtctctactgagcgggctggcaaggcgcatagnnnnnnnnnnn

SEQ ID NO: 50646 - DNA, 684 bp, Homo sapiens
  misc_feature: GYAE6OF01CCQYZ.21.38.D05.1.454.CMB.1.raw
  modified_base (214)..(214): a, c, t, g, unknown or other
  misc_feature (214)..(214): n is a, c, g, or t
  modified_base (495)..(495): a, c, t, g, unknown or other
  misc_feature (495)..(495): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctctgctactctggctccaggtgtcaccggagagttgtcttgacgcagtctccaggccaccctgtctctgtctcgaaggggaaangttacctctcgtcctgacaaggccagtcagtagttggttgcatcgtacgttgcctacggtaaccaaacaaaaccgtggacctacggcctaccgacgtcctcctctatcgtaggtcgggactactacctacgtaggactcggaaccggcaacgtacccaaggtaccgtacggtttacgacggtccgaccggtagggttcgggtacgtacgggacctacggtaccttcgtactcctaccgaactactaccgaactcgaacgtcggaccaccgttagaacgttntttacggacttagttattacttaacgtcgttagtaagttagttacggttaggttacggttacggttaaccttaccggttaacttcccgggttacgggacggtaaacgggtaacggaacgggtcggtaaacggtactacggaacggtaaaccgtacggtttacggtcggacgtacgacctaggttacccg

SEQ ID NO: 50647 - DNA, 343 bp, Homo sapiens
  misc_feature: GYAE6OF01CTS8T.21.38.D05.1.454.CMB.1.raw
  modified_base (323)..(343): a, c, t, g, unknown or other
  misc_feature (323)..(343): n is a, c, g, or t
tcagtcgtcgctcgcacgaccggtgctcgatttagtatctgatagttggggtttgggatctatggggcatcctacaggatgaccggcatcccagacaggttcagtgccagtgggtctggggacagacttcactctcaccatcaacacactggcgcctgaagattttgctagtgtattactgtcagtatgtatggtaggtcaccgtacacctttggccaggggaccaaggtggagactcagacgaactgtggctgcacatctgtcttcatccttccgccatctgactcgtctctactgacgcggtctggcaaggcgacagtagnnnnnnnnnnnnnnnnnnnnn

SEQ ID NO: 50648 - DNA, 318 bp, Homo sapiens
  misc_feature: GYAE6OF01DZFQM.21.38.D05.1.454.CMB.1.raw
  modified_base (314)..(318): a, c, t, g, unknown or other
  misc_feature (314)..(318): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtgagatcagacgaactgtgctgcaccatctgtcttcatcttcccgccatctgactcgtctctactgagcgggctggcaaggcgcatagnnnnn

SEQ ID NO: 50649 - DNA, 540 bp, Homo sapiens
  misc_feature: GYAE6OF01BTACK.21.38.D05.1.454.CMB.1.raw
  modified_base (216)..(216): a, c, t, g, unknown or other
  misc_feature (216)..(216): n is a, c, g, or t
  modified_base (395)..(395): a, c, t, g, unknown or other
  misc_feature (395)..(395): n is a, c, g, or t
  modified_base (410)..(410): a, c, t, g, unknown or other
  misc_feature (410)..(410): n is a, c, g, or t
  modified_base (420)..(420): a, c, t, g, unknown or other
  misc_feature (420)..(420): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagagtgttggcatcgacgttgcctggtaccaacaaaacctgccaggctcccagtctcctcatctagtggggcatcctacaggatcggaccggcactccagacacggttcagtgccgagtggtcgtgggacagtacttcactctcaccatcaacncactggcgctgaatntttgctagtntattctgtacagtatgtagtggtaggttccaccgttacctaccgtttggaccgtacggggtaaccgagggtggagtacgtacgaagacggtaacgtggtacggactcgccgtaccgtacg

SEQ ID NO: 50650 - DNA, 666 bp, Homo sapiens
  misc_feature: GYAE6OF01EXU57.21.38.D05.1.454.CMB.1.raw
  modified_base (216)..(216): a, c, t, g, unknown or other
  misc_feature (216)..(216): n is a, c, g, or t
  modified_base (337)..(337): a, c, t, g, unknown or other
  misc_feature (337)..(337): n is a, c, g, or t
  modified_base (658)..(658): a, c, t, g, unknown or other
  misc_feature (658)..(658): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaanagttactctctcctgcaaggccagtcagagtgttggcatcgacgttgcctggtaccaacaaaacctggaccaggctccagtctcctcatctagtcggggcatcctacgaggatcgaccggnactcccgaagacgtaggttacaggtcgacccgtaggtacgggtccgttacggggacgtaaggtacctttcaaccgttccttaccgaaccctaattacccaaacaccgtaacgttcgggaccgtccgttaggaaacgttatttttacggacgttaacggttacgttaacgttttacttcggtacgaagttacgttacggtagtttacgggttaacggttccaacccggttaacctaccgtttacgggaccgtaacgggggaacccgtaaggggttcggaagtacgtacgaacggaacgtacgttagggtcggatcggtaacncccgtacg

SEQ ID NO: 50651 - DNA, 549 bp, Homo sapiens
  misc_feature: GYAE6OF01C4J69.21.38.D05.1.454.CMB.1.raw
  modified_base (215)..(215): a, c, t, g, unknown or other
  misc_feature (215)..(215): n is a, c, g, or t
  modified_base (538)..(538): a, c, t, g, unknown or other
  misc_feature (538)..(538): n is a, c, g, or t
  modified_base (543)..(543): a, c, t, g, unknown or other
  misc_feature (543)..(543): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaanagttactctctcctgcaaggccagtcagagtgttggcatcgacgttgcctggtaccaaacaaaacctggccacggcctccctagtctcctcatcgtagtggggcagtcctacgaggatcggaccggcactccacgacgtaggtcagtgacgaggtggtcgtgggacagtacttcactctacacactacaactacactggcgtccgtagtaagtattttgactagttgtattactgtcagtatgtagttggtacggtctaccgttactaccgttggaccgtagggaccgtaagggtggagatcgaaggacgaacgtggtacgancgtcncgtacg

SEQ ID NO: 50652 - DNA, 552 bp, Homo sapiens
  misc_feature: GYAE6OF01A39M6.21.38.D05.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaangttactctctcctgcaaggccagtcagagtgttgcatcgacgttgcctggtaaccaacaaaacctggccaggctcccagtctcctcatctagtgggcatcctacaggactacgaccggcactcccaagacgtaggttcagtcgccgtaggtcgggtcgtgggacagtaccttcactctcaccatacaaccacacgtcggaccgtacctagtaacgtattttgactagttagtattactgtcagtatgtagtggtacgtctacgtactacgttcggaccgtacgggaacctagggtggagagtcgaagacgtaacgtggtacggactcgcctacgtacg

SEQ ID NO: 50653 - DNA, 323 bp, Homo sapiens
  misc_feature: GYAE6OF01B6BQ1.21.38.D05.1.454.CMB.1.raw
  modified_base (232)..(232): a, c, t, g, unknown or other
  misc_feature (232)..(232): n is a, c, g, or t
  modified_base (240)..(240): a, c, t, g, unknown or other
  misc_feature (240)..(240): n is a, c, g, or t
  modified_base (254)..(254): a, c, t, g, unknown or other
  misc_feature (254)..(254): n is a, c, g, or t
  modified_base (260)..(260): a, c, t, g, unknown or other
  misc_feature (260)..(260): n is a, c, g, or t
  modified_base (289)..(289): a, c, t, g, unknown or other
  misc_feature (289)..(289): n is a, c, g, or t
  modified_base (310)..(310): a, c, t, g, unknown or other
  misc_feature (310)..(310): n is a, c, g, or t
  modified_base (315)..(323): a, c, t, g, unknown or other
  misc_feature (315)..(323): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagtattttgcagtgtattactgtcagatgtatggtaggtcaccgtacactttggaccagggaccaaggtggagancagacaangtggctgcaccatntgtctnactcttcccgcatctgactcgtctctacngacgcggctggacaaggccanatagnnnnnnnnn

SEQ ID NO: 50654 - DNA, 639 bp, Homo sapiens
  misc_feature: GYAE6OF01CR46W.21.38.D05.1.454.CMB.1.raw
  modified_base (214)..(214): a, c, t, g, unknown or other
  misc_feature (214)..(214): n is a, c, g, or t
  modified_base (419)..(419): a, c, t, g, unknown or other
  misc_feature (419)..(419): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctctgctactctggctcccaggtgtcaccggagaagttgtcttgacgcagtctccaggcaccctgtctctgtctccgaggggaangttactctctcctgcaaggccagtcagagtgttggcatcgagttcgcctaggtaaccaaacaaaacctggaccacggcctcccagtcctcctatactctagtgggactatcctagaggatcggaccgcactccagacgtaggttcagtcgacgtaggtggtcgtagggactacgtaccttcgacttcctacacctataccaaccnctacgtcggaccgtacgttagtaacgttattttcgactaaggtttgtttaacttacgttacgtacgtaacgtacgtaaggtttaacgtacggtaacgtttcctaacccgttcgtttacggtccgggtttaccggaaccggtagggaaacccgtaaagggtaacgtaaacggttaacggaaacgtacgttaggtcggaacttcgaccctacgtcgttaccg

SEQ ID NO: 50655 - DNA, 318 bp, Homo sapiens
  misc_feature: GYAE6OF01ADLFB.21.38.D05.1.454.CMB.1.raw
  modified_base (306)..(306): a, c, t, g, unknown or other
  misc_feature (306)..(306): n is a, c, g, or t
  modified_base (311)..(318): a, c, t, g, unknown or other
  misc_feature (311)..(318): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcagcagactggagcctgaagattttgcaatgtattactgtcagcaatatgctcaccccccgatccaccttcggccaaggacacgactgcagatgaaacgactgtggctgcaccatctgtctcatcttccgcatctgactcgtctctactgagcggctggacaaggcnatagnnnnnnnn

SEQ ID NO: 50656 - DNA, 823 bp, Homo sapiens
  misc_feature: GYAE6OF01AYXH5.21.38.D05.1.454.CMB.1.raw
  modified_base (225)..(225): a, c, t, g, unknown or other
  misc_feature (225)..(225): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggcctcccaggtgtcaccggagaagttgtcttgacgcagtctccgaggccaccctgtcctctgtcctaccgaaggggtaaagngttactctctcctgacaaggccagtcaggtagttgttggcacgtcggtacgttcgccgtacggtaacccaaaccaaaaccgtcggaccacggtcctaccccgagttccctcctactacgtcgtaacggtcggggtacctacttccccgtaacgacggtacgttacggacccggactaccgtaccccgaagtaccgtacgggtttaccacggtacgccggtaagggttcgggttacgtacggggaacgtaacggtacctttaccgacctttaccgtaccctaaacccgaacttaacccgaaacccgtaacccgtaacccggttacgggaccccgttaccggttaacggtaaacggtttacgtttttaaccggaccggttaacggtttacgtttaaacgttttacgttacggtttacgtaaacggtttagttacggtttaagggttacgggtttaaccgggttaacccttaacccggtttaccgttaacccggtttcgggacccggtaaccgggggtaaccgtaaaggggttcggaacgtaacgtaccgaacggtaacggttaaccgttgggtacgggtccgtaacgcccgtaacgtacg

SEQ ID NO: 50657 - DNA, 535 bp, Homo sapiens
  misc_feature: GYAE6OF01CLXBW.21.38.D05.1.454.CMB.1.raw
  modified_base (216)..(216): a, c, t, g, unknown or other
  misc_feature (216)..(216): n is a, c, g, or t
  modified_base (367)..(367): a, c, t, g, unknown or other
  misc_feature (367)..(367): n is a, c, g, or t
  modified_base (391)..(391): a, c, t, g, unknown or other
  misc_feature (391)..(391): n is a, c, g, or t
  modified_base (407)..(407): a, c, t, g, unknown or other
  misc_feature (407)..(407): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagagtgttggcatcgacgttgcctggtaccaacaaaacctgccaggctcccagtctcctcatctatgggcatcctacaggatgaccggcactcccagacaggttcagtgcctagtggtctgggacngtacttcactctcacatcaacacnctaggctcctgaagtnttttgctagttgtattactgtactagagttgtaagtgggtacgtcgtacccgtactaccgtttcggaccgtagggggacctaaggggtgaggactacgagtacgaacgtggtagctcgactacctacg

SEQ ID NO: 50658 - DNA, 727 bp, Homo sapiens
  misc_feature: GYAE6OF01DCMVC.21.38.D05.1.454.CMB.1.raw
  modified_base (217)..(217): a, c, t, g, unknown or other
  misc_feature (217)..(217): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccgggagaagttgtcttgacgcagtctccaggcaccctgtctctgtctccgaggggaaanagttactctctcctgcaggccagtcagagtgttggcatcgacgttgcctggtaccaacaaaacctggaccaggcctcccagtcctcctcactctagtgggcatcctacaggatcgaccggcactccagactaggttacaggtcgccgtaggtcgggtcgtaggggacacggtacttcgaccttcgtccaaccgtactaaccaaaccgtacctaaccgttcgggacccggtaccgttacgggtaaacgttacgtttttacggaccgttaggtttacgtttaacgttttaccggttacggttaccgaaggttacgttaagggttttacggttaggggtttaaccgggttacccgttaaccccgggtttaccgttaaccccgggttttaccggggaacccgggtaaccggggggtaaacccggtaaggggttacgggaacgttacgttaccggaaacggtaacccggtaacggttcgggtacgggtacgtacggtacccgtaacgttaaccgg

SEQ ID NO: 50659 - DNA, 847 bp, Homo sapiens
  misc_feature: GYAE6OF01C3411.21.38.D05.1.454.CMB.1.raw
  modified_base (826)..(826): a, c, t, g, unknown or other
  misc_feature (826)..(826): n is a, c, g, or t
tcagtcgtcgctcgcacgaccggtgctcgatttagtatctgatagttgggtttggggcagagctctggagaagagctgctcagttaggacccagaggaaccatggaaaccccagcgcagcttctcttcctcctgctactctggctcccaggtgtcaccggagaagttgtcttgacgcagtctcaggcaccctgtctctgtctccgaggggaatgttactctctctgacaaggccagtcagtagtgttcggctagtcgtacgttcgccgtacggtaaccaaacgtaaaaccgtcggaccgtacggcctacccgacgtcctcctacgtactccgtaacggttcggggacctaactacccgtaacggtaacggtacgttaccggaaccccgggtacctaaccgttaccccgaaacggtaaccggtaacggtttaccgaacgggttccggtaacccggtaacggggtcggggttaccggttacggggaacccgtaaaccggttaccgtttaccctaaccggtttacccgtaacccgtaacccttaaacttaaccccggaaaactaaccccgtaacccggtaccgggtaacccgtaacccgttaaggttaaaccgtacggttttacgaccgttaagtttacggttaacgttaacgtacggttacgtaacggttacgttacgggttaacgttacggggttaaccgttaacccgttaacccggttaaccgttacccgggttttaacggggaacccggtaaaaccgggggtacccgtaaaagggttcgggtaaacgtaggttaccggaaaccgtaacggtaacgtggtacggtntaccggtacctaacggttacg

SEQ ID NO: 50660 - DNA, 520 bp, Homo sapiens
  misc_feature: GYAE6OF01ERFHN.21.38.D05.1.454.CMB.1.raw
  modified_base (216)..(216): a, c, t, g, unknown or other
  misc_feature (216)..(216): n is a, c, g, or t
  modified_base (320)..(320): a, c, t, g, unknown or other
  misc_feature (320)..(320): n is a, c, g, or t
  modified_base (464)..(464): a, c, t, g, unknown or other
  misc_feature (464)..(464): n is a, c, g, or t
  modified_base (490)..(490): a, c, t, g, unknown or other
  misc_feature (490)..(490): n is a, c, g, or t
  modified_base (511)..(511): a, c, t, g, unknown or other
  misc_feature (511)..(511): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagagtgttggcatcgacgttgcctggtaccaacaaaaacctgaccaggctcccagtctcctcatctatgggcatcctanaggatgaccggtcatccagacaggttcagtgccaggtggtctgggacaggacttcacgttctcaccatacgaacacactggccgcctagaacgtattttcgctacgtgtatttactgtctagtatgtatggtacgtcaccgtanccgtttgaccgtgggactaggtgganagtcagacgtaacgtggcgtngccgctacg

SEQ ID NO: 50661 - DNA, 692 bp, Homo sapiens
  misc_feature: GYAE6OF01ET498.21.38.D05.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggccaccctgtctctcgtctccgaaggggaaangttactctctcctgcaaggccagtcagagtgttggcatcgtacgttcgcctaggtaaccaaacaaaaccgtcggaccacggcctacccacgtcctcctacactcgtagtcgggctactcctacgaggtactcgaccggctaccgtaccgagtacgtacggtacacgtcgccgtaggtcggtcggacgggacacgtacttctactccgtacaacctactaccaaccacgtaccgtcgaccgtacgtaaggtaacgttacgtttcggacgttaggttacgtttacgtttaacgtcgttacgaaggttacgttagggttacggtttaagggttaccggttacccgtaaccggttacccgttaccggtttacgggaacccgggtacgggggtaaccggttaaggggtcgggtaagtacggtacgaaaccgggtacggtaaccgttggtacggtaccgtacggtaccctacgttaccg

SEQ ID NO: 50662 - DNA, 323 bp, Homo sapiens
  misc_feature: GYAE6OF01C3I3N.21.38.D05.1.454.CMB.1.raw
  modified_base (318)..(323): a, c, t, g, unknown or other
  misc_feature (318)..(323): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccgaggggaccaaggtggagatcagacgaactgtgctgcaccatctgtcttcatacttcccgcctatctcgactcgtctctactgagcgggctggcaagcgcatagnnnnnn

SEQ ID NO: 50663 - DNA, 326 bp, Homo sapiens
  misc_feature: GYAE6OF01EK795.21.38.D05.1.454.CMB.1.raw
  modified_base (317)..(317): a, c, t, g, unknown or other
  misc_feature (317)..(317): n is a, c, g, or t
  modified_base (321)..(326): a, c, t, g, unknown or other
  misc_feature (321)..(326): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcaagacgaactgtggctgcaccatctgtcttcatccttcccgctatctgacctcgtctctactgacgcgggctggcaaggcgcancgannnnnn

SEQ ID NO: 50664 - DNA, 314 bp, Homo sapiens
  misc_feature: GYAE6OF01BE01Y.21.38.D05.1.454.CMB.1.raw
  modified_base (307)..(314): a, c, t, g, unknown or other
  misc_feature (307)..(314): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtagtcacgtacactttggcagggacaggtgagatcagacgaactgtggctgcaaccatctgtcttcatcttcccgcatctgactcgtctctactgagcggctggcaaggcgcatagnnnnnnnn

SEQ ID NO: 50665 - DNA, 713 bp, Homo sapiens
  misc_feature: GYAE6OF01AGQSH.21.38.D05.1.454.CMB.1.raw
  modified_base (437)..(437): a, c, t, g, unknown or other
  misc_feature (437)..(437): n is a, c, g, or t
tcagtcgtcgctcgcacgaccggtgctcgatttagtatctgatagttgggtttgggggcagagctctggagaagagctgctcagttaggacccagagggaaccatggaaaccccagcgcagcttctcttcctcctgctactctggctcccaggtgtcaccggagaagttgtcttgacgcagtctccaggccaccctgtcctctgtcctccgaaggggaaagagttactctctcctgcaaggccagtcagagtgttggcatcgacgttgcctggtaaccaacaaaacctggaccaggcctcccagtcctccgtcactctagtcgggggcacttccctacgaggatcggaccggcactccccgagaacctagggtcaggtcgccgaggtgggtcgtggggaccaggtacttccacgttcctaccgaccactaccaaacnccacgtcggccggtacttaggaacgttattttcggacgttacggttacgtttagtttaaccgttcggtacttaaggttagttaggtttaacggttacgggttaacggttaccgtaacccggttaacccgttaaccgggtttaccgggacccgggtaaaccggggggtaaacccgttaaaggggggttaccgggaaggttaacggtacccggttaaacgggaacccggttaaaggtttcgggtacgggtaacctcggtaacccgtacccgttaacgg

SEQ ID NO: 50666 - DNA, 835 bp, Homo sapiens
  misc_feature: GYAE6OF01DJRRO.21.38.D05.1.454.CMB.1.raw
tcagtcgtcgctcgcacgaccggtgctcgatttagtatctgatagttgggtttggggcagagctctggagaagagctgctcagttaggacccagagggaaccatggaaaccccagcgcagcttctcttcctctgctactctggctccaggtgtcaccggagtaagttgtcttgacgcagtctccaggccacctgtctctgtctccgaagggtaaatacgttactcgtcctcctgacaaggccagtcagtagtgttggcatcgtagttcgaccgtaggtaaccaaaaccgaaaaccgtcggaccgaacggtccctaccccgtacgttcccttccgtactacgttaccgttaaggtccggggtaacctaaccgttaccgtaacgtaaacgggtacgtacggtaacccgggtacctaaccgtaccccgaaaggtaccggtaacgggtttacgaacggttcgacccgtaagggttcgggttaccggtacgggtaacgtaacggtacctttccgaaccgtttcctaacccgaaccgtaaactacccgaaaacctaccgtacccggtttacggaccccgtaccgttaagggtaaacctttagttttaaccgggacgttaaggttttaacgttttaacgttttaacgtacgggttacgtaaacgttacgtttaggttaaacggttagggtttaacccgtaccggtaacccggtttaccgttaaccggtttccgggaccggtaaaccgggggtaaacccgtagggggtacgtaaccgttaacgtccgaaaagggtacccggttaacggtcggttacgtaaccgtcggtaccgtaacgttacgg

SEQ ID NO: 50667 - DNA, 909 bp, Homo sapiens
  misc_feature: GYAE6OF01DH8TZ.21.38.D05.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgagggaanagttactctctcctgcaaggccagtcagtagtgttggcatcgacgttcgccgttacggtaaccaaaacaaaaaccgtcggacccaaggtccctaccccgtagtccttcctacacttaccgtaaggtcggggacctaacgtacccgttaacgaacgggtacgtccggaaccgggcctaacttaccccgaacggaaccgttacgggttaccaaggtccggaccgtaagggttcggggttaccgtacgggggaaccgtaaacggtaacccttttaccgaacccgtttccgtaaccctaacccgtaaccttacccgaaaaccgtaacccgtaaccggtttccggggaacccgttacccgtaagggtaacgttttaacgtttttccggaaacccgttaacgggttttacgtttaaacgttttacccggtttacggttaacggtaaacggttacggttttaacgggtttaacgggttacgggggttttaaccgggttaacccgttaaccccggtttaaacccgttttaccccgggttttaacccggggaaccccggggtaaaccggggggttaacccgtaaaaggggggttaccgggtaaacggttaaccgttaaccgggtaaaaccgggtaaacccgggttaaacggttccgggggtttaccgggaccgggttaacccgaacccgtaaccccgttaacgg

SEQ ID NO: 50668 - DNA, 327 bp, Homo sapiens
  misc_feature: GYAE6OF01CDEMN.21.38.D05.1.454.CMB.1.raw
  modified_base (242)..(242): a, c, t, g, unknown or other
  misc_feature (242)..(242): n is a, c, g, or t
  modified_base (317)..(327): a, c, t, g, unknown or other
  misc_feature (317)..(327): n is a, c, g, or t
tcagtcgtcgctcgcacgaccggtgctcgatttagtatctgatagttgggtttgggatctatggggcatcctacaggatgaccggcatcccagacaggttcagtgccagtggtctgggacagacttcactctcaccatcaacacactggcgcctgaagattttgcagtgtattactgtcagatgtatggtaggtcaccgtacacctttggccaggggaccaaggtggagatcagagaactgnggctgcaccatctgtctcatccttcccgcatctgactcgtctctactgacgcgggtctggcaaggcgcgactagnnnnnnnnnnn

SEQ ID NO: 50669 - DNA, 672 bp, Homo sapiens
  misc_feature: GYAE6OF01DXUP6.21.38.D05.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaanagttactctctcctgcaaggccagtcagagtgttggcatcgacgttgcctggtaaccaaacaaaacctggaccaggcctcccgagtcctccgtcactccaacaatatattctacgagggccgcggcactcccaagactaggttcaaggtcggactaggtcgggtcgtcgggactaggtaccttcaccttacgtaccactatcgaacgcaaggtacctgggaacgtccgtagtaacgttatttttcggaaccttaagttaggttactttaacgtgttacgaagttaagttagttaacggttacgggttaacgggttaccttaacccggttaccttaacccggttttacgggacccgggtaaacggggtaacgtaaaggggttcggtaaacgtacgttaccggaacggttaaccggaaacgttgggtaaacgggtcttacggacccgtaacgttaccgg

SEQ ID NO: 50670 - DNA, 854 bp, Homo sapiens
  misc_feature: GYAE6OF01B30GC.21.38.D05.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagtatctgatagttgggtttggggcagagctctggagaagagctgctcagttaggacccagaggaaccatggaaaccccagcgcagcttctcttcctcctgctactctggctcccaggtgtcaccggagaagttgtcttgacgcagtctccaggcaccctgtctctgtctccgaggggaanagttactctctcctgcaaggcctagtcaggagtgttggcatcgtacgttgcctaggtaacaaacaaaaccgtgaccaggcctccacgtctcctcacttctacgtggggcactcctacgaggatcgaccgctacgtacccgaggtacgggttcacggtcgaccgaggttcgggtccgtggggaactacgtaccttacgtacttcgttaccaacccacttaacccaacgaccgtacgtcggtaccgaccgtagtaaacgtacgttttttacgaccgtaacgtttacgggttacttttaaccggttacgttaaccgtagtaacgtttacggttaaggtttacccggggtttaaacgggttacccgttaaaccccgggtttaccccgtttaacccggtttttaccgggggtaaccccgggttaaaaccgggggggtaaaccccgggttaaaacgggggttaaccggggggtaaaacgggtttaaacccgtttacccgggggttaaaaacccggggttaaaaccccggggtttaaaacccgggtttttaccggggggttaaaccgggggtttaccccggtttaaaccccggggaaccccccggttttaaaaccccggttacccggtttttttaaacccccggggg

SEQ ID NO: 50671 - DNA, 427 bp, Homo sapiens
  misc_feature: GYAE6OF01C8P7G.21.38.D05.1.454.CMB.1.raw
  modified_base (157)..(157): a, c, t, g, unknown or other
  misc_feature (157)..(157): n is a, c, g, or t
  modified_base (265)..(265): a, c, t, g, unknown or other
  misc_feature (265)..(265): n is a, c, g, or t
  modified_base (364)..(364): a, c, t, g, unknown or other
  misc_feature (364)..(364): n is a, c, g, or t
  modified_base (367)..(367): a, c, t, g, unknown or other
  misc_feature (367)..(367): n is a, c, g, or t
  modified_base (369)..(369): a, c, t, g, unknown or other
  misc_feature (369)..(369): n is a, c, g, or t
  modified_base (373)..(427): a, c, t, g, unknown or other
  misc_feature (373)..(427): n is a, c, g, or t
tcagtcgtcgctcgcacgaccggtgctcgatttagtatctgatagttggggtttaggggatctaatcggggcatcctaacaggatgaccggcatcccagacgacggttcagtgccaggtggggtcctgggacagacttcactctcacccatcaacanactggcgcctgaagattttgcagtgtactttactcgtcagatgtatggtaggtcaccgtactaccgttggccgagggaccaaggtggagatcagacgaatggtgctanctaccatctgtcttcactccgttaccccgacctaatacctcgaaccttcgtctctacgtgacggcgggtcgtaggacaaaacgggtcgagtacgtaggntgngncagnnnnnnnnnnnnnnnnnnnnnnnnnnnnnnnnnnnnnnnnnnnnnnnnnnnnnnn

SEQ ID NO: 50672 - DNA, 801 bp, Homo sapiens
  misc_feature: GYAE6OF01BA3NT.21.38.D05.1.454.CMB.1.raw
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggcctcccaggtcgtcaccggagtaagttgtcttgacgcagtcctccgaggccacctgtctctgtctccgaagggaatgttactctctctgacaaggccagtcaggtagttgtggctatcgtacgttcgaccgtacggtaacccaaacgtaaaaccgtcggaccgacggtacctacccgtacgtcctccgtactagtccgtaggtcgggtacctaccgtacctacgacggtacgtacggaccggtactaccgtacccgaagtaccgtacgggttacgacggtcgaccgtacgggttacgggtacggtacgggtaaccgtacggttaacccgttaccgtaccgttaccgtaccgaacccgtaaccgttaaccgaaaccgtaccgtaccggtcgggtaccgtaccgttaaggtaacgtttcgttttaccggacttaacggtttacgttaaactttacgtacggttaacgtaacggtagtttacgggtacggtttacgggtaacggttaacccgttaacccggttaccgttacccgggttacgggtaaccccggaaagggggttaacccggtaacgggtacgggtaacgtaaccgttaccgggaaaccgtaccggttaacggttagggtaccggtaccgttcgtaacccgtaccggttaacg

SEQ ID NO: 50673 - DNA, 770 bp, Homo sapiens
  misc_feature: GYAE6OF01D15HZ.21.38.D05.1.454.CMB.1.raw
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtcgtcaccggagtaagttgtcttgacgcagtctccaggcaccctgtctctgtctaccgaggggaaatagttactctcctcctgacgaacggccagtcaggtagttggttcggactagtccggtacgttcggaccgttacggtaaacccaaaaaccgtaaaaacccgtcgggaccccgaacgggtcccctacccccgtaacggttccctacccttactaacgttaccgtaacggttcggggacctacgtacccgtaacgaagggtacgtaccggaacccgggacctaacgtaccccgaaggtaaccgtaacgggttacacggtcgaccgtagggtcgggtcgtacgggactacgtacttacactcctaccacctactaaccaaccacgtaccgtacggccgtaccgtaggtaacgttagttttcgacgttaggttacgtttaacgtttacgtacggttacgtaagttagttacggttaaggttacgggttaaccggtacccgtaaccgttaccggttaccggttaccgggaccggtaaccggggtaacgtaacggggtaggaaacgtagtaccgaaagggtaccgtaacggtcggtacggacgtcgtacctaccgtacg

SEQ ID NO: 50674 - DNA, 708 bp, Homo sapiens
  misc_feature: GYAE6OF01EMXNL.21.38.D05.1.454.CMB.1.raw
  modified_base (153)..(153): a, c, t, g, unknown or other
  misc_feature (153)..(153): n is a, c, g, or t
  modified_base (161)..(161): a, c, t, g, unknown or other
  misc_feature (161)..(161): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctccaggtntcacgganagttgtcttgacgcagtctccaggcacctgtctctgtcctcgagggaaatgttactctctcctgacaacggcctagtcagacgttgttcggcagtccgacgttcgtaccgttacggtaaccaaaacgtaaaaccgtcggacccaacggtcctacccgtaagttcctacctactacgttccgtagtcggggacctacgttcccgtaacgacggtacgtcggtaaccggacaccgttaccgacgtacgtacggttcaacggtcgtaccgtaggtcgggtcgtacggggactacggtacttacgtactcctacctaaccgtataaccgaactaccgtacgttcggaccgtaccgttaaggaacgtttaacgttttcggaacttacgttacgttaacgtttacgtagttaccgaagttaccttaggttacgtacgggttacgtaccgtacgtaccgttacgttcggaccggtacgggtaaccgtaggtacggtacgtaagtcgaaacggtacgtacgttcggggtcgaccgtacgtacccgtacgttaccg

SEQ ID NO: 50675 - DNA, 511 bp, Homo sapiens
  misc_feature: GYAE6OF01E2B44.21.38.D05.1.454.CMB.1.raw
  modified_base (214)..(214): a, c, t, g, unknown or other
  misc_feature (214)..(214): n is a, c, g, or t
  modified_base (368)..(368): a, c, t, g, unknown or other
  misc_feature (368)..(368): n is a, c, g, or t
  modified_base (460)..(460): a, c, t, g, unknown or other
  misc_feature (460)..(460): n is a, c, g, or t
  modified_base (485)..(485): a, c, t, g, unknown or other
  misc_feature (485)..(485): n is a, c, g, or t
  modified_base (506)..(506): a, c, t, g, unknown or other
  misc_feature (506)..(506): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaangttactctctcctgcaaggccagtcagagtgttggcatcgacgttgcctggtaccaacaaaacctggccaggctcccagtctccgtcatctagtggggcatcctacaggatcgaccggcatcccagacaggttcagtgccagtggtctgggacnggacttcgactctcacctatccaacacactggccgcctagaacgtattttcgctagttgtattactgtcagatagtatggtagtcacgtacncgtttgacctagggactaggtgganatcagacgagtcgtagctgcnctacg

SEQ ID NO: 50676 - DNA, 604 bp, Homo sapiens
  misc_feature: GYAE6OF01A8UIO.21.38.D05.1.454.CMB.1.raw
  modified_base (217)..(217): a, c, t, g, unknown or other
  misc_feature (217)..(217): n is a, c, g, or t
  modified_base (323)..(323): a, c, t, g, unknown or other
  misc_feature (323)..(323): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggccaccctgtctctgtctccgaggggaaangttactctctcctgcaaggccagtcagagtgtggcatcgacgttgcctggtaccaacaaaacctggccaggctcccagtcctcctcatctagtggggcatccctanaggatcgaccggcactcccagacaggttcagtgccgaggtcgggtctgggacaggacttcactctacaccatccaacactacgtcggcctccgtagaacgtattttcggacgtagttagtactttacgtgtactagtattagttagttagggttacggtacctaacccgttacgtacccgttttagggacccgtaagggggacccgtaaaggggtcggtaaacgtagtacgaacggtaaccggtaacgttgggtacggtaccgtcgcccgtaaccgttacg

SEQ ID NO: 50677 - DNA, 848 bp, Homo sapiens
  misc_feature: GYAE6OF01BF1LL.21.38.D05.1.454.CMB.1.raw
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagagttgtcttgacgcagtctccaggccaccctgtctctgtctccgaagggaagagttactctctcctgcgaaggccagtcagtagtgttggcatcgtacgttgcctaggtaaccaaacgaaaacctcggaccgacggtcctacccctagtcctcctacagtcgtagtcgggacacgtacctacgaggtatcggaccggcactaccgagacgtagttcacgtcgacgtaggtcgggtcgtacgggactaacgtaccgttctaccgttacctacccaacctacgtaacccaaaccgaacctacccggttaccgggaccgttacccggttaaggttaaacgtttacgtttttacggacccgtttaagggtttacgtttaaacgtttttaaccgtagggtttaccgtaagggtttaacggtttacgggtttaaacgggtttaccggggttttaaccgggttaaccccgtttaaacccgggttttaaccccggtttaacccggggttttacccggggaaccgggggttaaaacccgggggtaaaccgggttaaaccggggggtttagggtaaacccggttaacggttaaccgggtaaaaccgggtttaaaccccgggtaaaacggttttcgggggttaacccggggtaccccgtttaaccggggtaaccccgttaaccccggtttaaacgg

SEQ ID NO: 50678 - DNA, 749 bp, Homo sapiens
  misc_feature: GYAE6OF01BFSHK.21.38.D05.1.454.CMB.1.raw
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctccaggtgtcaccggagaagttgtcttgacgcagtctccaggcaccctgtctctgtctccgaggggaagagttactctctcctgcagctccagccagaatatccagagctactacatagcctaggtaccagctaagaacgccctggaccgacggtccgtaccccgtacggtttccctacgtacttcctagtcgtccggttcgggtacccccacggtaaccgggtccccacggttacggacccgtactaccccgaaggtaacccgtagggttccgaaggttcggggtacgtaacggggttcggggtaccgttaggggaacctacggtaaccgtttaccgacctttacgtcctaaattccgtaaggtttacgacggtaacgtacggtacggtacgtacccgttaaggacgttacgtttccggataggttaggttactttacgttagtcgtaacggtacgtaaggtacggttaagggttaccttaccggtacccttccggtttacgggttcccggtttaacccggggacccgggttaaacgggaaaccggtaaacgggttaaacggtaaaaccggttaggtaaaaccgggtacggttcgggtaacgg

SEQ ID NO: 50679 - DNA, 604 bp, Homo sapiens
  misc_feature: GYAE6OF01EZUW4.21.38.D05.1.454.CMB.1.raw
  modified_base (217)..(217): a, c, t, g, unknown or other
  misc_feature (217)..(217): n is a, c, g, or t
  modified_base (331)..(331): a, c, t, g, unknown or other
  misc_feature (331)..(331): n is a, c, g, or t
  modified_base (335)..(335): a, c, t, g, unknown or other
  misc_feature (335)..(335): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggccaccctgtctctgtctccgaagggaaangttactctctcctgcaaggccagtcagagtgtgcagtcgtacgttgcctaggtaaccaaacaaaacctggaccaggcctcccgagtcctccgtcatctagtcgggctatcctanaggntcgaccggcactcccaagacgtacggtcaggtcgaccgtaggtcgggtctagggacagtacttcactccgtacacctactaccaaccacgtacgtcggccgtaccgtagtaacgttattttcgacgtaggtttagttaactttacgtgtaccagttaagtggttaagtcgggttacgtacctaccgtacctaccgttgggaccgtaacggggtaacgtaagggtggaagtacgacgaacgacgtacgtgggtacagtcgacctcgtacg

SEQ ID NO: 50680 - DNA, 349 bp, Homo sapiens
  misc_feature: GYAE6OF01C9YCC.21.38.D05.1.454.CMB.1.raw
  modified_base (264)..(264): a, c, t, g, unknown or other
  misc_feature (264)..(264): n is a, c, g, or t
  modified_base (322)..(323): a, c, t, g, unknown or other
  misc_feature (322)..(323): n is a, c, g, or t
  modified_base (325)..(349): a, c, t, g, unknown or other
  misc_feature (325)..(349): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagatttttgcagtgtattactgtcagcagtatggaagttcacctctgtcgttcggccaaagggaccaaaggtagaaaatgaaacgaactgtggctgcaccatctgtnttcatcttccgcatctgactcgtactctactgacgcgggctgggcaagggcgcatagnngnnnnnnnnnnnnnnnnnnnnnnnnn

SEQ ID NO: 50681 - DNA, 420 bp, Homo sapiens
  misc_feature: GYAE6OF01BSAH9.21.38.D05.1.454.CMB.1.raw
  modified_base (370)..(370): a, c, t, g, unknown or other
  misc_feature (370)..(370): n is a, c, g, or t
  modified_base (377)..(378): a, c, t, g, unknown or other
  misc_feature (377)..(378): n is a, c, g, or t
  modified_base (380)..(420): a, c, t, g, unknown or other
  misc_feature (380)..(420): n is a, c, g, or t
tcagtcgtcgctcgcacgaccggtgctcgatttagtatctgatagttgggtttgggatctatggggcatcctacaggatgaccggcatcccagacaggttcagtgccaggtgggtctgggacagacttcactctcaccatcaacacacgtggccgcctagaagtattttgcagttgtaattacgtgtacagtattgtagtgggtacgtccaccgtactaccgtttggaccggtagggaacctaaggtggaatagtacgaggaacgaacgtggtggctagccacctattctgtcttactacttcccgtcccgactattctcgtaccttcgtctcgtaacgtggacggcggtcgtacggactaacggccganaagtcgnngnnnnnnnnnnnnnnnnnnnnnnnnnnnnnnnnnnnnnnnnn

SEQ ID NO: 50682 - DNA, 756 bp, Homo sapiens
  misc_feature: GYAE6OF01A68I1.21.38.D05.1.454.CMB.1.raw
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggccaccctgtctctgtctccgaagggaatgttactctctcctgacaacggccagtcagtagtgttggctacgtcgtacgttcgccgtacggtaaacccaaaacaaaaccgtcggacccgaacggtccccttaccccgtaacggttccctcccttaccgtaacgtttccgtaaggttccggggacctaccgtacccgtaacggtaacgggtacgtaccggacccggtacctaaccgtaccccgaaggtaaccgtacggttacacggtcgaccggtaggtcgggtaccgtacgggaactacggtaccttacgtaccgtccgtacctaacctactaaccgaaacctaccgtaccggtacgggtacccgtacgtaacgtaacgttacgttttacggacgttagtttacgttaactttacggttcgtaacgagtaagttaggtacggttacggtaccggttaaccttaccgtaccgttaccggttacggaccgggtacgggtaaccgtaagggtcgtaagtacgtacggaacggtaacgtacggttcggtacggaccgtacgccgtacggtacg

SEQ ID NO: 50683 - DNA, 327 bp, Homo sapiens
  misc_feature: GYAE6OF01EYNFI.21.38.D05.1.454.CMB.1.raw
  modified_base (319)..(327): a, c, t, g, unknown or other
  misc_feature (319)..(327): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccgaggggaccaaggtggagatcagacgaactggtggctgcaccatctgtcttcatccttcccgcatctgtactcgtctctactgagcgggctggcaaggcgcatagnnnnnnnnn

SEQ ID NO: 50684 - DNA, 735 bp, Homo sapiens
  misc_feature: GYAE6OF01D8JIV.21.38.D05.1.454.CMB.1.raw
tcagtcgtcgctcgcacgaccggtgctcgatttagtatctgatagttgggtttggggcagagctctggagaagagctgctcagttaggacccagagggaaccatggaaaccccagcgcagtcttctcttcctctgctactctggctcccgaggtgtcgaccggagtaagttgtcttgacgcagtctccgagccacctgtctctgtctacggaagggaaatcgttactctctccgtagacaacggccagtcgagtagtgttcgctagtcgtacgttcgtaccgtacggtaaaccaaaacgtaaaaccgtcggaccgacggtcctacccgtacgtccttacctctactcgtacggtcgggacctacgtacctaagaggacgtacgacggactacgtaccgagaccgtacgtacgacgtcgtaccgtagggttcggtacgtacggaacgtacgtaccttcgtacttaccgaacctaaccgaactaaccgaaccgtacgtaccgtcggtaccctacgtaacggtaacgtttactttacgacgtttaagttacgttaacttacggtgaactaaggttagttacggtacgtttacggtaccgttaacccgtaaccgttaaccgtaaccgggttccgggaaaccgggtagggtaaacccgtaaggggtacgtaaaggtctaaacggaaccggtaacggttaacgtcggttacgggacccgttaacgaccgtaccggttaacg

SEQ ID NO: 50685 - DNA, 726 bp, Homo sapiens
  misc_feature: GYAE6OF01EDGR3.21.38.D05.1.454.CMB.1.raw
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctccaggtgtcaccggagaagttgtctgacgcagtctcaggcacctgtctctgtctcgagggaatgttactctctctgacaagccagtcagtagtgttgcatcgacgttgcctaggtaaccaaactaaaaccgtggaccacggcctccccgagttcctcctctactcgtagtcggggactactcctacgaggactacggaccggctacgtaccgagacgtacggttcaggtcgacgtagggtcgggtcgtacggggactaagtaccttacactactaccaaccgtactaccgaacaccgtaccgtcggaccgtaccttaggaacgtttacttttcggaccgtaggtttacgtttaactttacgtcggttactaaggttacgttaggtttaacgggttaggggtttaaccggttaccgtaacccgggtttaaccgttacccgggttttacggggaacccgggtaaaccgggggtaaacccgttaaagggggtacgggtaaaggttaacggttaccggaaacgggtaaccgggtaaacggttcgggttacgggtacccttacggtaccgaacccgtttaaccgg

SEQ ID NO: 50686 - DNA, 726 bp, Homo sapiens
  misc_feature: GYAE6OF01CSXES.21.38.D05.1.454.CMB.1.raw
  modified_base (251)..(251): a, c, t, g, unknown or other
  misc_feature (251)..(251): n is a, c, g, or t
tcagtcgtcgctcgcacgaccggtgctcgatttagtatctgatagttgggtttggggcagagctctggagaagagctgctcagttaggacccagaggaaccataggaaaccccagcgcagcttctcttcctctgctactctggcctcccaggtgtcaccggagtaagttgtcttgacgcagtctccaggcctaccctgtcctctgtcaccgaggggaatgttactctctcctgacgaacggccagtctagngtgttggactatcgtacgttcgctacggtaaccaaacgaaaccgtggaccacggcctacccgtagttcctacctactacgtcgtagtcgggacctacgtaccgtaacgaggtacgtccggaccgtactacgtacccgagtaccgtaaggttacgacggtcgtaccgtaacgggttcgggtacccgtacgggtaacgtaaccgttaccttaccgtaaccgttccttaacccaaacccgtaacttaaacccgaaaccaaccgttacccggtcggtacccgtaacggtaggttaaacgtttacgttttacgccgttaagttacgtttaacttacgtagttcgtaaagttacggttagttaacggttcggttacggtaccgttaacccgtaccttaccggttacgggaccggtaacggggacgtaagggtacggatacgtacgaagtacgttaagtcggaggtactacgcgtacctacg

SEQ ID NO: 50687 - DNA, 356 bp, Homo sapiens
  misc_feature: GYAE6OF01C6EQ9.21.38.D05.1.454.CMB.1.raw
  modified_base (258)..(258): a, c, t, g, unknown or other
  misc_feature (258)..(258): n is a, c, g, or t
  modified_base (342)..(356): a, c, t, g, unknown or other
  misc_feature (342)..(356): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggccgcctagaagtattttgcagtgtattactgtcagatgtatggtagtcaccgtacacttggaccaggggaccaaggtggagatcagacgaacgtgtgctgcaaccgtntcgtgtcttcacgttccttcccgactacgtctgaccttcgtctcctacgtgacgtcgggctcggaccgaaggccgactagtagnnnnnnnnnnnnnnn

SEQ ID NO: 50688 - DNA, 681 bp, Homo sapiens
  misc_feature: GYAE6OF01A94D5.21.38.D05.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctcgagggaaangttactctctctgacaaggccagtcagtagtgttggcatcgacgttgccgtaggtaaccaaacaaaaccgtggaccacggtcctacccacgtcctcctctactacctagtcgggactacgtacctagacgtagtcgaccggactacgtcccgaacgacgtacggttacacggtcgaccgtaggttcgggtcgtcgggaactacggtaccttctactacctacgaccataccaaacactacggtcgaccgtaccgtacggtaagttacgttttcgacgttaagttagtaacgttttaacgtacgttacgaacgttagttaggtaacgtttcgggtaacggttacctaacccgttaccgttaaccggttgggtaacccgaacggggtaacgtaaacggggttaggaaggtacgtaacggacggttaacgtaacgttcgggtacgaccgttcggaccgtaaccgttaccg

SEQ ID NO: 50689 - DNA, 669 bp, Homo sapiens
  misc_feature: GYAE6OF01A6GSM.21.38.D05.1.454.CMB.1.raw
  modified_base (268)..(268): a, c, t, g, unknown or other
  misc_feature (268)..(268): n is a, c, g, or t
  modified_base (318)..(318): a, c, t, g, unknown or other
  misc_feature (318)..(318): n is a, c, g, or t
  modified_base (371)..(371): a, c, t, g, unknown or other
  misc_feature (371)..(371): n is a, c, g, or t
tcagtcgtcgctcgcacgaccggtgctcgatttagtatctgatagttgggttttgggggcagagctctggagaagagcgtgctcagttaggacccagagggaaccatcggaaaccccagcgcgagcttctcttcctcctgctactctggtctcccaggtgtcaccgggagaaagttgtcttgacgcgagtctccaggccaccctgtctctcgtctccgagggaactagttactcctctcctcgcaacgccagtcagtagtgttggacntcgacgtgcctaggtaccaaacaaaccgtgaccaggccacacgtctcctnatctagcgggacactcctacaggactcgaccggcactccaagtacgacgttanaggtcgaccgtaaggtcggtacgtacgggtaactacgtacgttacaccgttacttaccaacctactacaaacctaccgacttacggaccgactaggtaagttacgttttcgacgttagtcgtttaatttcctgtacgtaacgtagttgtaagttacggtacgttacgtaccggttacttaacccggtttacggccgggtaaaacgggtaccgtaaaggggtcggtaactaacggttcgaaacgggtacgttaaacgttcgggtaacggttaccgacggtaaccgttacgttaaacccg

SEQ ID NO: 50690 - DNA, 886 bp, Homo sapiens
  misc_feature: GYAE6OF01BQ5IW.21.38.D05.1.454.CMB.1.raw
tcagtcgtcgctcgcacgaccggtgctcgatttagtatctgatagttgggtttggggcagagctctggagaagagctgctcagttaggacccaggagggaaccatacggaaaccccagcgcagcttctcttcctcctgctactctggcctcccgaggtcgtaccgaccggagtaagtttcgtcttcggacgtcacgtcctccgacggtcctacccgtgtccttctcgtaccgtaccggaaggggtaatacgtttacctcttccgttccgtacgaaccgaacgggtaccctaaggtaccgaaggtaggtttcggtacggaccgtaacgtccggttaacggttccgtacccgtaacgggtaaaacccaaaaaccgtaaaaaccggttcggaccgtaccgggtaccccttacccgtaacgtccccgtttacctacctaacgtttccgtaacgggtccgggtacctaaccctttacccgaaaggtaacgggtacgtaccggaaccggtcctaaccgtaaccggaacggtaaccgttacggggttaccacggtacggtacccggtaggggttccggggtccgtaacggggaacctacgttacccgttcctacgttaccctacgaacccttactaaccaaccgtacggtacgtaccggcccgtaaacgttgtaacggttttacgtttaccggaacgtttaggttaccgtttaacgtttacgtacggttacgtaagttcggttaaggttaacgggtttgggtaacccggttaccctaacggttaccggttaccggttaacgggaccgtaaacgggggtaacgtacggggtagaacgtacgtacgggaaacggtacggtacgttcgggacctacggtaccgccgttccttacgg

SEQ ID NO: 50691 - DNA, 348 bp, Homo sapiens
  misc_feature: GYAE6OF01AY97G.21.38.D05.1.454.CMB.1.raw
  modified_base (316)..(318): a, c, t, g, unknown or other
  misc_feature (316)..(318): n is a, c, g, or t
  modified_base (320)..(348): a, c, t, g, unknown or other
  misc_feature (320)..(348): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtatactgtcagatgtatggtaggtcaccgtacacctttggccaggggaccaaggtggagatcagacgaactgtggctgcaccatctgtcttcatcttcccgcatctgactcgtctctactgacgcggctggcaaggcgacatagcnnncnnnnnnnnnnnnnnnnnnnnnnnnnnnnn

SEQ ID NO: 50692 - DNA, 701 bp, Homo sapiens
  misc_feature: GYAE6OF01CZ66X.21.38.D05.1.454.CMB.1.raw
  modified_base (225)..(225): a, c, t, g, unknown or other
  misc_feature (225)..(225): n is a, c, g, or t
  modified_base (337)..(337): a, c, t, g, unknown or other
  misc_feature (337)..(337): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggctcaagaaaccaccggaagtaattgtagttgacgcagtctccaggccaccctgtcttgtcctcgaaggggaancgccacctctcctgccagcctccagccagaatctaccagacgctaactacattacgccgtaggtaccagcaaggtaacgccgtcggaccacggtcctacccgaggtttcccngacttctatcggcctcgggtacccagacggcctacgtcggctactcccgaagtacgtaggttcgaggtcggactagggttcgggtcgtacgggactaacggtaccttacgtaccttaccgtactaactacgtaagtttaacgacgtaacggtacggttacggacgtaccgttaaggtaacgttacgtttacggagttaacggtttacgtttaacgttacgttggttactaaggtaccttaaggttacgttacgggtaactttacccgtaaccgttcgttaccggttacggttaacccggaaccggtaaaccgggtacgtaaaacgggttaagtaaacggtaacggtaaaacgtacggttacggg

SEQ ID NO: 50693 - DNA, 802 bp, Homo sapiens
  misc_feature: GYAE6OF01CNNSG.21.38.D05.1.454.CMB.1.raw
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcctaccctgtcctctgtctaccgaaggggaaatgttactctctcctgcaaggccagtcagagtgttggctatcgtacgttgcctacggtaaccaaaacaaaaaccgtcggacccacggtcctaccccgacgttccctacctactacgttacgttacggtcggggactacgttaccctaacgaagggtactaccggaacccgggacctaaccgtaccccgtaacggtaaccgtaacggtttccgaacggttacggtacccggtaagggttccgggggttaccgttacgggggtaaacctaacggttaaccctttaccgtacccgtttacccgttaaccctaacccgttaaccttaaccccgaaaccgtacccgtaacccggtccgggtacccggttaaccgtacggttaacgtttacgttttacgggacgttaaggtttacgtttaacttacgttacgtagtacgttagttacgttacggttcgggtaaccgttccgttaacccgtacgttaccggtttaccgggaccggtaaacggggaaccgtaaggggttacgaagtaacgtacggtaaacgtaacggtaacgttcgggtacgtcgtacgacctacgttacg

SEQ ID NO: 50694 - DNA, 331 bp, Homo sapiens
  misc_feature: GYAE6OF01E1VW4.21.38.D05.1.454.CMB.1.raw
  modified_base (316)..(331): a, c, t, g, unknown or other
  misc_feature (316)..(331): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagtattttgcagtgtattactgtcagatgtatggtaggtcaccgtacacctttggccaggggaccaagggtggagatcagacgaactgtggctgcaccatctgtcttcatctcccgcatctgactcgtctctactgagcgggctggcaaggcgcatagnnnnnnnnnnnnnnnn

SEQ ID NO: 50695 - DNA, 559 bp, Homo sapiens
  misc_feature: GYAE6OF01ELXGX.21.38.D05.1.454.CMB.1.raw
  modified_base (423)..(423): a, c, t, g, unknown or other
  misc_feature (423)..(423): n is a, c, g, or t
tcagtcgtcgctcgcacgaccggtgctcgattttagtatctgatagttgggtttgggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaaggggaaagagttactctctcctgcaaggccagtcagagtgttggcatcgacgttgcctaggtaccaaacaaaaacctggaccacggctccccagtcctcctcatctatggggcatcctacaggatgaccggcactaccaagacgtaggttacagtgccaggtgggtcgtagggacagacttcaactctaccaccatacaacacactacggcncctagaagtattttgacagtgtattactgtcaagattagtagtggtaaggtcacgtactaccgtttggacccgaagggggacctaaggggtaggaagatacgaaggacgaaacgtggtacggatgaccacctaacg

SEQ ID NO: 50696 - DNA, 739 bp, Homo sapiens
  misc_feature: GYAE6OF01ASC3A.21.38.D05.1.454.CMB.1.raw
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcgagtctccaggccacctgtctctgtctccgaaggggaaatgttactctctctgacaggcctagtcagagtgtcgcagtcgagttcgccgttacggtaaccaaactaaaaccgtcggaccgacggtcctcccgagtcctcctacattacgtaggtcgggtacctacttacccgtaagtaacggacgttaccggacccggtacctaaccgtacccgtaaggtaaccggtaacggtttaccaacgggttccgaccggtagggttcgggtacggtacgggacgtaacgtacgttccacttcctaccgtaacctacgacctaaaccgacgtaccgtacggcccgtaccgtaaggtaaccgtttaagttttcggaaccgttaaggtttacggttaacttaccggttacgtaataacggtacttacgggttaagttcgggttaaccggtccttaacccggttaccgtcccgtttacggggaaccgttaccggggaaacggttaacgggcggtaacggacgttacggagtaaaccggtcgtaacgttacgggactacgccgttgttacg

SEQ ID NO: 50697 - DNA, 933 bp, Homo sapiens
  misc_feature: GYAE6OF01ESUQP.21.38.D05.1.454.CMB.1.raw
  modified_base (112)..(112): a, c, t, g, unknown or other
  misc_feature (112)..(112): n is a, c, g, or t
  modified_base (424)..(424): a, c, t, g, unknown or other
  misc_feature (424)..(424): n is a, c, g, or t
tcagtcgtcgctcgcacgaccggtgctcgatttagtatctgatagttgggtttgggcagagctctggagaagagctgctcagttaggacccagaggaaccatcggaaacccngcgcagcttctctcctcctgctactctggcctccgaggttcgtcaccgggagtagtttcgtcttcgacgtcagttcctccgacggacctcccgttgttcctccgttcgtaccgtaccgggaaggggtaaactacgtttacctcgttcctccgtacgaccgaacgggcccagtccgaaaggtgttcggttgacctagtccgttacgttcgaccgtacggtaaaccaaaaccgtaaaaccgtcggaaccgcggtacctacccgtacgttcctcctactacgttcgtacggtcgggtactacgtacctacgaggntaccgccgacacaccgaggactacggtcgacggtcgaccggtaggttcgggtcgtacggaacgtacgtactttaccgaccttaccgtaaccaacccgtaacctaaccgtaaccctaccgttaccccgtacggtacccggtaccgttaagtaacggtttacgttttacggacgtttagggttaacctttaaccgggtttttaactacgggtttacggtaacggtttaacgggttaacggtttacggggtttaaacccggggttaccgttaaccgggtttaacccccgggtttaaacggttttaccccggggtttacccggggggtaaacccggtaaacccggggggggttaaaacccgttttaacggggggtacgggttaaacccggttaaacgggttaacccgggtaaaacccggggtttaaacccggttaccccgggggttaaacgggtaccggggtttaccccggtaaaccggttaaacccccggttaaacggtttaaacccccggg

SEQ ID NO: 50698 - DNA, 734 bp, Homo sapiens
  misc_feature: GYAE6OF01BLV3R.21.38.D05.1.454.CMB.1.raw
tcagtcgtcgctcgcacgaccggtgctcgatttagtatctgatagttgggtttggggcagagctctggagaagagctgctcagttaggacccagagggaaccatcggaaaccccagcgcagcttctcttcctctgctactctggctcccgaggtgtccacggagtaagttgtctgacgcagtctcgaggccacctgtctctgtccgtaccggaaggggaaatacgttactctcctctgacgaacggcagtcgagtagttgttggactagtcgtacgtcgtaccgtacggtaaaccaaaaccgtaaaaccgtcggaccacggtccctacccgtacgtcccttaccgtactaacgttaccgttacggtcgggtacctaacgtaccccgtaagaacgggtacgtaccggacccgtactaccgtacccgaacgtaacgtacggttacaacggtcggtaaccgtagggttacggtacggtacggggtaacctacggtaccttactaccgttactacccgaacctacgtaaccaaccgtacgtacggtcggacctacggtaagttaacgtttacgtttacgacgttaggttagttaacttacgtgtactaggtaattaggtacggttacggtacgtacctaaccggttacctacggttacggaccgggtaaacgggtaaccgtaagggtcgaaggtactcgaacgtaagtacgttcggacggtctaacggcctaaggtcg

SEQ ID NO: 50699 - DNA, 584 bp, Homo sapiens
  misc_feature: GYAE6OF01EZ15B.21.38.D05.1.454.CMB.1.raw
  modified_base (217)..(217): a, c, t, g, unknown or other
  misc_feature (217)..(217): n is a, c, g, or t
  modified_base (447)..(447): a, c, t, g, unknown or other
  misc_feature (447)..(447): n is a, c, g, or t
tcagtcgtcgctcgcacgaccggtgctcgatttagtatctgatagttgggtttgggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaanagttactctctcctgcaaggccagtcagagtgttggcatcgacgttcgcctggtaaccaaaccaaaaaccgtggaccacggcctccccacgttcctccctcaagtcctaagtcgggggactactaccctacagggatcgaccggcgactcccgaagacaggttcagtgccagtgggtcgtagggacagtacttcactctacaccatccaacacactggccactagaagtntttcgacctagtagtactttactcgtacagtaatgtagtagggttacgtcgaacccgtactaccgttggaccggtacgggaaccgtaagggtcggagacgtcgaacggaaacgacgtggtacgagtcgacaccgtac

SEQ ID NO: 50700 - DNA, 705 bp, Homo sapiens
  misc_feature: GYAE6OF01DEBV6.21.38.D05.1.454.CMB.1.raw
  modified_base (573)..(573): a, c, t, g, unknown or other
  misc_feature (573)..(573): n is a, c, g, or t
  modified_base (583)..(583): a, c, t, g, unknown or other
  misc_feature (583)..(583): n is a, c, g, or t
tcagtcgtcgctcgcacgaccggtgctcgatttagtatctgatagttgggtttggggcagagctctggagaagagctgctcagttaggacccagaggaaccagtacggaaaccccagcgcagtcttctcttcctctgctactctggcctccgaggtcgtccgaccggagtagttgtcttgacgtcgagtcctcgagcctacctgtctctgtctacggaaggtaatcgttactctcctccgtgacgacgccgtagtacgagtcggttgtcgactgtccgtagtcgaccgtacggtaaaccaaactaaccgtcggacctacgcccgttaccacgttccgtccctagtacgtaccgttaggcggtacctaccgttaaccgacgtaggttaccgaccggtacccgacctaccgtaccgtaaggtaacctttgggtaccacggttaccgacgtagggtccgggtacgtaggtacctacggtaaccttccgaccttaaccgttccaaccgttaactacccgaaacgtccgtaacggcggtacctcggttaagtaagttttccgtagtaccgttaggttnttaacgtcgntaagcgttagttcgtacgtagggtacttccaaccggttcgttacgagggtaccgggtagaacggtttaggcaagtacacggacggtacgttacgtggggcttaccgcggttaaacccggttc

SEQ ID NO: 50701 - DNA, 696 bp, Homo sapiens
  misc_feature: GYAE6OF01CQW7D.21.38.D05.1.454.CMB.1.raw
  modified_base (338)..(338): a, c, t, g, unknown or other
  misc_feature (338)..(338): n is a, c, g, or t
  modified_base (645)..(645): a, c, t, g, unknown or other
  misc_feature (645)..(645): n is a, c, g, or t
  modified_base (676)..(676): a, c, t, g, unknown or other
  misc_feature (676)..(676): n is a, c, g, or t
tcagtcgtcgctcgcacgaccggtgctcgatttagtatctgatagttgggtttggggcagagctctggagaagagctgctcagttaggacccagagggaaacatcggaaaccccagcgcagtcttctcttccctcctgctacctctcggccttcccaaggtgtcaccggagtaagttgtctgacgcaggtctccgaggccaccctgtctctgtcctaccgaggggaaatacgttactcttctccgtgacgaacggcctagtcaggtacgtgtgcagtcgtacgtcgctacggtaacaaacaaaccgtcggaccacgtcctaccgacgtcctacctacncgtactaggtcgggactactaccgtaacgaggtacgtacggacccggactacctacccggaacggtaaccgttacggttacccgagttccgcgtaagggtcgggtaccggtagggaactacggtacttccgtaacttcgaacctacctaccgtaaccgtaacctaccgacgtccggccgtaaccgtagttaagtcgtttgacgtattcgttaacttcgttagtcgtaagtgttacgtagggtaccgtagtacccttacgtaccgtacgttaccgggccggaagggtaacggtagggtacgacggtanaccggtaacgtaacggttacgtgggaccgtntaacccgccgtacgttaccg

SEQ ID NO: 50702 - DNA, 801 bp, Homo sapiens
  misc_feature: GYAE6OF01EAWTU.21.38.D05.1.454.CMB.1.raw
  modified_base (517)..(517): a, c, t, g, unknown or other
  misc_feature (517)..(517): n is a, c, g, or t
tcagtcgtcgctcgcacgaccggtgctcgatttagtatctgataggttgggtttggggcagagctctggagaagagctgctcagttacggacccaggacgggaaccagtacggaaaccccagccgcagccttctccttcctcctgctactcgtggcctccgaggtcgtcgaccggagtagttgtctcgacgctacgtcctaccgacggcctacccgtgtcctcgtcgtaccgtaccggaaggggtaaatcgtttactccttaccgtctacgaccgaacggtcctaggtacgaaggttagttcggtacgactacggtccggtacgttcgtacccgtaacggtaaacccaaaacgaaccgtcggacctaccgtccctaccgtacttccctacctacgtatacgttacggcggtacctactaccgtagtagacgtccgaaccgcacccgtacgacgtaacggtcgttacgcgtctcggtacgggtggcgtaaggactactcttaccacctaccgtaaccncctaacacctacgacgtccgacgggtacctagtaacggtttagttaccgttgaccgttttacgttactttacgtaacgttcgaaacggtagtttggttaacggtttaccgggttaacggtaacccgggtttaacccttaacccgggttccggtttaccgggttaaacccgggaccgggggttaaaccgggtaaaacgttcggtaaagggttacaaccgggtaaactaccggggttaaatccgggttacggtacggtaccttacccggaactttaccggttaccg

SEQ ID NO: 50703 - DNA, 684 bp, Homo sapiens
  misc_feature: GYAE6OF01AUEMI.21.38.D05.1.454.CMB.1.raw
  modified_base (220)..(220): a, c, t, g, unknown or other
  misc_feature (220)..(220): n is a, c, g, or t
  modified_base (248)..(248): a, c, t, g, unknown or other
  misc_feature (248)..(248): n is a, c, g, or t
  modified_base (361)..(361): a, c, t, g, unknown or other
  misc_feature (361)..(361): n is a, c, g, or t
  modified_base (369)..(369): a, c, t, g, unknown or other
  misc_feature (369)..(369): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtcgtcaccggagaagttgtcttgacgcagtctccaggccaccctgtctctgtctaccgaaggggaaanttactctctcctgcaaggccagtcaggntgttgacatcgacgttgccgtaggtaccaaacaaaaccgtcggaccaggcctccagtcctcctcactctagtcgggacactcctacgagagtcgaccggcacgtcccaagacncggttacngtacgccgtaggtcggttcgtagggacacggtacctacgaccttcctacgtaacctactacccaactaccgtacgttccgggacctaccgtaggtaactttcgttttaggacctttacggttagttaacgtttaccgtcgggttaccgtaagtagtttacggttacgttaggggttaccgtaacccgttaaccggttacccgttaccggtttccgggaccgggtaaccggggtaaaccgtaggggtacggtaatcggtaaccgtaacgggaccttaacgggtcggttacggtacctcggtacccgtaaccgttcg

SEQ ID NO: 50704 - DNA, 1072 bp, Homo sapiens
  misc_feature: GYAE6OF01AONWE.21.38.D05.1.454.CMB.1.raw
tcagtcgtcgctcgcacgaccggtgctcgatttagtatctgatagttgggtttggggcagagctctggagaagagctgctcagttaggacccagagggaaccatggaaaccccagcgcagcttctcttccctcctgctactctggcctcccaggtcgtcgaccggagtaagttgtcttgacgtcagtcctccgagccacctgtcctctgtcctaccgaaggggtaaatcgttactccttcctccgtgaccgaacggccacgttcaaggtagttggttggcctagttaccggtacgttcggtacccgttacggtaaaacccaaaaaccctaaaaaccggtccggtaacccgtaccgggccccttaacccccgtacggttaccccgttcccttaacgtaacgttaccggttacgggtaccggggaccttaacccgttccccggttaaaaacggcgggtaacgttaccccgggaaccccggtaaccttacccgtaaccccggtaaggtaacccggttacggttaacccggtacgttcccgggtaacgggttacgggttccggggtacccggtttacgggaaaccgttaaccggtccctttacccggaaccgttacccctttaaccccggaaacttaacccttaaccccgtaaaaaccgtccccgttaaccgggggttaacccggtaccccttaacccgggttaaagggtttaaccgtttttacggtttttaaccgaacccggtttaaggttttaccgttttaaacccgttttacgggtacgtttaaacccgggttaagtttacggggttttaaaccccggtttaaggggtttaaccggtttaacccgggaacccccgttttaaaacccccggttacccgggttttaaaccccggggtcggggtaaaaccccggggttaaccccggggggaaaagtttaaccccggggggtaagggtaaacccggtttaaacccggaacccggggttaaaaaaccgggttaaaacccgggtcggttttaacccgggggaccggtttaccgtcccccgtaaacccggtttaccggtttaacccccgg

SEQ ID NO: 50705 - DNA, 667 bp, Homo sapiens
  misc_feature: GYAE6OF01ERCL1.21.38.D05.1.454.CMB.1.raw
  modified_base (328)..(328): a, c, t, g, unknown or other
  misc_feature (328)..(328): n is a, c, g, or t
tcagtcgtcgctcgcacgaccggtgctcgatttagtatctgatagttgggtttgggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaagagttactctctcctgacaaggccagtcagagttgttggcatcgacgttgcctggtaaccaaacaaaacctggccaggcctccagtctcctcatctagtcgggcactcctanaggagtacgaccggcactcccagacgtagtacgagtcgccgaggtcgggtcgtcgggactacgtacttccacgttcctacaacctataccaacactacgtcggccgtaccgtagtaagttactttcgacgtagttacgttaagtttaccgtggttactaagtcgttaggttacggttagggtttaacggttaccgtaacccggttaaccgttaccggtttaccgggacccggtaaaccggggggtaacccgttaaagggggtcggtaacggtaacgtaccggtaaacggtaaccggtaacggttcggtacgggtcctaacgtcccgtaaccgttaccgg

SEQ ID NO: 50706 - DNA, 688 bp, Homo sapiens
  misc_feature: GYAE6OF01BJCSJ.21.38.D05.1.454.CMB.1.raw
  modified_base (500)..(500): a, c, t, g, unknown or other
  misc_feature (500)..(500): n is a, c, g, or t
tcagtcgtcgctcgcacgaccggtgctcgatttagtatctgatagttgggtttgggatctatgggcatcctacaggatgaccggcatcccagacacggttcagtgccagtgggtctgggacagactacacgtctcaccatcaacgacactggcgcctagaacgtattttgctagtgtattacgtgtcagactgtacgtggtacggttccaaccgtactaccgtttggaccgtaaggggaacctaaggttcggaagaattccgaagaacggtaaaccgtggtacggtacctaggtaccaacccgtagttaccgttcggtaccttacgtaaaccgttcccgtttaccccgaccgtaacttaccgtaaccggtaaccttccgttaccgttaccttaacggttacggaaccggtcgggtaccgttaggaacccgtaagggccgtaaccgtaaacgttggaccacggatacggagtataggctagtccgataacctgactaacgngactacacgtacgtacgacgacgacgtacgtacgtacgtacgtatactacgtactacgtactacgtacgtactacgtatacgtacgtacgtacgtacgtacgtagacgtacgtagtacgacgtagacgtacgtacgtacgtacgacgacgtactacgtacgtacgtacgtactacgtctcgtactacg

SEQ ID NO: 50707 - DNA, 875 bp, Homo sapiens
  misc_feature: GYAE6OF01EYAGG.21.38.D05.1.454.CMB.1.raw
  modified_base (155)..(155): a, c, t, g, unknown or other
  misc_feature (155)..(155): n is a, c, g, or t
  modified_base (186)..(186): a, c, t, g, unknown or other
  misc_feature (186)..(186): n is a, c, g, or t
  modified_base (686)..(686): a, c, t, g, unknown or other
  misc_feature (686)..(686): n is a, c, g, or t
tcagtcgtcgctcgcacgaccggtgctcgatttagtatctgatagttggggtttggggcagagctctggagaagagctgctcagttacggacccagaggaaccatacggaaaccccagcgcagtcttctcttcctcctgctactctggcctccgnggtgtcacggagagttgtctgacgctagtcnccgacggcctaccctgtcctctacggtcctaccggaaaggggaaacttacgtttacctccgttaccgtaccgtacggaccgaacggcctaagttaccaaggttaggttcggttcggacgtacgtacggttaccggttccgtacccgtacggtaaaaccctaaaaccgtaaaacccggtaccggacccgtaaaaaccggtccccgttaaccccgtaccggttccccgtaccctaccgttacgttaccgtacgggtccggggtaaccttaccgttaacccggtaacggtaacgggtacggtaacccggtaacccggtaccgtaacccgtacccggtaacggtaaccggttaacggttacgtaaccggtacgtaccggttacgggtcgggtaacggtaccgggtaacgtaccggtaccttaccgtaccctaccgtacctaacccgtaacctaacctaaccgaccgtaccgtaccgtaccgtacgttacgtaagttacgtttanacgtagtttacttacgttacgtcgtaaggtacgttaagttacggttagtacggttaccgtaccgttaacccgttaacggttacccggttaccgggtaaccgggtaacgggtaacggttacgggtacggtaaggtacgtaacggtaccgtaaggtaacgtcgggttacgaccgtacgtaccgtcgttacg

SEQ ID NO: 50708 - DNA, 737 bp, Homo sapiens
  misc_feature: GYAE6OF01B8BXV.21.38.D05.1.454.CMB.1.raw
tcagtcgtcgctcgcacgaccggtgctcgatttagtatctgatagttgggtttgggggcagagctctggagaagagctgctcagttaggacccagagggaaccatcggaaaccccagcgcagcttctcttcctcctgctactctcggcctcccgaggtcgtccgaccggagtaagttcgtcttgacgcacgtcctccgaggcctaccgtcgtctcgtgtccgtaccggaaggggaatacgttacctctcctccgtagacgacggccagtcgaggtgtggtcggacgtagtccggtacgttcgaccgttacggtaaacccaaacaaaaccggtcggaccacggtcctccgacgttcctcctctactacgtacggtcgggtactacgtaccgacgtaacgggacgtaccggaccgactacctaccggtaacgtaccgttaacggttcgaacggtccgtaccgggtacgggtacggttcggtacgggaaccttagttacccgttcctaccgttacctaccgaaccctaacgtaccgaacctaccgtacgtcggacctagttaacgtagttacgtttagacgtagtttagttacgttcgtacgtagaggttacttggttaacgggttcggtaccgttaccgtaaccgttacggtacggttacgggccgggtaacgggacgtacgggcgtaggtagtacgtaacggacgttacggtcggtacgtaccgacggtctacgttcg

SEQ ID NO: 50709 - DNA, 687 bp, Homo sapiens
  misc_feature: GYAE6OF01EKEIQ.21.38.D05.1.454.CMB.1.raw
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagagttgtcttgacgcagtctccaggcaccctgtctctgtctcgagggaatgttactctctctgacaaggccagtcagagtgtgcatcgacgttgccgtacggtaaccaacaaaacctggaccacggcctaccccgtagttcctcctactacgtcgtaggtcggggcacgtacctacgaggtacgtggtacccggctaactcccgaagaccgtacggttacacggttcgaccgtagggttcggtcgtaggggactacgtaccttcacctcacaccctatacaacaccgtagtcggaccgtaccgtagtaacgttagttttcgacgttagttcttaacgtttactaggtacgtagtagttacggttagttacgggttaacgtacccgttaacccggttaacgacccgggttttacggaaccgggtaacgggggtaaaccgtaagggggtacgggtaaactacggtaacccggaaagggaacccggttaacgttcggggtacggaccgttccgggaccttaccgtacg

SEQ ID NO: 50710 - DNA, 594 bp, Homo sapiens
  misc_feature: GYAE6OF01BB4PI.21.38.D05.1.454.CMB.1.raw
  modified_base (446)..(448): a, c, t, g, unknown or other
  misc_feature (446)..(448): n is a, c, g, or t
  modified_base (450)..(450): a, c, t, g, unknown or other
  misc_feature (450)..(450): n is a, c, g, or t
  modified_base (452)..(452): a, c, t, g, unknown or other
  misc_feature (452)..(452): n is a, c, g, or t
  modified_base (467)..(467): a, c, t, g, unknown or other
  misc_feature (467)..(467): n is a, c, g, or t
  modified_base (482)..(482): a, c, t, g, unknown or other
  misc_feature (482)..(482): n is a, c, g, or t
  modified_base (516)..(516): a, c, t, g, unknown or other
  misc_feature (516)..(516): n is a, c, g, or t
  modified_base (518)..(518): a, c, t, g, unknown or other
  misc_feature (518)..(518): n is a, c, g, or t
  modified_base (520)..(520): a, c, t, g, unknown or other
  misc_feature (520)..(520): n is a, c, g, or t
  modified_base (547)..(547): a, c, t, g, unknown or other
  misc_feature (547)..(547): n is a, c, g, or t
  modified_base (552)..(552): a, c, t, g, unknown or other
  misc_feature (552)..(552): n is a, c, g, or t
  modified_base (560)..(560): a, c, t, g, unknown or other
  misc_feature (560)..(560): n is a, c, g, or t
  modified_base (590)..(590): a, c, t, g, unknown or other
  misc_feature (590)..(590): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctagaagattttgcagtgtattactgtcagcagtatggtagctcacctccatcgtaacacttttggaccgtaggggaaccaaggtagggtaaaatacgaaaaccggtaactagttaggacgttgaccgaaccgtaataccttagttaccttacgactttaccctttaccccgacctattaccgttacgaaccgtttaccggtccttacgttacccgttaggtaacgggacccggggttctagggacccggaaaacgggttcggaacctaagtacgggaagtcagatacggatnnnananacgactacgagaganacagtatcgacaganagagacacgacgatatacgacgtagagacgatanananagtactagcgcgctacacgtacactanagtanactcgtanactacgtacgtagactacgtacagtactcntacg

SEQ ID NO: 50711 - DNA, 779 bp, Homo sapiens
  misc_feature: GYAE6OF01EVQGH.21.38.D05.1.454.CMB.1.raw
  modified_base (154)..(154): a, c, t, g, unknown or other
  misc_feature (154)..(154): n is a, c, g, or t
tcagtcgtcgctcgcacgaccggtgctcgatttagtatctgatagttgggtttggggcagagctctggagaagagctgctcagttaggacccagagggaaccatacggaaaccccagcgcagcttctcttcctcctgctactctgctccaggtntcaccggagagttgtcttgacgctacgtctccgaggcctaccctgtctcgtcgtccgtaccggaaggggaaatcgttacctcctctcctagacgaacgtccgagtcgagtaggttcggttcggactagtccgtacgttcgaccgtacgtaaaccaaaaccgtaaaccgtcggacctacggacctacccgtacgtcctacctactacgttcgtacggtcgggacctacgtacccgtaacgacggtacgtaccggtacccggactaccgtacccgaaaggttaccggttacgggttacgaacgtccgtaccggtaggggttccgggtacgtacggggaactaacggtaccttaccgtaccttaccgtaccaacctacgtaaccgaacgtacgtaccgtacggacctacggttaacgtaacgtttcgtttacgacgttacggttacgttacgttacgtagtacgtagttacgttacggtacggttaacgggtaccttaccggtaacccgttaaccgttaccgggttaccgggaacccggtaacggggtaacccgtaagggtaccgtaggtaaccgtaagggaaaccgtaacgtacggtcggtacggacttaccgaaccctcggttacg

SEQ ID NO: 50712 - DNA, 918 bp, Homo sapiens
  misc_feature: GYAE6OF01ERLJI.21.38.D05.1.454.CMB.1.raw
tcagtcgtcgctcgcacgaccggtgctcgatttagtatctgatagttgggtttgggcagagctctggagaagagctgctcagttaggacccagaggaaccatcggaaaccccagcgcagtcttctcttcctcctgcctactcgtggcctcccgaggtgtcgaccggagtagttgtcttgacgtcagtctccgaggcctaccctcgtcctcgttcgtaccgtaccggaaggggtaaacgtacgtttaccgtcctccttcccgttcggaccgaaaccgggtcccgtaacggttaccgaaggtacgggttttggtttacgggaccgtaacggttccggttaccgggtttaccgttaccccggttaaccgggttaaaaccccctaaaaaaccgtaaaaaccccgtaccgggtaccccgtaaccgggtccccgttacccccgtaccggttaccccttacccgttacccgtaccggttaccgtacgggttccggggtacctacccggttaccgtaaccggtaacggtaccgtaccggtacccggtacctaacccgtacccgaacggtaaccggtacggttaaccgtaacggtcggtaccggtacgggttcgggtacggtacggggaccgtacgttaacccgttccgtacccgttcctaccctaaccgttacctaaccgaaaccctaccggtacccggttacggacccgtaccggttaaacgttacgtttacggtttacgacgttaacggtttcgttaacgtttacggttacgtacgttaagtagttaggttaaggttcggttaaccgttacccgtaaccgttaccggttaccgtcggaaccgggtacgggtaacggtagggtaacggtacgtaacgtaacggacgtaccggtagtacggtacgtaccgtccgtcgtaccgtccg

SEQ ID NO: 50713 - DNA, 319 bp, Homo sapiens; identical to SEQ ID NO: 50602
  misc_feature: GYAE6OF02F2DM7.21.38.D05.1.454.CMB.1.raw
  modified_base (316)..(319): a, c, t, g, unknown or other
  misc_feature (316)..(319): n is a, c, g, or t

SEQ ID NO: 50714 - DNA, 318 bp, Homo sapiens; identical to SEQ ID NO: 50599
  misc_feature: GYAE6OF02GVSAF.21.38.D05.1.454.CMB.1.raw
  modified_base (314)..(318): a, c, t, g, unknown or other
  misc_feature (314)..(318): n is a, c, g, or t

SEQ ID NO: 50715 - DNA, 321 bp, Homo sapiens
  misc_feature: GYAE6OF02F1LX5.21.38.D05.1.454.CMB.1.raw
  modified_base (316)..(321): a, c, t, g, unknown or other
  misc_feature (316)..(321): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttcccgccatctgactcgtctctactgagcgggctggcaaggcgcatagnnnnnn

SEQ ID NO: 50716 - DNA, 324 bp, Homo sapiens
  misc_feature: GYAE6OF02I8FEA.21.38.D05.1.454.CMB.1.raw
  modified_base (314)..(324): a, c, t, g, unknown or other
  misc_feature (314)..(324): n is a, c, g, or t
tcagtcgtcgctcgcacgaccggtgctcgatttagtatctgatagttgggtttgggatctatgggcatcctacaggatgaccggcatcccagacaggttcagtgccagtggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttcccgccatctgactcgtctctactgagcgggctggcaaggcgcatagnnnnnnnnnnn

SEQ ID NO: 50717 - DNA, 319 bp, Homo sapiens; identical to SEQ ID NO: 50602
  misc_feature: GYAE6OF02GK9AH.21.38.D05.1.454.CMB.1.raw
  modified_base (316)..(319): a, c, t, g, unknown or other
  misc_feature (316)..(319): n is a, c, g, or t

SEQ ID NO: 50718 - DNA, 521 bp, Homo sapiens
  misc_feature: GYAE6OF02GXJLH.21.38.D05.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccagggggaaangttactctctcctgcaaggccagtcagagtgttggcatcgacgttgcctggtaccaacaaaacctggccaggctcccagtctcctcatctatggggcatcctacaggatgaccggcatcccagacaggttcagtgccagtgggtctggggacagacttcactctcaccatcaacacactggcgcctgaagtattttgctagtgtattactgtcagatgtatggtagtcaccgtacaccgtttggcctaggggaccaagggtcggaagacgtcgaagacggtaactggtaggctaggccacgtacg

SEQ ID NO: 50719 - DNA, 318 bp, Homo sapiens
  misc_feature: GYAE6OF02GRF8I.21.38.D05.1.454.CMB.1.raw
  modified_base (316)..(318): a, c, t, g, unknown or other
  misc_feature (316)..(318): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttcccgccatctgactcgtctctactgagcgggctggcaaggcgcatagnnn

SEQ ID NO: 50720 - DNA, 319 bp, Homo sapiens
  misc_feature: GYAE6OF02HXH9I.21.38.D05.1.454.CMB.1.raw
  modified_base (315)..(319): a, c, t, g, unknown or other
  misc_feature (315)..(319): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccagggaccaaggtggagatcagacgaactgtggctgcaccatctgtcttcatcttcccgccatctgactcgtctctactgagcgggctggcaaggcgcatagnnnnn

SEQ ID NO: 50721 - DNA, 322 bp, Homo sapiens
  misc_feature: GYAE6OF02F6ZMQ.21.38.D05.1.454.CMB.1.raw
  modified_base (315)..(322): a, c, t, g, unknown or other
  misc_feature (315)..(322): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttcccgcatctgactcgtctctactgagcgggctggcaaggcgcatagnnnnnnnn

SEQ ID NO: 50722 - DNA, 505 bp, Homo sapiens
  misc_feature: GYAE6OF02HPUD6.21.38.D05.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaanagttactctctcctgcaaggccagtcagagtgttggcatcgacgttgcctggtaccaacaaaaacctggccaggctcccagtctcctcatctatggggcatcctacaggatgaccggcatcccagacaggttcagtgccagtgggtctgggacagacttcactctcaccatcaacacactgcgcctgaagatttgcagttgtattactgtcagatgtatggtagtcaccgtacactttggccgaggggaccaagggtggagatcgagacgaactggtagctcgcactacg

SEQ ID NO: 50723 - DNA, 321 bp, Homo sapiens; identical to SEQ ID NO: 50715
  misc_feature: GYAE6OF02HE7HQ.21.38.D05.1.454.CMB.1.raw
  modified_base (316)..(321): a, c, t, g, unknown or other
  misc_feature (316)..(321): n is a, c, g, or t

SEQ ID NO: 50724 - DNA, 502 bp, Homo sapiens
  misc_feature: GYAE6OF02G33G4.21.38.D05.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggctcccagtctcctcatctatggggcatcctacaggatgaccggcatcccagacaggttcagtgccagtgggtctgggacagacttcactctcaccatcaacacactggcgcctgaagtatttgctagtgtattactgtcagatgtatggtagtcaccgtacacctttggccagggaccaagggtggagagtcgagacgactgtggctgccactac

SEQ ID NO: 50725 - DNA, 319 bp, Homo sapiens; identical to SEQ ID NO: 50602
  misc_feature: GYAE6OF02HEGDD.21.38.D05.1.454.CMB.1.raw
  modified_base (316)..(319): a, c, t, g, unknown or other
  misc_feature (316)..(319): n is a, c, g, or t

SEQ ID NO: 50726 - DNA, 606 bp, Homo sapiens
  misc_feature: GYAE6OF02H7GM5.21.38.D05.1.454.CMB.1.raw
  modified_base (218)..(218): a, c, t, g, unknown or other
  misc_feature (218)..(218): n is a, c, g, or t
  modified_base (224)..(224): a, c, t, g, unknown or other
  misc_feature (224)..(224): n is a, c, g, or t
tcagtcgtcgctcgcacgaccggtgctcgatttagtatctgataggttgggtttggggcagagctctggagaagagctgctccagttaggacccagagggaaccatggaaaccccagcgcagcttctcttcctcctgctactctggctcccaggtgtcaccggagaagttgtcttgacgcagtctccaggcaccctggtctctgtctccaggggaaangttacnctctcctgcaaggccagtcagagtgttggcatcgacgttgcctggtaccaacaaaacctggccaggctcccagtcctcctcactctagtcgggcatccgtacacggatcgaccggcactcccagaccgtaggttcaggtcgaccgtaggtcgggtcgtggaacacggtaccttcgaactctaccaccgtactaccaaacacgacgttggccgtacctagtaacgtacgttttgactagtgttaattactagttctagtattgtagtggttaggtaccgtaccgtacgtaccgtttggaccgtaggggtaaccgtaagggtcggaacgtacgtacgtaaggaaccgtaacgttcggtacggtacgttacgacccgtactaccg

SEQ ID NO: 50727 - DNA, 324 bp, Homo sapiens
  misc_feature: GYAE6OF02GA62C.21.38.D05.1.454.CMB.1.raw
  modified_base (315)..(324): a, c, t, g, unknown or other
  misc_feature (315)..(324): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttcccgcatctgactcgtctctactgagcgggctggcaaggcgcatagnnnnnnnnnn

SEQ ID NO: 50728 - DNA, 320 bp, Homo sapiens
  misc_feature: GYAE6OF02H3XJB.21.38.D05.1.454.CMB.1.raw
  modified_base (314)..(320): a, c, t, g, unknown or other
  misc_feature (314)..(320): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttccgccatctgactcgtctctactgagcggctggcaaggcgcatagnnnnnnn

SEQ ID NO: 50729 - DNA, 521 bp, Homo sapiens
  misc_feature: GYAE6OF02G2TT7.21.38.D05.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggctcccagtctcctcatctatggggcatcctacaggatgaccggcatcccagacaggttcagtgccaggtgggtctggggacagacttcactctcaccatcaacacactggcgcctgaagtattttgctagttgtattactgtcagtatgtagtggtagtcaccgtactaccgtttggccgaggggacctaagggtggaagatcgaggtacgaacgttggtggactggccactcg

SEQ ID NO: 50730 - DNA, 519 bp, Homo sapiens
  misc_feature: GYAE6OF02JE7BT.21.38.D05.1.454.CMB.1.raw
  modified_base (216)..(216): a, c, t, g, unknown or other
  misc_feature (216)..(216): n is a, c, g, or t
  modified_base (401)..(401): a, c, t, g, unknown or other
  misc_feature (401)..(401): n is a, c, g, or t
tcagtcgtcgctcgcacgaccggtgctcgatttagtatctgatagttgggtttggggcagagctctggagaagagctgctcagttaggacccagagggaaccatgggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaaacctggccaggctcccagtctcctcatctagtgggcatcctacaggatgaccggcatcccagacaggttcagtcgccaggtgggtctgggacagacttcactctcaccatcaacacactggcncctagaatatttgctagtgtattactgtcagtattgtagtggtacgtctaccgtactaccgttggcccgaggggaccaagggtggagatcgaagacgaacgtggtggctcgccactag

SEQ ID NO: 50731 - DNA, 349 bp, Homo sapiens
  misc_feature: GYAE6OF02JFYV8.21.38.D05.1.454.CMB.1.raw
  modified_base (312)..(312): a, c, t, g, unknown or other
  misc_feature (312)..(312): n is a, c, g, or t
  modified_base (318)..(319): a, c, t, g, unknown or other
  misc_feature (318)..(319): n is a, c, g, or t
  modified_base (321)..(321): a, c, t, g, unknown or other
  misc_feature (321)..(321): n is a, c, g, or t
  modified_base (323)..(349): a, c, t, g, unknown or other
  misc_feature (323)..(349): n is a, c, g, or t
tcagtcgtcgctcgcacgaccggtgctcgatttagtatctgatagttggggtttggggatctatcggggcatcctacaggatgaccggcatcccaggacaggttcagtgccagtgggtctgggacagacttcactctcaccatcaacacactggcgcctgaagattttgcagtgtattactgtcagatgtatggtagtcaccgtacacctttggccaggggaccaaggtgagatcagacgaactgtggctgcaccatctgtcttcatccttccgccatctgactcgtctctactgagcgggctggcaaggcncatagnngncnnnnnnnnnnnnnnnnnnnnnnnnnnn

SEQ ID NO: 50732 - DNA, 499 bp, Homo sapiens
  misc_feature: GYAE6OF02HOMLC.21.38.D05.1.454.CMB.1.raw
  modified_base (216)..(216): a, c, t, g, unknown or other
  misc_feature (216)..(216): n is a, c, g, or t
  modified_base (451)..(451): a, c, t, g, unknown or other
  misc_feature (451)..(451): n is a, c, g, or t
  modified_base (488)..(488): a, c, t, g, unknown or other
  misc_feature (488)..(488): n is a, c, g, or t
  modified_base (492)..(492): a, c, t, g, unknown or other
  misc_feature (492)..(492): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccagggggaaangttactctctcctgcaaggccagtcagagtgttggcatcgacgttgcctggtaccaacaaaaacctggccaggctcccagtctcctcatctatggggcatcctacaggatgaccggcatcccagacaggttcagtgcagtggtctgggacagacttcactctcaccatcaacacactgccgcctagaagtattttgctagttgtattactgtcagatgtatggtagtcacgtacncgttgccgagggacaaggtggagatcgagacgactgngtcngcactag

SEQ ID NO: 50733 - DNA, 517 bp, Homo sapiens
  misc_feature: GYAE6OF02GJYDJ.21.38.D05.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaaacctggccaggcctcccagtctcctcatctagtggggcatcctacaggatcgaccggcactcccagacaggttcagtcgcagtgggtctgggacagacttcactctcaccatacaacacactggcgcctagaagtattttgctagtgtattactgtacagatgtatggtagtcacgtacacgtttgaccgagggtacagggtggagatacgagacgaacgtggtacggctcgacactacg

SEQ ID NO: 50734 - DNA, 319 bp, Homo sapiens
  misc_feature: GYAE6OF02HSU94.21.38.D05.1.454.CMB.1.raw
  modified_base (309)..(309): a, c, t, g, unknown or other
  misc_feature (309)..(309): n is a, c, g, or t
  modified_base (315)..(319): a, c, t, g, unknown or other
  misc_feature (315)..(319): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttcccgccatctgactagtctctatgagcgggctggcaaggcncatagnnnnn

SEQ ID NO: 50735 - DNA, 320 bp, Homo sapiens
  misc_feature: GYAE6OF02FOURX.21.38.D05.1.454.CMB.1.raw
  modified_base (315)..(320): a, c, t, g, unknown or other
  misc_feature (315)..(320): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttcccgcatctgactcgtctctactgagcgggctggcaaggcgcatagnnnnnn

SEQ ID NO: 50736 - DNA, 543 bp, Homo sapiens
  misc_feature: GYAE6OF02FK32V.21.38.D05.1.454.CMB.1.raw
  modified_base (221)..(221): a, c, t, g, unknown or other
  misc_feature (221)..(221): n is a, c, g, or t
  modified_base (447)..(447): a, c, t, g, unknown or other
  misc_feature (447)..(447): n is a, c, g, or t
tcagtcgtcgctcgcacgaccggtgctcgatttagtatctgatagttgggtttggggcagagctctggagaagagctgctcagttacggacccagagggaaccatacggaaaccccagcgcagcttctcttcctcctgctactctggctcccaggtgtcaccggagaagttgtcttgacgcagtctccaggccaccctgtctctgtctccgaggggaaagngttactctctcctgcaaggccagtcagtagtgttggcatcgacgttgcctggtaccaaacaaaaaccgtggaccaggcctcccagtcctcctcatctagtggggcactcctaacaggtatcggaccggcactcccagacgtacggttcagtcgccaggtgggtcgtagggacagacttcactctcacatcaacacactggccgtcctagaattatttcgactagtntattactgtacagtatgtatgggtagtcacgtacacgttcgacgacgggacagggtggagatacgaagaccgtaagtggtcggctcggacacgtac

SEQ ID NO: 50737 - DNA, 510 bp, Homo sapiens
  misc_feature: GYAE6OF02F7LYG.21.38.D05.1.454.CMB.1.raw
  modified_base (215)..(215): a, c, t, g, unknown or other
  misc_feature (215)..(215): n is a, c, g, or t
  modified_base (455)..(455): a, c, t, g, unknown or other
  misc_feature (455)..(455): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaanagttactctctcctgcaaggccagtcagagtgttggcatcgacgttgcctggtaccaacaaaaacctggccaggctcccagtctcctcatctatggggcatcctacaggatgaccggcatcccagacaggttcagtgccgagtgggtctgggacagacttcactctcacatcaacacactcggcgcctgaagtattttgctagtgttattactgtcagatgtatggtaggtcaccgtacnctttggccagggaccagggtggagtatacgagacgaactggtggctgacacgtac

SEQ ID NO: 50738 - DNA, 319 bp, Homo sapiens
  misc_feature: GYAE6OF02HVWQG.21.38.D05.1.454.CMB.1.raw
  modified_base (315)..(319): a, c, t, g, unknown or other
  misc_feature (315)..(319): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttcccgccatctgactcgtctctactgagcggctggcaaggcgcatagnnnnn

SEQ ID NO: 50739 - DNA, 318 bp, Homo sapiens
  misc_feature: GYAE6OF02HLU9D.21.38.D05.1.454.CMB.1.raw
  modified_base (314)..(318): a, c, t, g, unknown or other
  misc_feature (314)..(318): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttcccgcatctgactcgtctctactgagcggctggcaaggcgcatagnnnnn

SEQ ID NO: 50740 - DNA, 323 bp, Homo sapiens
  misc_feature: GYAE6OF02I9SWT.21.38.D05.1.454.CMB.1.raw
  modified_base (260)..(260): a, c, t, g, unknown or other
  misc_feature (260)..(260): n is a, c, g, or t
  modified_base (294)..(294): a, c, t, g, unknown or other
  misc_feature (294)..(294): n is a, c, g, or t
  modified_base (312)..(312): a, c, t, g, unknown or other
  misc_feature (312)..(312): n is a, c, g, or t
  modified_base (318)..(323): a, c, t, g, unknown or other
  misc_feature (318)..(323): n is a, c, g, or t
tcagtcgtcgctcgcacgaccggtgctcgatttagtatctgatagttgggtttgggtagtctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaagggtggagatcagacgaactgtggctgcaccatcngtcttcatctcccgccatctgactcgtctctacngagcgggctggcaaggcncatagnnnnnn

SEQ ID NO: 50741 - DNA, 590 bp, Homo sapiens
  misc_feature: GYAE6OF02GZ2P6.21.38.D05.1.454.CMB.1.raw
  modified_base (216)..(216): a, c, t, g, unknown or other
  misc_feature (216)..(216): n is a, c, g, or t
  modified_base (323)..(323): a, c, t, g, unknown or other
  misc_feature (323)..(323): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagagtgttggcatcgacgttgcctggtaccaacaaaacctggccaggcctcccagtcctcctcatctagtgggcactcctanaggatcggaccggcactcccgagacgtaggttcagtgccgtaggtcgggtctagggacagtacttcacgtctacaccataccaaacacacgtcggccgtcctagtaacgttagttttcgacttaggttattactttacgtgtactagtattgtagttgggtaacgtcctaaccgttacgtaccgtttcgggaccgtacggggaccgtaaggggtcggaagtacgtacgaacgacggtaacgttcgggtacgcgtacgaccacctacg

SEQ ID NO: 50742 - DNA, 874 bp, Homo sapiens
  misc_feature: GYAE6OF02J3D2M.21.38.D05.1.454.CMB.1.raw
  modified_base (113)..(113): a, c, t, g, unknown or other
  misc_feature (113)..(113): n is a, c, g, or t
tcagtcgtcgctcgcacgaccggtgctcgatttagtatctgatagttgggtttggggcagagctctggagaagagctgctcagttaggacccagaggaaccatggaaaccccngcgcagtcttctcttcctctgctactctggcctcccgaggtctcgaaccggtagtaagttgtcttgacgctagtcctccgaggcctacccttgtcctcgtcgtaccgtaccgaaaggggtaaactcgtttacctctccgtccgtcgaccgaacggcctaagttccgaggtcggttcgtcgactacgtccgtacgtcgtaccgtacggtaaccaaaccgtaaaccgtcggaccgtacgccctaccgtacgtcctccgtacgtacgtacgtaggtcggactacgtaccgtacgacgtacgtacgaccgactaccgtaccgacgtaccggtacggttacgtaacggtccggtaccggttaacgggttcgggtaccggtaaccgggtaaaccgtaaccggttaacccttacccgtaaccgttacccgtaaccgtaaccccgtaacttaaccccgaaaaccggtacccgttacccgggttaccggtacccggttaacccggttaagttaaaccggttttacgtttacgaacggtttaacgttacgtttaacgttaaccggttacgttaacgttaacggtaacggtttacggttaacggtaccgggtttaaccgtacccggttaaacccgttaaccggttaccgggttaaccgggaaccgggttacggtaaccggtaaggttaaccggacttaaaccggtaccgtaacggtaaccggttaacgtttccgggaaccggttaccacggttacccgtaccggtttaaccg

SEQ ID NO: 50743 - DNA, 569 bp, Homo sapiens
  misc_feature: GYAE6OF02JGIWA.21.38.D05.1.454.CMB.1.raw
  modified_base (218)..(218): a, c, t, g, unknown or other
  misc_feature (218)..(218): n is a, c, g, or t
  modified_base (326)..(326): a, c, t, g, unknown or other
  misc_feature (326)..(326): n is a, c, g, or t
  modified_base (405)..(405): a, c, t, g, unknown or other
  misc_feature (405)..(405): n is a, c, g, or t
tcagtcgtcgctcgcacgaccggtgctcgatttagtatctgatagttggggtttggggcagagctctggagaagagctgctcagttaggaacccagagggaaccatggaaaccccagcgcagcttctcttcctctgctactctggctcccaggtgtcaccgggagaagttgtcttgacgcagtctccaggcaccctgtcctctgtctccaggggaaangttactctctcctgcaaggccagtcagagtgttggtatcgacgttgcctggtaccaacaaaaacctggccaggctcccagtctcctcatctatgggcatcctacgagntacgaccggcactccagacaggttcagtcgccgagtggtctgggacagacttcactctcaccatacaacacactcggcncctagaacgtattttcgcgtagttcgtaattactgtcgagatagttatacggtagtacgtaccgtactaccgtttggaccgtaggggtacccaagggtacggaagtacgtacgtacggtaacggtaacgttggtacggtccgtcggaccgtaccgagttacccg

SEQ ID NO: 50744 - DNA, 322 bp, Homo sapiens
  misc_feature: GYAE6OF02GFPGG.21.38.D05.1.454.CMB.1.raw
  modified_base (316)..(322): a, c, t, g, unknown or other
  misc_feature (316)..(322): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttcccgccatctgactcgtctctactgagcgggctggcaaggcgcatagnnnnnnn

SEQ ID NO: 50745 - DNA, 321 bp, Homo sapiens; identical to SEQ ID NO: 50715
  misc_feature: GYAE6OF02JBTNM.21.38.D05.1.454.CMB.1.raw
  modified_base (316)..(321): a, c, t, g, unknown or other
  misc_feature (316)..(321): n is a, c, g, or t

SEQ ID NO: 50746 - DNA, 515 bp, Homo sapiens
  misc_feature: GYAE6OF02IMZOQ.21.38.D05.1.454.CMB.1.raw
  modified_base (214)..(214): a, c, t, g, unknown or other
  misc_feature (214)..(214): n is a, c, g, or t
  modified_base (402)..(402): a, c, t, g, unknown or other
  misc_feature (402)..(402): n is a, c, g, or t
  modified_base (458)..(458): a, c, t, g, unknown or other
  misc_feature (458)..(458): n is a, c, g, or t
tcagtcgtcgctcgcacgaccggtgctcgatttagtatctgatagttgggtttggggcagagctctggagaagagctgctcagttaggacccagagggaaccatggaaacccaagcgcagcttctcttcctcctgctactctggctcccaggtgtcaccggagaagttgtcttgacgcagtctccaggcacctgtctctgtctccaggggaaangttactctctcctgcaaggccagtcagagtgttggcatcgacgttgcctggtaccaacaaaaacctggccaggctcccagtctcctcatctatggggcatcctacaggatgaccggcactccagactaggtcagtgaccgagtcgggtctgggacagtacttcactctcaccatacaacacactggcncctgaacgtatttgacagtgttattactgtacagtatgtagtggtagtcaccgtanaccgtttgccagggacctaggtggatagtacgagacgacgtggtggctgacactacg

SEQ ID NO: 50747 - DNA, 320 bp, Homo sapiens
  misc_feature: GYAE6OF02IFARV.21.38.D05.1.454.CMB.1.raw
  modified_base (316)..(320): a, c, t, g, unknown or other
  misc_feature (316)..(320): n is a, c, g, or t
tcagtcgtcgctcgcacgaccggtgctcgatttagtatctgatagttgggtttgggatctatggggcatcctacaggatgaccggcatccccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttcccgcatctgactcgtctctactgagcgggctggcaaggcgcatagnnnnn

SEQ ID NO: 50748 - DNA, 589 bp, Homo sapiens
  misc_feature: GYAE6OF02F8KA0.21.38.D05.1.454.CMB.1.raw
  modified_base (217)..(217): a, c, t, g, unknown or other
  misc_feature (217)..(217): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggccaccctgtctctgtctccgaggggaaangttactctctcctgcagctccagccaagaatatccagacgctactacatacgcctggtaccagcagaacgcctggccaggcctcccgaggttcctcatctatcgcgtcgggtcccacgacgggcccacgtggccactcccgagacgtaggttcaggtcggcgtagggttcgggtcgtgggacagtacttcactctcatctattacgacagacgtggacgtctagaagtactttacgacgtagttagttattacgtgtacgagtcgtagttagtacggtaacttacgtaccgttcgttcggttaccggttaccggtaccgtaacgggtaaccgtaaggtaacgtaaacgtacgtaaacggtacgtaggtacgg

SEQ ID NO: 50749 - DNA, 320 bp, Homo sapiens
  misc_feature: GYAE6OF02GCJV1.21.38.D05.1.454.CMB.1.raw
  modified_base (316)..(320): a, c, t, g, unknown or other
  misc_feature (316)..(320): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttcccgcatctgacctcgtctctactgagcgggctggcaaggcgcatagnnnnn

SEQ ID NO: 50750 - DNA, 501 bp, Homo sapiens
  misc_feature: GYAE6OF02FJFX0.21.38.D05.1.454.CMB.1.raw
  modified_base (215)..(215): a, c, t, g, unknown or other
  misc_feature (215)..(215): n is a, c, g, or t
  modified_base (395)..(395): a, c, t, g, unknown or other
  misc_feature (395)..(395): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaaacctggccaggctcccagtctcctcatctatgggcatcctacaggatgaccggcatcccagacaggttcagtgccagtggtctgggacagacttcactctcacatcaacacactggcncctgaagtattttgctagtgtattactgtcagatgtatggtagtcaccgtacactttgccaggggaccagggtggagatcgagacgaactggtggctcgcacctag

SEQ ID NO: 50751 - DNA, 512 bp, Homo sapiens
  misc_feature: GYAE6OF02HD3S6.21.38.D05.1.454.CMB.1.raw
  modified_base (411)..(411): a, c, t, g, unknown or other
  misc_feature (411)..(411): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaagagttactctctcctgcaaggccagtcagagtgttggcatcgacgttgcctggtaccaacaaaaacctggccaggctcccagtctcctcatctagtggggcatcctacaggatgaccggcatcccagacaggttcagtgccaggtgggtctgggacagacttcactctcaccatcaacacactggccgcctgaagtnttttgctagtgtattctgtcagtatgtatggtagtcaccgtactcgtttgccgaggggacctaagggtggaagtagtcagacgacgtggtggctgcactac

SEQ ID NO: 50752 - DNA, 506 bp, Homo sapiens
  misc_feature: GYAE6OF02IWNNG.21.38.D05.1.454.CMB.1.raw
  modified_base (215)..(215): a, c, t, g, unknown or other
  misc_feature (215)..(215): n is a, c, g, or t
  modified_base (407)..(407): a, c, t, g, unknown or other
  misc_feature (407)..(407): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaaacctggccaggctcccagtctcctcatctatgggcatcctacaggatgaccggcatcccagaccaggttcagtgccagtgggtctgggacaggacttcactctcaccatacaacacactgcgcctgaagnttttgctagtgtattactgtcagtatgtagtggtagtcaaccgtacaccgtttggccagggaccaaggtggagatcagacgactggtgctgccactacg

SEQ ID NO: 50753 - DNA, 535 bp, Homo sapiens
  misc_feature: GYAE6OF02GA0YA.21.38.D05.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccagggggaaangttactctctcctgcaaggccagtcaggagtgttggcatcgacgttgcctggtaccaacaaaacctggccaggctcccagtctcctcatctatggggcatcctacaggatgaccggcactcccagactaggttcagtcgccaggtgggtctgggacagtacttcactctcaaccatcaacacacgtgcgcctagaatattttcgctagttgttacttactgtacgagtatgtagttggtacgtcaaccgtactaccgtttggcctaggggaccaagggtggagtactcgagtacgtaactggtcggctggaccactacg

SEQ ID NO: 50754 - DNA, 554 bp, Homo sapiens
  misc_feature: GYAE6OF02IFQHG.21.38.D05.1.454.CMB.1.raw
  modified_base (215)..(215): a, c, t, g, unknown or other
  misc_feature (215)..(215): n is a, c, g, or t
  modified_base (413)..(413): a, c, t, g, unknown or other
  misc_feature (413)..(413): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaanagttactctctcctgcaaggccagtcagagtgttggcatcgacgttgcctggtaaccaaacaaaaacctggaccaggcctcccagtcctcctcatctagtggggcatcctacaggatcgaccggcactcccagacaggttcagtcgccgaggtgggtctggacagtacttcactctcacactacaacacacgtggccncctagaagtattttcgctagttgttacttactgtacagtatgtagtggtagtactaaccgttactaccgtttgggaccgtacggggaccgtaagggtggaacgtatacgaagacgtaacgtggtacggctggaccacctag

SEQ ID NO: 50755 - DNA, 554 bp, Homo sapiens
  misc_feature: GYAE6OF02ICMS1.21.38.D05.1.454.CMB.1.raw
  modified_base (215)..(215): a, c, t, g, unknown or other
  misc_feature (215)..(215): n is a, c, g, or t
  modified_base (374)..(374): a, c, t, g, unknown or other
  misc_feature (374)..(374): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgagttgcctggtaccaacaaaaactggaccaggctcccagtcctcctcatctatgggcatcctacaggatgaccggcactccagacaggttcagtcgcagtgggtctgggacagacttcnctctacaccatcaaacacactcggcgacctggaagtattttgactagttagttaattactagtcaagtattgtagttggtacgtacctaccgttactaccgtttcggaccgaggggtaccgaagggtggaagtacgtacgaaggacgtaacgtcggtacggcgttacgacctacgtaacg

SEQ ID NO: 50756 - DNA, 547 bp, Homo sapiens
  misc_feature: GYAE6OF02FFAFD.21.38.D05.1.454.CMB.1.raw
  modified_base (154)..(154): a, c, t, g, unknown or other
  misc_feature (154)..(154): n is a, c, g, or t
  modified_base (215)..(215): a, c, t, g, unknown or other
  misc_feature (215)..(215): n is a, c, g, or t
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
  modified_base (400)..(400): a, c, t, g, unknown or other
  misc_feature (400)..(400): n is a, c, g, or t
  modified_base (409)..(409): a, c, t, g, unknown or other
  misc_feature (409)..(409): n is a, c, g, or t
  modified_base (419)..(419): a, c, t, g, unknown or other
  misc_feature (419)..(419): n is a, c, g, or t
  modified_base (424)..(424): a, c, t, g, unknown or other
  misc_feature (424)..(424): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtntcaccggagaagttgtcttgacgcagtctccaggcaccctgtctctgtctccaggggaaangttacctctctcctgcaaggccagtcagagtgttggcatcgacgttgcctggaccaacaaaacctggccaggcctcccagtctcctcatctatgggcatcctacaggatggaccggcactcccagacaggttcagtcgcctaggtgggtctgggacagacttcactctcacatcaacncacngcnctagaagtntttgctagtntattntgtacagtatgtagttggtacgtccaccgttactccgtttaggcccgtaggggaaccctaaggggtcggagtacgtaccgaaggaaccgtaacgttggtacggaccttcggacctaccgtacg

SEQ ID NO: 50757 - DNA, 537 bp, Homo sapiens
  misc_feature: GYAE6OF02G0L1Z.21.38.D05.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaaacctggaccaggctcccagtcctcctcatctagtgggcactcctacaggatcgaccggcactcccagacaggttcagtgccgaggtgggtctgggacaggtacttcactctcaccatcaaacacacgtcggccgctagaagttattttcgctagttgtattactgtcagtattgtatggtaggtcaccgtactaccgtttggccgtaggggaccgtaagggtggagagtacgaggacgtaacgtggtgcgtgccactacg

SEQ ID NO: 50758 - DNA, 324 bp, Homo sapiens
  misc_feature: GYAE6OF02HQUVX.21.38.D05.1.454.CMB.1.raw
  modified_base (316)..(324): a, c, t, g, unknown or other
  misc_feature (316)..(324): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatccttcccgccatctgactcgtctctactgagcggctggcaaggcgcatagnnnnnnnnn

SEQ ID NO: 50759 - DNA, 589 bp, Homo sapiens
  misc_feature: GYAE6OF02J2X9W.21.38.D05.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagtatctgatagttgggtttggggcagagctctggagaagagctgctcagttaggacccagagggaaccatgggaaaccccagcgcagcttctcttcctcctgctactctggctcccaggtgtcaccggagaagttgtcttgacgcagtctccaggcaccctgtctctgtctccaggggaaangttactctctcctagcaaggccagtcagagtgttggcatcgacgttgcctggtaccaacaaaacctggaccaggctccagtctcctcatctatcgggcatcctacaggatcgaccggcactcccagaccaggttcagtcgcctaggtcggtctagggacaggaccttcgactctacgacatcgaacactactcggcgtcctagaacgtattttagcctaagttcgtaattacctcggtacacggtattggttaacgtgggttacgtacccgaaccgttaactccgtttacgggaccgtacggggtacctaagggtcggacgacgtaccgtaggtaaccggtaacgttggaccgtacgtcggacctaccgtacg

SEQ ID NO: 50760 - DNA, 319 bp, Homo sapiens
  misc_feature: GYAE6OF02H0M2X.21.38.D05.1.454.CMB.1.raw
  modified_base (310)..(310): a, c, t, g, unknown or other
  misc_feature (310)..(310): n is a, c, g, or t
  modified_base (316)..(319): a, c, t, g, unknown or other
  misc_feature (316)..(319): n is a, c, g, or t
tcagtcgtcgctcgcacgaccggtgctcgatttagtatctgatagttgggtttgggatctatggggcatcctacaggatgaccggcatcccagacaggttcattgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttcccgccatctgactcgtctctactgagcgggctggcaaggcncatagnnnn

SEQ ID NO: 50761 - DNA, 674 bp, Homo sapiens
  misc_feature: GYAE6OF02INLIF.21.38.D05.1.454.CMB.1.raw
tcagtcgtcgctcgcacgaccggtgctcgatttagtatctgatagttgggtttggggtcgagagctctggagaagagctgctcagttaggacccagagggaaccatggaaacccagcgcagcttctcttcctctgctactctggctcccaggtgtcaccggagaagttgtcttgacgcagtctccaggcacctgtctctgtctcgaggggaaatgttactctctcctgcaaggccagtcagtagtgttggcatcgacgttgctggtaccaacaaaacctggaccaggctcccagtctcctcactctagtcgggacactacctacgaggtactcgaccggacacgtcccgaacgtacgtacggttacgaaggtcgaccgtaaggttcggggtacgtacggggaactacggtccttacgaccgtttctaccaacgtactaacctaaccaccgtacgtacggccgtaccgtaggtaaacgtttactttacggctaaggttcttaacgtttacgtacgtataacgtagttacgtaggttaggtacgttaccgtaaccgttaagttacccgtttgggaaccgggtacggggtaaccgtaggggtacgtaacggtacttaacgtaacggtaacccggttaagttcgggttaccggtcgtaccggtacccgaaacttcggg

SEQ ID NO: 50762 - DNA, 320 bp, Homo sapiens
  misc_feature: GYAE6OF02F0H3Z.21.38.D05.1.454.CMB.1.raw
  modified_base (318)..(320): a, c, t, g, unknown or other
  misc_feature (318)..(320): n is a, c, g, or t
tcagtcgtcgctcgcacgaccggtgctcgatttagtatctgatagttgggtttgggatctatggggcatcctacaggatgaccggcatcccagacaggttcagtgccagtgggtctggggacagacttcactctcaccatcaacacactggcgcctgaagattttgcagtgtattactgtcagatgtatggtaggtcaccgtacacctttggccaggggaccaaggtggagatcagacgaactgtggctgccaccatctgtcttcatcttcccgccatctgactcgtctctactgagcgggctggcaaggcgcatagnnn

SEQ ID NO: 50763 - DNA, 565 bp, Homo sapiens
  misc_feature: GYAE6OF02I77KP.21.38.D05.1.454.CMB.1.raw
  modified_base (216)..(216): a, c, t, g, unknown or other
  misc_feature (216)..(216): n is a, c, g, or t
  modified_base (321)..(321): a, c, t, g, unknown or other
  misc_feature (321)..(321): n is a, c, g, or t
  modified_base (347)..(347): a, c, t, g, unknown or other
  misc_feature (347)..(347): n is a, c, g, or t
  modified_base (391)..(391): a, c, t, g, unknown or other
  misc_feature (391)..(391): n is a, c, g, or t
  modified_base (399)..(399): a, c, t, g, unknown or other
  misc_feature (399)..(399): n is a, c, g, or t
  modified_base (401)..(401): a, c, t, g, unknown or other
  misc_feature (401)..(401): n is a, c, g, or t
  modified_base (414)..(414): a, c, t, g, unknown or other
  misc_feature (414)..(414): n is a, c, g, or t
  modified_base (431)..(431): a, c, t, g, unknown or other
  misc_feature (431)..(431): n is a, c, g, or t
  modified_base (443)..(443): a, c, t, g, unknown or other
  misc_feature (443)..(443): n is a, c, g, or t
  modified_base (450)..(450): a, c, t, g, unknown or other
  misc_feature (450)..(450): n is a, c, g, or t
tcagtcgtcgctcgcacgaccggtgctcgatttagtatctgatagttgggtttggggtcgagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgagggaangttactctctcctgcaaggtccagtcagtagtgttggcatcgacgttgcctggtaccaacaaaacctggaccacgctcccagtcctcctcatctagtgggctacncctacgagacgtaggacccggacacncccaagaccgtaggtccagtcgctagggttgtcggtagggacancctttacncnctcacatacaacncacgtgcacctagagtntttcgactagtntactttngtatacgaatgtatcggttagtcctaaccgtcctaccgtttggaccgagggtacctaggggtacggtataacgtcgacgtaaaccggagtcgggtccgactcggtacaccttacg

SEQ ID NO: 50764 - DNA, 316 bp, Homo sapiens
  misc_feature: GYAE6OF02IHQSO.21.38.D05.1.454.CMB.1.raw
  modified_base (310)..(316): a, c, t, g, unknown or other
  misc_feature (310)..(316): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtagtcaccgtacacctttggccaggggaccaaggtggagatcagacgaactgtggctgcaccatctgtctcatctcccgcatctgactcgtctctactgagcgggctggcaggcgcatgnnnnnnn

SEQ ID NO: 50765 - DNA, 623 bp, Homo sapiens
  misc_feature: GYAE6OF02G3GY2.21.38.D05.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctccaggtgtcaccggagaagttgtcttgacgcagtctccaggcaccctgtctctgtctcgaggggaaangttactctctcctgcaaggccagtcagagtgtgcatcgacgttgcctggtaaccaaacaaaacctggaccaggcctcccagtcctcctcatctagtcggggacactcctacaggatcggaccggcactccagactaggttcagtgccaggtggtctgggacagtaccttcactctaccacctactaccaaaccacgacgtcggaccgtacctaggtaacgttattttcgacgttagttagttaactttacgtgttacgtagtacgttagtagttagggttacgttaccgtaaccggttaccgtaccgtttacgggaccggtacgggggtaaccgtaaggggtcggaacggtaacgttacggaacggtaacggtaacgttcgggtacggtaccgtacggaccgtactacg

SEQ ID NO: 50766 - DNA, 551 bp, Homo sapiens
  misc_feature: GYAE6OF02I045Z.21.38.D05.1.454.CMB.1.raw
  modified_base (200)..(200): a, c, t, g, unknown or other
  misc_feature (200)..(200): n is a, c, g, or t
  modified_base (216)..(216): a, c, t, g, unknown or other
  misc_feature (216)..(216): n is a, c, g, or t
  modified_base (410)..(410): a, c, t, g, unknown or other
  misc_feature (410)..(410): n is a, c, g, or t
  modified_base (421)..(421): a, c, t, g, unknown or other
  misc_feature (421)..(421): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtttcngtctccagggggaaangttactctctcctgcaaggccagtcagagtgttggcatcgacgttgcctggtaccaacaaaaacctggccaggctcccagtctcctcatctatggggcatcctacaggatgaccggcatccccagacaggttcagtcgccagtgggtctgggacagacttcgactctcaccatcaacacactggcgcctagaantttcgctagtntattctgtcagattgtagtgggtagtcaccgttactacgtttcggaccgtacgggaccctaagggtcgggaagacgttacgaaggtacccggaaattcgggtaggtccgtcggacctaccctagttcccg

SEQ ID NO: 50767 - DNA, 320 bp, Homo sapiens
  misc_feature: GYAE6OF02H3J0D.21.38.D05.1.454.CMB.1.raw
  modified_base (280)..(280): a, c, t, g, unknown or other
  misc_feature (280)..(280): n is a, c, g, or t
  modified_base (316)..(320): a, c, t, g, unknown or other
  misc_feature (316)..(320): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagatttttgcagtgtattactgtcagatgtatggtaggtcaccgtacacctttggccaggggaccaaggtggagatcagacgaactgtggctgcaccatctgtcttcatccttcccgcatctnactcgtctctactgagcggctggcaaggcgcatagnnnnn

SEQ ID NO: 50768 - DNA, 544 bp, Homo sapiens
  misc_feature: GYAE6OF02IKQ6L.21.38.D05.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcacctgtctctgtctccaggggaaangttactctctcctgcaaggccagtcagagtgttggcatcgacgttgcctggtaccaacaaaaacctggccaggctccagtctcctcatctatggggcatctacaggatgaccggcactcccagacaggtttcagtgccagtgggtctgggacagacttcactctcaccatcaacacactggccgctagaagtattttgctagtgttacttactgtcagtattgtagtgggttagtcaaccgttactaccgtttgggacccgtaggggacctaagggtggaacgtacgtcgaagaaccgaacgttggtacggacgtcggtaccacctacgg

SEQ ID NO: 50769 - DNA, 673 bp, Homo sapiens
  misc_feature: GYAE6OF02GUROB.21.38.D05.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagtatctgatagttgggtttgggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccagggggaangttactctctcctgcaaggccagtcagagtgtgcatcgagttcgcctggtaccaaacaaaaaccgtgaccaggctacccgagtcctctcatctagtgggctactcctacaggtactcggaccggcactccccgaagtaccgtagggtttccaggtcgcccgaggtcggggtacgtggggtaacacggtacctttacaccgttccttacaccctaacgtaccaaaccacaaccgtcggaccgtaccgtagtaacgttactttagactaggttattaacgtttacgtaggttaccaaggttacgttaggttacgttagggttacggttaccgtaaccggttaccgttaccgtttcgggaccggttacggggaaccgttaagggggtcggtaaacggtactacggtaacggtaaccggttaacggttacggttcgggaccttacgggacctaaccttacg

SEQ ID NO: 50770 - DNA, 640 bp, Homo sapiens
  misc_feature: GYAE6OF02IROMR.21.38.D05.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagtatctgatagttgggtttgggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaanagttactctctcctgcaggccagtcagagtgtggcatcgagttgcctggtaaccaaacaaaaccgtggaccaggcctccagtcctcctcatctagtggggctactcctacaggtatgacgaggctactccagactaggttcacgtgcgtaggtcggtcgtacggacacgtaccgttcactctaccactactacaaccaccgtacgtcggaccgtccgtagtaagttacgttttcggacttaggttagtttaacttacgttagtacgtagttacgttggttaagttcgggttaacgttacccgtaaccgttaaccgtacccgtttacgggaccggttaaccggggtaaccgtaaggggttaacggaacggtacgtaaccgtaaggaaccggtaacggttcggtgggtaccgtcgtaccgtaaccg

SEQ ID NO: 50771 - DNA, 542 bp, Homo sapiens
  misc_feature: GYAE6OF02GGWM6.21.38.D05.1.454.CMB.1.raw
  modified_base (216)..(216): a, c, t, g, unknown or other
  misc_feature (216)..(216): n is a, c, g, or t
  modified_base (417)..(417): a, c, t, g, unknown or other
  misc_feature (417)..(417): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccagggggaaangttactctctcctgcaaggccagtcagagtgttggcatcgacgttgcctggtaccaacaaaaacctggccaggctcccaggctcctcatctatggtgcatccagcagggccatggcatcccagacaggttcagtggcagtgggtctgggacagacttcactctcaccatcacagactggacgcctgaagtatttgctagtntattactgtacagctagtatagtagctacaccctccctagtacgtaccttacgttttacggaccgtaacggggtaccgaagggttacggtaaacgtaccgaaacggtaaccgtaggtaggtaccg

SEQ ID NO: 50772 - DNA, 567 bp, Homo sapiens
  misc_feature: GYAE6OF02F1GHM.21.38.D05.1.454.CMB.1.raw
  modified_base (217)..(217): a, c, t, g, unknown or other
  misc_feature (217)..(217): n is a, c, g, or t
  modified_base (413)..(413): a, c, t, g, unknown or other
  misc_feature (413)..(413): n is a, c, g, or t
  modified_base (422)..(422): a, c, t, g, unknown or other
  misc_feature (422)..(422): n is a, c, g, or t
  modified_base (435)..(435): a, c, t, g, unknown or other
  misc_feature (435)..(435): n is a, c, g, or t
tcagtcgtcgctcgcacgaccggtgctcgatttagtatctgatagttgggtttggggcagagctctggagaagagctgctcagttaggacccagagggaaccatgggaaaccccagcgcagcttctcttcctcctgctactctggctcccaggtgtcaccggagaagttgtcttgacgcagtctccaggcaccctgtctctgtctccaggggaaagngttactctctcctgcaaggccagtcagagtgttggcatcgacgttgcctggtaccaacaaaaacctggccaggctcccagtctcctcatctagtcggggcactcctacaggatggaccggcactcccagacgaggtcagtgcgaggtcgggtcgtgggacagtacttccactctacaccatacaacacactcggcncctagaatnttttgactagttnttaattactgtacagtagttgtagtaggttagtacctaacgtacctaccgtttcggaccgtacggggaaccgtaagggtcggaagtacgtacgaacggtaacgtaacgttggtcgtacgtcgaccacgtacg

SEQ ID NO: 50773 - DNA, 516 bp, Homo sapiens
  misc_feature: GYAE6OF02HB2YU.21.38.D05.1.454.CMB.1.raw
  modified_base (215)..(215): a, c, t, g, unknown or other
  misc_feature (215)..(215): n is a, c, g, or t
  modified_base (402)..(402): a, c, t, g, unknown or other
  misc_feature (402)..(402): n is a, c, g, or t
  modified_base (411)..(411): a, c, t, g, unknown or other
  misc_feature (411)..(411): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaccaacaaaacctggccaggctcccagtctcctcatctatggggcatcctacaggatgaccggcactcccagacgaggttcagtcgccaggtgggtctgggacagtactcactctcaccatcaacacacgtgccnctagaagtntttgctagttgtattactgtcagtatgtagtggtagtcacgtactaccgtttggccgagggaccagggtggatagtacgagacgtacgtggtggctcgcactacg

SEQ ID NO: 50774 - DNA, 333 bp, Homo sapiens
  misc_feature: GYAE6OF02G4NR5.21.38.D05.1.454.CMB.1.raw
  modified_base (322)..(333): a, c, t, g, unknown or other
  misc_feature (322)..(333): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtactacctttggccaggggaccaaggtggagatcagacgaactggtgctgcaccatctgtcttcatccttcccgccatctgacctcgtctctactgaggcgggctggcaaggccgctatagnnnnnnnnnnnn

SEQ ID NO: 50775 - DNA, 631 bp, Homo sapiens
  misc_feature: GYAE6OF02HPY5Y.21.38.D05.1.454.CMB.1.raw
  modified_base (211)..(211): a, c, t, g, unknown or other
  misc_feature (211)..(211): n is a, c, g, or t
  modified_base (252)..(252): a, c, t, g, unknown or other
  misc_feature (252)..(252): n is a, c, g, or t
  modified_base (401)..(401): a, c, t, g, unknown or other
  misc_feature (401)..(401): n is a, c, g, or t
tcagtcgtcgctcgcacgaccggtgctcgatttagtatctgatagttgggtttggggcagagctctggagaagagctgctcagttaggacccagagggaaccatggaaacccagcgcagcttctcttcctcctgctactctggctccaggtgtcaccggagaagttgtcttgacgcagtctccaggcaccctgtctctgtctcgagggaangttactctctctgcaaggccagtcagagtgttggcatacgngttgctcggtaaccaacaaaactggaccaggctccagtctcctcactctatgggcatcctacgagactcggaccggctactccagacgtaggttcaggtcgacgagtgggtcgtggacacgtactcgtactcgtcaactactacgaacncgtaaccgtggaccgtacctagtaacgtgttttacgccgtaagttgttaactttacgtcggttacaaggtactttaggtaagttacgggtacggttacctaacccgggttaccttaccggttttacgggaccggttaccggggaacccgttaagggggtagaaccggtctaaccgggtaaggaacccggtacgttacgggtaccgggttactccgtaccgtactacccgg

SEQ ID NO: 50776 - DNA, 709 bp, Homo sapiens
  misc_feature: GYAE6OF02G66QM.21.38.D05.1.454.CMB.1.raw
tcagtcgtcgctcgcacgaccggtgctcgatttagtatctgatagttgggtttggggcagagctctggagaagagctgctcagttaggacccagagggaaccatggaaaccccagcgcagcttctcttcctctgctactctggcctccaggtgtcaccggagaagttgtcttgacgcagtctccaggcacctgtctctgtctcgaaggggaaatgttactctctcctgcaaggccagtcagtagtgttggacatcgacgttcgcgtaggtaaccaaacaaaaccgtggaccgaggcctcccgacgttcctacctctacttacgtaggtcgggtctactaccgtaacgaggacttacggacccggtactaccgtacccgaacgtacgtacggttcgacggttcgacgtaggttcgggtcgtacggggactacgtaccgttactaccgttctacctacctaactaccaaactacgtaccgtacggaccgtacgtacgtaaagtttacgtttacgacgttagtttacgttaactttaccgtaggttaacctaaggttagttacggttaagttacgggttaacgttaacccgttaccggttaacgttaaccggtttccggaaccgggtacgggtaaccggtaggggtacggtacgtacgtaacggaacggtaacgtaacggtcggttaggaccgtacgtaccgaacgttacgg

SEQ ID NO: 50777 - DNA, 659 bp, Homo sapiens
  misc_feature: GYAE6OF02IWN1K.21.38.D05.1.454.CMB.1.raw
  modified_base (216)..(216): a, c, t, g, unknown or other
  misc_feature (216)..(216): n is a, c, g, or t
  modified_base (403)..(403): a, c, t, g, unknown or other
  misc_feature (403)..(403): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtcctctgtctccaggggaaanagttactctctcctgcaaggccagtcagagtgttggcatcgacgttgcctggtaccaaacaaaacctggaccaggcctcccagtctcctcactctagtgggctatcctacaggatgaccgcactcccagacaggtcagtgccaggtcgggtcgtgggaactacgtacttccgacttcctccaacccntaccaaacaccgtacgtcggaccgcccgtagaaacgtttacttttaggaccttaaggttcttaatttacggtcgttacgtagtaattaggttacgttaggttaacggttaccttaaccgggtaaccttcccggttttacggggtaccgaaccgggggtaaccttaacggggtcgggtaaacgtaacggttaccgtaaagggtaaccgaacggtttacgggttaccgggtaccgtaccggtacctaaccccgttaag

SEQ ID NO: 50778 - DNA, 612 bp, Homo sapiens
  misc_feature: GYAE6OF02I2F5P.21.38.D05.1.454.CMB.1.raw
  modified_base (342)..(342): a, c, t, g, unknown or other
  misc_feature (342)..(342): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaagagttactctctcctgcaaggccagtcagagtgttggcatcgacgttgcctggtaccaacaaaacctggccaggcctcccagtctcctcatctagtgggcatcctacaggatcgaccggcactcccanacgaggttcagtcgccaggtgggtcgtgggacagacttcactctcaccataccaacaccactcggccgtccctagtaagtagttttcgacgtagttcgtaatttactggttactaaggtattaggtagttgggttacggttaccgtaacccgttaccgtaaccgtttgggacccggtacgggggtaaccctaagggggtacgggaggtaacgttaccgaacgggtaaccgtaacgttagggtacggtacgtacggtaccccaccgtaacg

SEQ ID NO: 50779 - DNA, 697 bp, Homo sapiens
  misc_feature: GYAE6OF02ITKB0.21.38.D05.1.454.CMB.1.raw
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaatgtactctctcctgcaaggccagtcagagtgttggcatcgacgttgcctaggtaaccaacaaaaacctggaccagggctcccagtctccgtcatctaagtgggctactcctaagaggtatcgaccggcactccagacagggttcagtcgccgtaggtgggtacgttacgggactacgtaccgttacgaaccttccgtaccgtaaccctaatacctaaacccgacgtaaccgtacgggtacccgtacccttaagggtaaactttacggttttcgaaccgttaggttaacggttactttaaccgtagggttaccaaggtatttaaccggttaagttcgggttaacgtaacctaacccggttacttaacccgggtttacggacccggtaacggggtaaccgtaacggggtacgggtaacgtaacgtacgaaacgggtaacccgttaacgttcgggtcggtaacggtccgtaccgtaaccttacgg

SEQ ID NO: 50780 - DNA, 601 bp, Homo sapiens
  misc_feature: GYAE6OF02I80IC.21.38.D05.1.454.CMB.1.raw
  modified_base (216)..(216): a, c, t, g, unknown or other
  misc_feature (216)..(216): n is a, c, g, or t
  modified_base (421)..(421): a, c, t, g, unknown or other
  misc_feature (421)..(421): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccagggggaaangttactctctcctgcaaggccagtcagtagtgttggcatcgtacgttgcctggtaccaaacaaaacctggaccaggctcccagtcctcctctatctagtcgggcactcctaacgacggtatacgaccggactactacccgagaccgtaacggtcacgtcgccgaggtcgggtccgtggactagacctttcacgtctacaccgtanacaacactagtcggccgtctaagtaagtagttttcgctagtacttaagttctagtactagtattacgttagtaagggtacgttaccgtacccgttaactaccgttacggaccggtacgggtaaccgagggtcgtaaggtctaacgacgaagtacgttggtacgcgttacgcgtacctacg

SEQ ID NO: 50781 - DNA, 383 bp, Homo sapiens
  misc_feature: GYAE6OF02HXSK8.21.38.D05.1.454.CMB.1.raw
  modified_base (188)..(188): a, c, t, g, unknown or other
  misc_feature (188)..(188): n is a, c, g, or t
  modified_base (238)..(238): a, c, t, g, unknown or other
  misc_feature (238)..(238): n is a, c, g, or t
  modified_base (325)..(325): a, c, t, g, unknown or other
  misc_feature (325)..(325): n is a, c, g, or t
  modified_base (331)..(331): a, c, t, g, unknown or other
  misc_feature (331)..(331): n is a, c, g, or t
  modified_base (334)..(383): a, c, t, g, unknown or other
  misc_feature (334)..(383): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcagcagactggagcctgaagattttgcaatgtattactgtcagcaatangctcacccccgatcacttcgcaaggacacgatgcagatgaaacgtaatgnggctgcacagtctgtcttcaacttcctttcccgcctatcctacgtacttcgttctactactgacgcgggtctcggactaacggctanactagntgnnnnnnnnnnnnnnnnnnnnnnnnnnnnnnnnnnnnnnnnnnnnnnnnnn

SEQ ID NO: 50782 - DNA, 588 bp, Homo sapiens
  misc_feature: GYAE6OF02JURDD.21.38.D05.1.454.CMB.1.raw
  modified_base (229)..(229): a, c, t, g, unknown or other
  misc_feature (229)..(229): n is a, c, g, or t
  modified_base (463)..(463): a, c, t, g, unknown or other
  misc_feature (463)..(463): n is a, c, g, or t
tcagtcgtcgctcgcacgaccggtgctcgatttagtatctgatagttgggtttggggtcgagagctctggagaagagctgctcagttaggacccagagggaaccatggaaaccccagcgcagcttctcttcctcctgctactctggctcccaggtgtcacggagaagttgtctgacgcagtctccaggccaccctgtctctgtctccgaggggaatgttactctcctcngacaaggccagtcagagtgtggcatcgagtgctgtaccaacaaacctgccagcctccagtctcctcactctagtggaccactctacacgacgtcgaccggactactcccgacgacgtacggttcacggtcgactacgggtcggtacgacgggtacacgtacttaccacttccacgacctactaccacaccactcggccgtacagtaagttactttacgcgtagttataacgttntacgtacagtacttgtaagtcggttacgtactaaccgttaccgtacgtccggtacggacgggtactacgggtagtagtaataccggaagtacccgtaagtcggacgtacgtcgacccgtaatccg

SEQ ID NO: 50783 - DNA, 613 bp, Homo sapiens
  misc_feature: GYAE6OF02IHBWM.21.38.D05.1.454.CMB.1.raw
  modified_base (215)..(215): a, c, t, g, unknown or other
  misc_feature (215)..(215): n is a, c, g, or t
  modified_base (325)..(325): a, c, t, g, unknown or other
  misc_feature (325)..(325): n is a, c, g, or t
  modified_base (598)..(598): a, c, t, g, unknown or other
  misc_feature (598)..(598): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcagagtgttggcatcgacgttgcctggtaaccaacaaaaacctggccagcctcccagtacctcctcatctaatcggggcatcctanaggatcgaccggcaactccacgactaggttcagtcgaccgaggtcgggttacgtcggggaacaggtacctttccgaaccgttctccgaaccaactccgaaaacgtacaccgtacgggaccgccgttaagaagttattttcgacgtagttcgttattacgtagtcgtaagtattggtagtgggttaagggtacctaccgtaactaccggtttggacccgtaggggaaccgtaagggtggaagtacgtacgaagtaacggtaacgtggtgggccncggtcccaacctacg

SEQ ID NO: 50784 - DNA, 560 bp, Homo sapiens
  misc_feature: GYAE6OF02GPZIU.21.38.D05.1.454.CMB.1.raw
  modified_base (216)..(216): a, c, t, g, unknown or other
  misc_feature (216)..(216): n is a, c, g, or t
  modified_base (325)..(325): a, c, t, g, unknown or other
  misc_feature (325)..(325): n is a, c, g, or t
  modified_base (417)..(417): a, c, t, g, unknown or other
  misc_feature (417)..(417): n is a, c, g, or t
  modified_base (445)..(445): a, c, t, g, unknown or other
  misc_feature (445)..(445): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctctgcaaggccaagtcagagtgttggcatcgacgttgcctggtaccaaacaaaaacctggaccaggctacccagtctcctcatctagtggggcatcctanaggatcgaccggcatccagacaggttcagtgccagtggtctgggacaggacttcactctcatcaattagcagacgtggacaccgtgaaagtnttacgagagttgtaattactgtacagtntaagtataggtaacttccacgttacgtgttacgttacggaccgaacgggtaaccgaaaggtaacgaaacgttacggaaaacgtacgtagggtacgacgtacggtacaaccgtacg

SEQ ID NO: 50785 - DNA, 610 bp, Homo sapiens
  misc_feature: GYAE6OF02I1MJK.21.38.D05.1.454.CMB.1.raw
  modified_base (418)..(418): a, c, t, g, unknown or other
  misc_feature (418)..(418): n is a, c, g, or t
  modified_base (450)..(450): a, c, t, g, unknown or other
  misc_feature (450)..(450): n is a, c, g, or t
  modified_base (479)..(479): a, c, t, g, unknown or other
  misc_feature (479)..(479): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggccaccctgtctctgtctccgaggggaaagagttactctctcctgcaaggccaggtcagagtgttggcatcgacgttgccttaggtaaccaaacaaaaaccgtggaccaggcctcccgagttcctcctcatcctagtcgggctactaccgtacaggatcggaccggcactcccgagacgtagttacagtcgcgaggtggtcgtagggactagaccttcactctaccactanaccaacgacacgtcggcgaccgtagaacgttnttttacgacgtagttacgttactttacgngtacagtagttgtagttcggtaagtccgtaaccgtacgttaaccgttcgggaccgtacggggtaaccgtagggtaccggtaagtactacggaacgtaacggtacgtcggtcggtctacggaccctactacg

SEQ ID NO: 50786 - DNA, 606 bp, Homo sapiens
  misc_feature: GYAE6OF02IAHGK.21.38.D05.1.454.CMB.1.raw
  modified_base (217)..(217): a, c, t, g, unknown or other
  misc_feature (217)..(217): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgagggggaaangttactctctcctgcaaggccagtcagagtgttggcatcgacgttgcctggtaccaacaaaaacctggaccaggctcccagtcctcctcatctagtggggcatcctacaggatcggaccggcactccagacaggttcagtcgccgtaggtcgggtcgtgggacagacttcactctcaccataccaacacacgtcggcgacctagaagtattttacgactaggttagttacttacgtagtcagtagttagtacgttgggttacggtcctacccggtactaccgtttagggacccgtacgggggtaacccgtaaggggtcggtaacgtacgtaccggaacgtaaccggtaacgttgggtacggtaccgttacggaccctaccgttaaccgg

SEQ ID NO: 50787 - DNA, 769 bp, Homo sapiens
  misc_feature: GYAE6OF02HH0XH.21.38.D05.1.454.CMB.1.raw
tcagtcgtcgctcgcacgaccggtgctcgatttagtatctgatagttgggtttggggcagagctctggagaagagctgctcagttaggacccagagggaaccatggaaaccccagcgcagcttctcttcctctgctactctggctcccaggtgtcaccgggagaagttgtcttgacgcagtctccaggccaccctgtctctgtctccgaaggggaaagtgttactctcctcctgccaaggccagtcaggtagtgttgcatcgacgttgccgtggtaaccaacaaaaacctggaccagggcctcccgagtcctcctctactctagtggggctactcctacgaggactcgaccggacacgtccaacgacgtacggttacgtacgtacgtaccgacggttcggggtccggtacggggtacggaacgtaaccgttacctaccgttccctacccgtaaccgtaacctaactaacccgtaaactacccgtaccgggtacggtacccgttacggtaaacgtttaaggttttacgttaccgtagtttacgttacgtttaaaccttcggttaccgtaagtaacgttggttaacgtttacgggttaacgggtttcccgttaacccggttaaaccgtttaacccggtttaaccgggtacccgggtaaccgggggtaaccgggttaacggggttaacggaagggttaacgttaaccggtaaggtaacccggtaaacggttacgggtacgggtaccgtacgggtccgaacccgtttaaccgg

SEQ ID NO: 50788 - DNA, 536 bp, Homo sapiens
  misc_feature: GYAE6OF02F5H82.21.38.D05.1.454.CMB.1.raw
  modified_base (215)..(215): a, c, t, g, unknown or other
  misc_feature (215)..(215): n is a, c, g, or t
  modified_base (400)..(400): a, c, t, g, unknown or other
  misc_feature (400)..(400): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaangttactctctcctgcaaggccagtcaggagtgttggcatcgacgttgcctggtaccaacaaaaacctggccaggctcccagtctcctcatctatggggcatcctacaggatgaccggcatcccagacaggttcagtgccaggtgggtctgggacagtacttcactctcaccatcaacacactgcnctgaagtactttgcattgtattactgtcagtatgttagttggttaggtacctacgtactaccttttacggccgaggggaaccgtaagggtgggagtacgtacgaacgacggtaactggtacggtctgaccactacg

SEQ ID NO: 50789 - DNA, 596 bp, Homo sapiens
  misc_feature: GYAE6OF02I58DE.21.38.D05.1.454.CMB.1.raw
  modified_base (215)..(215): a, c, t, g, unknown or other
  misc_feature (215)..(215): n is a, c, g, or t
  modified_base (567)..(567): a, c, t, g, unknown or other
  misc_feature (567)..(567): n is a, c, g, or t
  modified_base (572)..(572): a, c, t, g, unknown or other
  misc_feature (572)..(572): n is a, c, g, or t
  modified_base (578)..(578): a, c, t, g, unknown or other
  misc_feature (578)..(578): n is a, c, g, or t
  modified_base (585)..(585): a, c, t, g, unknown or other
  misc_feature (585)..(585): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaanagttactctctcctgcaagggccagtcagagtgttggcatcgacgttgcctggtaccaaacaaaaaccgtggccacggctacccagtcctcctcatctagtggggcatcctaacgaggatcggaccggcactccgagacgaggttcagtcgcgagtgggtcgtgacagcttcactctcaccatacaaccactaaccgtcggccgtccgtacggaaagttagttttacggacgtacgttagttactttacgttgtactaggtagttaggttagttagggtaacgggttaccgtaaccgggttaccttaccggttttaccgggaccggaggggtacccggtaaggtggaacggngtaanacgtanacgtggngtatgacgctc

SEQ ID NO: 50790 - DNA, 319 bp, Homo sapiens
  misc_feature: GYAE6OF02F1C0C.21.38.D05.1.454.CMB.1.raw
  modified_base (309)..(309): a, c, t, g, unknown or other
  misc_feature (309)..(309): n is a, c, g, or t
  modified_base (315)..(319): a, c, t, g, unknown or other
  misc_feature (315)..(319): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttcccgcatctgactcgtctctactgagcgggctggcaaggcncatagnnnnn

SEQ ID NO: 50791 - DNA, 591 bp, Homo sapiens
  misc_feature: GYAE6OF02FSYYN.21.38.D05.1.454.CMB.1.raw
  modified_base (216)..(216): a, c, t, g, unknown or other
  misc_feature (216)..(216): n is a, c, g, or t
  modified_base (423)..(423): a, c, t, g, unknown or other
  misc_feature (423)..(423): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaanagttactctctcctgcaaggccagtcagagtgttggcatcgacgtgcctggtaaccaaacaaaacctcggaccacggcctcccagtcctcctctactctagtggggctaatcctacgaggactcggaccggcactacccgagacgtacggttcagtcgacgaggtcggtcgtcggacgtagtacttcactctccacactacaacacncgtcggccgcctaggaagttacgtttgacgtagttgtattacctgtacagtagttgtagttggtacgtacgtacccgtacttaccgtttcggaccgtacggggacctagggtcggaagtacgtacggaacgtaaccggtacgtacgggtcgcgtacggactacctacg

SEQ ID NO: 50792 - DNA, 599 bp, Homo sapiens
  misc_feature: GYAE6OF02GMP4D.21.38.D05.1.454.CMB.1.raw
  modified_base (154)..(154): a, c, t, g, unknown or other
  misc_feature (154)..(154): n is a, c, g, or t
  modified_base (216)..(216): a, c, t, g, unknown or other
  misc_feature (216)..(216): n is a, c, g, or t
  modified_base (341)..(341): a, c, t, g, unknown or other
  misc_feature (341)..(341): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtntcaccggagaagttgtcttgacgcagtctccaggcaccctgtctctgtctccgaggggaaanagttactctctcctgcaaggccagtcagagtgttggcatcgacgttgcctaggtaaccaaacaaaaacctggccaggcctcccgagtctcctcatctagtgggacatcctacaggatcgaccggnactccagacaggttcagtcgcgaggtcggtcgtggacacgtacttcactccgtacacctataccaaacactacgtcgccgtcagtaacgttagtttcgacgtagttgttaacttactacgtacgagtattagtagtggtacggttcaacccgttactaccgtttacggaccgtacggggtaccgtaagggtggtaacgacgttaacgacggtaaacgtaaccgttggtaccggtacgtcggtaccgaacccgttacgg

SEQ ID NO: 50793 - DNA, 623 bp, Homo sapiens
  misc_feature: GYAE6OF02JCAYU.21.38.D05.1.454.CMB.1.raw
  modified_base (216)..(216): a, c, t, g, unknown or other
  misc_feature (216)..(216): n is a, c, g, or t
  modified_base (325)..(325): a, c, t, g, unknown or other
  misc_feature (325)..(325): n is a, c, g, or t
  modified_base (424)..(424): a, c, t, g, unknown or other
  misc_feature (424)..(424): n is a, c, g, or t
  modified_base (450)..(450): a, c, t, g, unknown or other
  misc_feature (450)..(450): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccagggggaaangttactctctcctgcaaggccagtcagagtgttgcatcgacgttgcctggtaccaacaaaacctggaccaggctcccagtctcctcactctatgggcatcctacgagtntacgaccggcactcccgaagacgtaggttcacggtgccaggttcggtactggggacaggtactccgactctccaacctatacaaccgacacgtggaccnccgtagaacggttattttgcaagttntaactttactagtcgtaacgtagttgtaattagggttacggtaccgtaaccgttacccgtaaccggtttcgggaccgtacgggggaaccctaagggggttaggtaacgtaagttaccgaaaggtaacccggtaacgttacgggtcggtacccggtagtaccccggattaccgg

SEQ ID NO: 50794 - DNA, 623 bp, Homo sapiens
  misc_feature: GYAE6OF02JJUAC.21.38.D05.1.454.CMB.1.raw
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaaggggaaatgttacctctctcctgcaaggccagtcaagagtgttgcatcgacgttgccgtacggtaaccaaacaaaacctcggaccgaggcctccagtcctcctacattctagtcgggctactcctacgaggtagtacgaccggctacctacccgagacgtaggttacaggtcgccgtaggtcgggtcgtacgggacacggtaccttcctaccgtacctacctaacctactaccgaaacctacgaccgttacggccgtaccgtaggaacgttgttttcgacgtagttacgttacttacgtcgttacagtattaggtagtggtaacgtcctaccgttatacccggttgaccggtacgggacgtaaggtggaactagtcgtaacgacgtaacgtgtccggtatccgacgtactacgg

SEQ ID NO: 50795 - DNA, 704 bp, Homo sapiens
  misc_feature: GYAE6OF02G801G.21.38.D05.1.454.CMB.1.raw
  modified_base (509)..(509): a, c, t, g, unknown or other
  misc_feature (509)..(509): n is a, c, g, or t
tcagtcgtcgctcgcacgaccggtgctcgatttagtatctgatagttgggtttggggcagagctctggagaagagctgctcagttaggacccagagggaaccatggaaacccagcgcagcttctcttcctcctgctactctggctcccaggtgtcaccggagaagttgtcttgacgcagtctccgaggccacctgtctctgtctcgagggaagtagttactctctctgcaggccagtcagagtgtgcagtcgacgttgccgtgtaaccaaaccaaaaccgtcggaccaacggcctccgacgtcctcctctactctaggtcgggctactcctacgagacgtcgaccgtcacgtccagtacgtacggtcaggtcgaccgtaggtcggttcgtacgggactacggtacttaccgtactccgtaccctaccgtactaaccaaactaaccgtcggtacggacccggtactacgtaacttcggtttacgcgttacggtttaagttactttacggngttaacgtacggtatttacgtaagggttacggtttaccggtaaccgttaacccggttaaccgttaccgggtttaccggggacccggtaacggggggtaaccctaagggggtaacggtaacggttaaccggtagtaaccggggtaacgttaacggttacggttaccggtacgtacgtaccccgtaacgttaaccgg

SEQ ID NO: 50796 - DNA, 665 bp, Homo sapiens
  misc_feature: GYAE6OF02HZIXE.21.38.D05.1.454.CMB.1.raw
  modified_base (215)..(215): a, c, t, g, unknown or other
  misc_feature (215)..(215): n is a, c, g, or t
  modified_base (504)..(504): a, c, t, g, unknown or other
  misc_feature (504)..(504): n is a, c, g, or t
  modified_base (660)..(660): a, c, t, g, unknown or other
  misc_feature (660)..(660): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctctgctactctggctcccaggtgtcaccggagaagttgtcttgacgcagtctccaggccaccctgtctctgtctccgagggaaancgttactctctcctgcaggccagtcagtagtgttggcatcgacgttgccgtaggtaaaccaaacaaaaccgtggaccaggccctccgatccctcctacacttcaggtcgggctaacgtccttaacgaggactacgggacccgtacgtacctacccgaagtacccgtaggtttacacggtacgacccgtaagggttcgggtacggtagggtaacctaggttacctctaccgtcctacacccggtactaaccgaacaaccgtgtacggcctccggtaagttaaccggtttntttaccgattacggttattaacttccgttagtagtaacggttgttagtaccggtaggtttaccgacgttaacccgtacttaacgggttccgaccgggtagggaccgtaagggtcctaaagctaacgaacgtacggtacgtcggtgactcgaccctnttacg

SEQ ID NO: 50797 - DNA, 329 bp, Homo sapiens
  misc_feature: GYAE6OF02FTU9Z.21.38.D05.1.454.CMB.1.raw
  modified_base (317)..(329): a, c, t, g, unknown or other
  misc_feature (317)..(329): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtagtcaccgtacacctttggccgagggaccaaggtggagatcagacgaactgtggctgcaccatcgtgtcttcactccttcccgcatctgactcgtctctactgagcgggctggcaaggcgcatagnnnnnnnnnnnnn

SEQ ID NO: 50798 - DNA, 827 bp, Homo sapiens
  misc_feature: GYAE6OF02JFG4X.21.38.D05.1.454.CMB.1.raw
  modified_base (220)..(220): a, c, t, g, unknown or other
  misc_feature (220)..(220): n is a, c, g, or t
  modified_base (226)..(226): a, c, t, g, unknown or other
  misc_feature (226)..(226): n is a, c, g, or t
  modified_base (248)..(248): a, c, t, g, unknown or other
  misc_feature (248)..(248): n is a, c, g, or t
tcagtcgtcgctcgcacgaccggtgctcgatttagtatctgatagttgggtttgggggcagagctctggagaagagcctgctcagttaggacccagagggaaccatggaaaccccagcgcagcttctcttcctcctgctactctggtctcccaggtgtcaccgggagtaagttgtcttgacgcagtctccaggcaccctgtctctgtctcgagggtaaangttacnctctctgcgtaagccagtcagngtcgttgcagtcgtcgttgcctggtaaccaacaaaacgtgaccgaaggcctaccctacgtccgtcctacgtacttaccgtaggtcggggacctacgtcccttaacggaacggtacgtaccggtaacccggactaaccgtaccccaggtaaccgtacggtttacaaggttccgaccgtagggttcgggtccgtaagggtaccacggttaacgttccgtacctacgtacccaaccgtacctaacaacctacggtaccgtaacggtcctaacccgttaaggtaaaccgtttacgttttcgaacgttacgtttaccgttaaacgtttaccgtagttacgaaacggttagttaggttaaacggggttaccgggtttaaccggttacccgttaaaaccccgttaccgggttttacccgttacccggggtaacccggggttaaccgggggtaacccggttaaggggtttaaccgggtaaaaccggttaccgggttaaacggaaacccgggtttaaccgggttaaaccggttacgggttacccggggttaacgggtcccggtaaacccctacggttttaaccccggg

SEQ ID NO: 50799 - DNA, 836 bp, Homo sapiens
  misc_feature: GYAE6OF02JXJNR.21.38.D05.1.454.CMB.1.raw
  modified_base (231)..(231): a, c, t, g, unknown or other
  misc_feature (231)..(231): n is a, c, g, or t
tcagtcgtcgctcgcacgaccggtgctcgatttagtatctgatagttgggtttggggcgagagctctggagaagagctgctcagttaggacccagagggaaccatggaaaccccagcgcagcttctcttcctcctgctactctcggctcccaggtcgtcaccggagaagttgtcttgacgcagtctccgaggccaccctgtcctcgtgtctccgagggaaagacgtttccncttctccgtgacgaaacggcctaggtaccgaggtacgttggttacgacgtacgtcgtaaccgttcgaccgtacggtaaccgaaaacccgaaaaaccgtccggaccgtacgggtacccgtaccccgtacggttaccctccccgttacaaccgttaccgttacggtacgggaccttaaccgttaccccgtaaccgtaggtaaccggttccgacccggtactaaccgtacccgagtaaccggtacggtttacacggtacgccgtacgggttacgggtcgtacgggactaacggtaccttacgtactaccgtacaccgtaacgtacccaacgtaccgtacgtacgtcccggaccttacgggttaaacgtttgtttaaccggtacgtacgttaggtttaacgttaccgtaccgttacgttaaggtactttaagggtacgggttttacggttaaccggtacccgttaacggtttaaaccccgtaaccggtttcgggttaaacccggccggggttaaccggtaacgggttaggggaaacccgttttagaaccggttaaccggtaacggtaccgggttagttaacggcccgtacggtacccgtacccttacgg

SEQ ID NO: 50800 - DNA, 742 bp, Homo sapiens
  misc_feature: GYAE6OF02GY7RJ.21.38.D05.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcacctgtctctgtctccgaggggaangttactctctcctgcaaggccagtcagtagtgttgcatcgacgttgcctggtaaccaacaaaacctggaccaggcctcccagtccgtcctcatctagtcggggcatcctagaggatcggaccggcactcccagacgtaggtttcaggtcgaccgaggttcgggttacgtggggaactaacggtacctttcgaacgttccgttaccaaccgtagttaccaaaccgtacctaaccggttcggacccgtaccttagggtaaaacgttacgttttttacggaaccgttaaggttacggtttaacgtttaacgtttcggtaaccgtaagggtactttagggttaacgttcgggttaaacggttacccgtaacccggttaacctttaacccgggtttcgggtaacccgggtaacgggggtaacccgtaaagggggtaccgggttaaacgaaccggttaccggtaaacggtaacccgggtaaacgtttccgggggttacggtacccgttacggtacccgtaacccgtttaaccgg

SEQ ID NO: 50801 - DNA, 666 bp, Homo sapiens
  misc_feature: GYAE6OF02F447D.21.38.D05.1.454.CMB.1.raw
  modified_base (215)..(215): a, c, t, g, unknown or other
  misc_feature (215)..(215): n is a, c, g, or t
  modified_base (305)..(305): a, c, t, g, unknown or other
  misc_feature (305)..(305): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaaggggaangttactctctcctgcaaggccagtcagagtgttggcatcgacgttgcctggtaaccaaacaaaacctggccaggcctacccagtctcctnactctagtcggggcactccgtaacgaggagtcggaaccggcactacccgaagtaccaggttacaggtcgccgaggttgggtctggggacacgtactttacacgtctacgaacctactaccaaacaccgacgtacgggccgtaccctaggtaaacttagttttcgacgtagttacgttaagtttaccctaggtacctaaggtattagggttaagttgggttacggtaccttaaacccggttacccttacgtttacgggacccggtacgggggtaaccctaaggggttacggaacgtcgttaacggaacgtaaccggttaacggttcggacgggttacccgttacggacccgtaccgttacgg

SEQ ID NO: 50802 - DNA, 643 bp, Homo sapiens
  misc_feature: GYAE6OF02FZ5CI.21.38.D05.1.454.CMB.1.raw
  modified_base (216)..(216): a, c, t, g, unknown or other
  misc_feature (216)..(216): n is a, c, g, or t
  modified_base (320)..(320): a, c, t, g, unknown or other
  misc_feature (320)..(320): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagagtgttggcatcgacgttgcctggtaccaacaaaacctggccaggctcccagtctcctcatctatggggcatcctanaggatggaccggcactcccagacaggttcagtcgccgaggtgggtcgtgggacaggtaccttcgaactctacctaccactaccaacacctacgtcggccgaccgttagaaacgtatttttcggacttaggttagttaactttacttcgtactaagtattaggtaagtttgggttacggttacctaacccggtttacgtacccgtttttacgggacccggttacgggggaaccgtaaggggttcgggaacgttaacggttaccgtaaggaaccggttaacgttcgggttacgggtaccggttacggtaccgtacccttaaccgg

SEQ ID NO: 50803 - DNA, 843 bp, Homo sapiens
  misc_feature: GYAE6OF02I4Z5I.21.38.D05.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaanagttactctctcctgcaaggccagtcagagtgtggcagtcgacgttgccgtggtaaccaaactaaaaaccgtggacccaggtcctacccgacgtcctcctactacttactaggtcgggacacttacctagaggtacgtacgacccggactactacccgaggtaaccgtaacgggttacacggttccgtaccggtaaggttcggggtaccgttagggggaacctacggtaccgttaccgtacctaccgttacccaaccgtaaccttaaccgaaacccgaacctacggttacggtcccggtaccgtaacggtaaagtttaccgttttaggaaccgttacggtttaagtttaccgtttaaacgtacgttaacgaacggtttacgtttacggtttaacgttacgggggttaaccgttaccccgttaaaccggttaacccgtttaacccgggtttttaccggggaacccgggtttaaaccgggggggaaacccgttaaacgggggtttaacggggtaaccgggttaaaccggtaacccggtaaaacgggggttaaacccggtaaaccgggtttcggggttaaaccggggtccccgttaaaccgggtaccccgttaaaccgggttaaccccgg

SEQ ID NO: 50804 - DNA, 825 bp, Homo sapiens
  misc_feature: GYAE6OF02IJBEL.21.38.D05.1.454.CMB.1.raw
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccgaggcacctgtctctgtctccgagggaatacgttactctctcctgacgaacggccagtcaggtagttggttcggactagttacggtacggtttccgtacccgttacgggtaaacccaaaaccgtaaaaaacccgttcgggacccgaacggtccctacccgtacgtccctcccgtactacttcgtaaggttcgggactactaccgtaacgacgggtacgtacggaacccggtctacgtaccccgaagtaccgtagggttccaacggtccgtacgtacgggttcgggtcgtacgggaaccgtacggttaccttccgtacctttacctacccgtacctaaacctaccaaacccgtaaccgtacgtaccgggtcccgtaaccggttacgtaaacggttttacttttaacgggaccgtttaaaggtttacgtttaaacgttccgttaacggtttacgtaaaggtttacggttacggttaacggtttacggggttaccgttacccgttaaacccgggtttaacttccccgggttttaacggccgggttaacggggtaacccggttaaggggtcggtaaacgtcggtaaccggtaaggtaaccggttacggttcgggtaccggtaccgtacgttcccgacttaccgg

SEQ ID NO: 50805 - DNA, 596 bp, Homo sapiens
  misc_feature: GYAE6OF02JHGNK.21.38.D05.1.454.CMB.1.raw
  modified_base (215)..(215): a, c, t, g, unknown or other
  misc_feature (215)..(215): n is a, c, g, or t
  modified_base (393)..(393): a, c, t, g, unknown or other
  misc_feature (393)..(393): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgagggaaangttactctctcctgcaaggccagtcagagtgttggacagtcgacgttgccgtggtaccaaacaaaacctggaccaggcctcccagtcctcctacatcgtagtcgggcactccgacgaggactcgaccggcactccagacgtggtcagtcgacaggtggtcgtggacagtactcactcncacatcgaactacgacgtcggctacgtagtaagttatttcggactagttacgttattaccgtgtacttaaggactttgggaacgttgggtaaccgttacgtaaccgttactaccggtttacggccggtacgggtaaccgaggtgggtaacagttacgaacggtaacgtacggtcggtaccggtcgtacggtaccacgttaccg

SEQ ID NO: 50806 - DNA, 621 bp, Homo sapiens
  misc_feature: GYAE6OF02GUD9H.21.38.D05.1.454.CMB.1.raw
  modified_base (216)..(216): a, c, t, g, unknown or other
  misc_feature (216)..(216): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangttactctctcctgcaaggccagtcagagtgttggcatcgacgttgcctaggtaaccaacaaaacctggaccaggcctcccagtcctcctcactctagtggggctatcctacgaggtagtacggaccggacacgtacccagacaggttcagtcgcctaggtcgggtacgtagggactagtacttcacgtcctacaccactacaacacctacgtcgggaccgtaccgtaggtaagttacgttttagaccgttagttacgttaactttacgtgttacgaagtacgttagttagttaggtacgtacgtaaccgtacgtacgttcggaccgtagggtaccgtagggtacggaagtacgtacgaacggtacgtaacggttcggtacggtacggtacgtacctaccgtacg

SEQ ID NO: 50807 - DNA, 678 bp, Homo sapiens
  misc_feature: GYAE6OF02G23DE.21.38.D05.1.454.CMB.1.raw
  modified_base (325)..(325): a, c, t, g, unknown or other
  misc_feature (325)..(325): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctcgagggaatgttactctctcctgacaagccagtcagagtgtgcatcgacgttgcctgtaaccaaacaaaaccgtgaccacggcctcccagtcctcctcactctagtcgggctactcaacgngtatcggaccgcactccagacgagttcacggtcgacgtaggtcggtacgtgggactacggtacctttccgaccgttccacctaacccgtacttaacccaaaccgaccttaacgtcgggccgtaccgtaacggtaacgttagttttcgacgtaacgtttagttactttaccgtagtacgtaaggtacgtttaggttagttagggttaaccgttacccgttaaccggttaccgtttaaccggttacgggacccgggtacgggtaaccggtaggggtacggtaaaggtacgttaaccgaaggtaaccggttacgttacgggtccggtacccgttacggtacccgtaagttacccgg

SEQ ID NO: 50808 - DNA, 689 bp, Homo sapiens
  misc_feature: GYAE6OF02ITE4M.21.38.D05.1.454.CMB.1.raw
  modified_base (216)..(216): a, c, t, g, unknown or other
  misc_feature (216)..(216): n is a, c, g, or t
  modified_base (255)..(255): a, c, t, g, unknown or other
  misc_feature (255)..(255): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaaangtttactctctcctgacaaggccagtcagtagtgttggnatcgacgttgcctaggtaccaaacaaaaccgtgaccaggtcctccctagtcctctacactcgtagtcgggacattcccagacggtatcggaccgacacgtaccagtaccgacggttacagttcgaccgtaggtcggtcggagggtacacgtactccacgtacctccgacctacgaccaaaccaccgtacgtcggtccgtaccttaacgtaagttactttacgactaggtttacttacgttacgttacgtacgtaggttaacttaggttacgttacgggtaaccgtttaccgtaacccggtttacttaacccgggttttccgggaaccgggtaaccggggtaaccgttaaggggtacggtaaagtaccgggttaaccgaaggtaaccggttaacgttcggggttaccggtaccgtacggttcccaaaccgtttcg

SEQ ID NO: 50809 - DNA, 634 bp, Homo sapiens
  misc_feature: GYAE6OF02HGPT3.21.38.D05.1.454.CMB.1.raw
  modified_base (154)..(154): a, c, t, g, unknown or other
  misc_feature (154)..(154): n is a, c, g, or t
  modified_base (163)..(163): a, c, t, g, unknown or other
  misc_feature (163)..(163): n is a, c, g, or t
  modified_base (272)..(272): a, c, t, g, unknown or other
  misc_feature (272)..(272): n is a, c, g, or t
  modified_base (529)..(529): a, c, t, g, unknown or other
  misc_feature (529)..(529): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctctagctactctggctcccaggtntcaccgganaagttgtctgacgcagtcctccaggctacccgtgtctctgtctaccgaggggtaaactgttacctcgtctccgtgacctaaggccctagtccagtaggttgttcggacnttaccgacgttgaccgtgtaacctaaacgtaaaaccgtcggacctacggtcctacccgtacgtcctaccgtactataccgtacggtgggacctacgtacccgtagacggtactcggaccggctacgaccgtacgagtacgtcagtcgcgtaggtcgtacgtggctagccttactacgtcacgtaacctataccaactacctcgtacgcgtactagtaagttcgtttcgactagttatacgttagtcgttgaacgttnttaacgtagttcgtacggttcgtaaccgttacgtaccgtaccggtacgagggtaccagggtgacgtacgcgtacgaagtacgttcggagtactgtacctacgtac

SEQ ID NO: 50810 - DNA, 322 bp, Homo sapiens
  misc_feature: GYAE6OF02HG5RN.21.38.D05.1.454.CMB.1.raw
  modified_base (316)..(322): a, c, t, g, unknown or other
  misc_feature (316)..(322): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtgctgcaccatctgtcttcatcttcccgccatctgactcgtctctactggagcgggctggcaaggcgcatagnnnnnnn

SEQ ID NO: 50811 - DNA, 364 bp, Homo sapiens
  misc_feature: GYAE6OF02F4E09.21.38.D05.1.454.CMB.1.raw
  modified_base (277)..(277): a, c, t, g, unknown or other
  misc_feature (277)..(277): n is a, c, g, or t
  modified_base (320)..(320): a, c, t, g, unknown or other
  misc_feature (320)..(320): n is a, c, g, or t
  modified_base (322)..(322): a, c, t, g, unknown or other
  misc_feature (322)..(322): n is a, c, g, or t
  modified_base (324)..(324): a, c, t, g, unknown or other
  misc_feature (324)..(324): n is a, c, g, or t
  modified_base (329)..(329): a, c, t, g, unknown or other
  misc_feature (329)..(329): n is a, c, g, or t
  modified_base (331)..(331): a, c, t, g, unknown or other
  misc_feature (331)..(331): n is a, c, g, or t
  modified_base (334)..(334): a, c, t, g, unknown or other
  misc_feature (334)..(334): n is a, c, g, or t
  modified_base (340)..(364): a, c, t, g, unknown or other
  misc_feature (340)..(364): n is a, c, g, or t
tcagtcgtcgctcgcacgaccggtgctcgatttagtatctgatagttgggtttgggatctatggggcatcctacaggatgaccggcatcccagacaggttcagtgccagtggtctgggacagacttcactctcaccatcaacacactggcgcctgaagattttgcagtgtattactgtcagatgtatggtaggtcacgtacacctttggccagggaccaaggtgagatcgagacgaactgtggctgcaccatctgtcttcattccttcccgcatctnacctcgtctctatgagccgggctgggcaaggccacgagtacgngncngatcncnganatcatnnnnnnnnnnnnnnnnnnnnnnnnn

SEQ ID NO: 50812 - DNA, 794 bp, Homo sapiens
  misc_feature: GYAE6OF02JEZLW.21.38.D05.1.454.CMB.1.raw
  modified_base (214)..(214): a, c, t, g, unknown or other
  misc_feature (214)..(214): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctccaggtgtcaccggagaagttgtcttgacgcagtctccaggccacctgtctcgtctctacgagggaanagttactctctacgtgacacggcctagtcagagttcggttacgctaagtcgtacgttcgaccgttacggtaaaccgaaaacctaaaaccgttcgggtaacccacgggtaccccttaccccgaacggttccctacccgtactacgttaccgtaacggtcgggtacctaaccgtacctaacggtaacggtactacggacccggtacctacgtacccgacgtacgtacgttcgacgtcggacgagggttcggtacgtacggactacggtaccttacaccgtccgtaacaaccctacgtaaccaaccgtaccgtagttccggtaccgacgttaacgggtaaacttcgttacggacgttaacggttacgttaacgttactcggaacgttaggttaacttagggtttacgtaaacgggttaccggttacccttaaacgggttcccgtttaaacgggttccgggtaaccggggtaaccggttaaccgggtaagggtttaaccgggacgtttaaccgggtaccgtaaccggttaacccgggtagttaaccgggtcggtacccggtttaaacgccggtaaccttacggg

SEQ ID NO: 50813 - DNA, 685 bp, Homo sapiens
  misc_feature: GYAE6OF02I1XT2.21.38.D05.1.454.CMB.1.raw
  modified_base (548)..(548): a, c, t, g, unknown or other
  misc_feature (548)..(548): n is a, c, g, or t
  modified_base (586)..(586): a, c, t, g, unknown or other
  misc_feature (586)..(586): n is a, c, g, or t
  modified_base (591)..(591): a, c, t, g, unknown or other
  misc_feature (591)..(591): n is a, c, g, or t
  modified_base (652)..(652): a, c, t, g, unknown or other
  misc_feature (652)..(652): n is a, c, g, or t
  modified_base (672)..(672): a, c, t, g, unknown or other
  misc_feature (672)..(672): n is a, c, g, or t
  modified_base (680)..(680): a, c, t, g, unknown or other
  misc_feature (680)..(680): n is a, c, g, or t
tcagtcgtcgctcgcacgaccggtgctcgatttagtatctgatagttgggtttggggcagagctctggagaagagctgctcagttaggacccagagggaaccataggaaaccccagcgcagcttctcttcctcctgctactctggcctccgaggtgtcaccggagaacgttgtcttgacgcagtctccaggccaccctgtctctcgtcctccgaagggtaagtcgtacctctcctccgtgaccgaacggacctaggtaccaaggtaggttcggttggactacgttaccgtacggtttccggtacccgttaacggtaaaccccaaaaaccgtaaaaacccggtccgggacccgtaacgggaccctaccccgtacgttccttccctaccgtactacgtacggtcgggtacctaaccgtaccgtaacgagggacgtaccggacccgataacccgtccgtaagacgtacggttacgaggtcggtaccgtaggggttcggttacgagggacctacgtaccgtacctcgtactaccactacctaacaacgaccncggtcgccacgtacgtaattgttagctgttctactagngttanagtattgtagtcggttacgacctacgtactccggttagaccggacgacgtaggcgagtacncgaacgtagtacgtggtccngccgtacncctag

SEQ ID NO: 50814 - DNA, 402 bp, Homo sapiens
  misc_feature: GYAE6OF02F5J24.21.38.D05.1.454.CMB.1.raw
  modified_base (229)..(229): a, c, t, g, unknown or other
  misc_feature (229)..(229): n is a, c, g, or t
  modified_base (328)..(328): a, c, t, g, unknown or other
  misc_feature (328)..(328): n is a, c, g, or t
  modified_base (330)..(330): a, c, t, g, unknown or other
  misc_feature (330)..(330): n is a, c, g, or t
  modified_base (332)..(332): a, c, t, g, unknown or other
  misc_feature (332)..(332): n is a, c, g, or t
  modified_base (334)..(334): a, c, t, g, unknown or other
  misc_feature (334)..(334): n is a, c, g, or t
  modified_base (343)..(402): a, c, t, g, unknown or other
  misc_feature (343)..(402): n is a, c, g, or t
tcagtcgtcgctcgcacgaccggtgctcgatttagtatctgatagttgggtttgggatctatggggcatcctacaggatgaccggcatcccagacaggttcagtgccagtgggtctgggacagacttcactctcaccatcaacacactggcgcctgaagattttgcagtgtattactgtcagatgtatggtagtcaccgtacacctttggccaggggaccaaggtgganatcagacgaactggtggctgcaccatctgtacttcactctcccgcatctgactcgtctctactgacgcgggtctcggcgaaaggtccgactattacggntngntncagcagcgnnnnnnnnnnnnnnnnnnnnnnnnnnnnnnnnnnnnnnnnnnnnnnnnnnnnnnnnnnnn

SEQ ID NO: 50815 - DNA, 745 bp, Homo sapiens
  misc_feature: GYAE6OF02GP48L.21.38.D05.1.454.CMB.1.raw
  modified_base (179)..(179): a, c, t, g, unknown or other
  misc_feature (179)..(179): n is a, c, g, or t
  modified_base (405)..(405): a, c, t, g, unknown or other
  misc_feature (405)..(405): n is a, c, g, or t
  modified_base (533)..(533): a, c, t, g, unknown or other
  misc_feature (533)..(533): n is a, c, g, or t
tcagtcgtcgctcgcacgaccggtgctcgatttagtatctgatagttgggtttggggtcgagagctctggagaagagctgctcagttaggacccagagggaaccatggaaaccccagcgcagcttctcttcctctagctactctgctcccaggtgtcaccggagaagttgtcttgacgnagtcctcaggcaccctgtctctgtactccgaggggaatagttactctctactgcgaacgcctagtcagacggtgttcgacgtatcgacgttgaccgtgtaacgtaaacctaaccgcgtaacgacgtcctaccggtactacctaccgtctacgttacgaggtcgacctacgtactacgacggtagtaccgggtaccatacccgtagcccgtaacgacgttcggtaanccggtcgtaaggtcggacgttaacggggacaacggtacgtttccgacctacggtaccaaccttactaacgaaccctacgttccaccggtacgtacctaaggtacgttagttccggtactaacgggttnttaaccgtttatacggtaacgttacgaacgtttacggtacgttacggtacggttaaccccgaaatttcccggttaacgtaacccggttaccggggaacgggttaccggtaaacgggtaccggtagggttaaccccgtaggtttaaaccgggaaacgtttcccgggtaacggtttaccggacccggacgtttacccggtaaacccggttcccg

SEQ ID NO: 50816 - DNA, 598 bp, Homo sapiens
  misc_feature: GYAE6OF02FYKGV.21.38.D05.1.454.CMB.1.raw
  modified_base (217)..(217): a, c, t, g, unknown or other
  misc_feature (217)..(217): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgagggggaaangttactctctcctgcaaggccagtcagagttgtgcatcgacgttgcctggtaccaacaaaacctggaccaggcctcccgagtcctcctcatacgtagtcggggcacgtcctacaggactcggaccggctactcccgacgacgtacggttcagtcgccgaggttcgggtcgtagggactagtacttcactctccacatacaacaccactcggccgtacctagaagttacgttttcgactagttcgttattactgtcagtattgttagtgggtacgttccgtaaccgtacgttaccgtttcgggaccgtaggggacccgtaagggtcggaacgtacgtacgaacggtaaccgtaacgtggtacgcggtacgaccgtacgtacg

SEQ ID NO: 50817 - DNA, 854 bp, Homo sapiens
  misc_feature: GYAE6OF02G3JGX.21.38.D05.1.454.CMB.1.raw
  modified_base (217)..(217): a, c, t, g, unknown or other
  misc_feature (217)..(217): n is a, c, g, or t
tcagtcgtcgctcgcacgaccggtgctcgatttagtatctgatagttggggtttggggcagagctctggagaagagctgctcagttaggacccagagggaaccatggaaaccccagcgcagcttctcttcctcctgctactcgtggcctccaggtgtcaccggagaaggttgtcttagacgcagtctccaggcacctgtctctgtctcggagggaangttactctctcctagccgaaggccagtcaaggtatgttgctagtcgtacgttgccttacggtaaccccaaaactaaaacccgtcggacccgtaacgggtccccttaccccgtaacgttacccgtcccgttaccgtacgtttaccggttaacgggtccggggtaacctacccgttaacccgtaacccggtaagggggttaacctaccgggaaccccgggtaacctaaccgttaccccccgaaaggtaaccgtacgggtttacgtacgggtcgtaccccggtaaggggtttcgggtaccgttaggggaaacccgtataacccgtttccaacctttacctaccgaacccttacgtaaaccgtaaaccccgtaacgtaacccgttgggaccccgtacctagggttaaacggtttactttttcggaaccggttagttaccggttttaactttacggttacccgttaagagttaaacgttcggttaaggtttacgggttaacggttcccctaaaccggtttacgttaaccccgggtttaggggaccgttaaccgggggtaccgtaaaggggttccggaagttacgtacggtaacggacccggttaagtccgggtaccgtaacgggtctaaccggactaaccgg

SEQ ID NO: 50818 - DNA, 615 bp, Homo sapiens
  misc_feature: GYAE6OF02GQ75B.21.38.D05.1.454.CMB.1.raw
  modified_base (215)..(215): a, c, t, g, unknown or other
  misc_feature (215)..(215): n is a, c, g, or t
  modified_base (491)..(491): a, c, t, g, unknown or other
  misc_feature (491)..(491): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaanagttactctctcctgcaaggtccagtcagacgtgttggcatcgacgtttcgcctggtaaccaaactaaaaacctggaccaaggcctacccgaagtcctcctactactctacgtggggctatcctaacgaggatcggaccggtcactcccagacgacggtttcgagtcgtccaggttcgggtcgtaggggacacggtacttccacgttccacaacctataccaactaaccacgtcggcctccgtagaaagttctttcgactagttagttacttacgngttacagtatgtaggtggtagttacacccgtacttaccgtttggacccggtaggggtaaccagggttagaaggtactacggaagaaccggtacttcgggtagccgtttacgaccaccgttaacg

SEQ ID NO: 50819 - DNA, 930 bp, Homo sapiens
  misc_feature: GYAE6OF02IEUKO.21.38.D05.1.454.CMB.1.raw
tcagtcgtcgctcgcacgaccggtgctcgatttagtatctgatagttgggtttggggcagagctctggagaagagctgctcagttaggacccagagggaaccatggaaacccagcgcagcttctcttcctcctgctactctggacctcccgaggtcgtcaccggagtagttcgtcttgacgcagtctaccgacggtccacccgttgtcctctgtcctaccggaggggtaaatcgttactccgtactccgtgacaaacggtccaggtcaggtacggttggttcgactacgttcggtacggttcgtcccgttacggtaaccctaaaaccgtaaaaaccgtcggtaccgtaacgtccgttaccccgtaacggttcccttaccttaaccgtactttaccgtaacggttacggggtccgtaaccgttacccgtaaccggtagggtaaccgtacgggtaaccccggggtacctaacgttaccccggaaagacccggttaacggtttccggaacggttcgaccggtaagggttccgggtacgggttacgggaacgtaccgtacccgttacgtacccgtttaccgtaacctaccgtaaccgtaaccctaaaccgtaacccgtaccggttaccggtacccgtacgttaacggttaaacgttgttttaaccgggactttaacggttacgtttacggtttaacgtaccgttagttaaacggttacgtttggttaacggtaccgggtttaacgtaccccggttaaacccgtttaacccggttaccggttttaaccgggtacccggggtaaccgggggttaaacccgggtaaacgggttacggggtacgttaaaacccgttcgggtaaaaccggtaaccggtttaaccgggttcggggtttaaaccgtcccgggtaaccggttaccccgttacggttaaccgg

SEQ ID NO: 50820 - DNA, 740 bp, Homo sapiens
  misc_feature: GYAE6OF02IM0D8.21.38.D05.1.454.CMB.1.raw
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccgaggtgtcacggagagttgtcttgacgcagtctcgaggccacctgtctcgtgtctcgaagggaatacgttactctctcctgacgaacgccagtcagtgtgtcgcatcgacgttcgccgtacggtaaaccaaacgtaaaacctcggaccgacggcctcccgtacgttcccgtacctctacgtacgtacggtggacctacgtaccgtaacgaggtacgtacggacccgtacaccgtacccgagtaccgtacggttacacggtccgacggtacggttacgggtccgtacgggaacgtacgttaccttacgtccgttacccgtactaacccgactaaccgaaacctaccgtacggtacggccgtaccgttagtaaacgtttacgttcgtacgttacggtttacttacgttaccgtacggtcgtaaacgttagttacggtaggttacggttaccgttaccgttaaacccggttagtacccggtttaaccggaccggtaccggggtaacgtacgggtaacggttacgacggttaaccggaacgtaacccggtacgtaccgggttaccgacgggtacccgtacccgtacgttaaccgg

SEQ ID NO: 50821 - DNA, 675 bp, Homo sapiens
  misc_feature: GYAE6OF02F374O.21.38.D05.1.454.CMB.1.raw
  modified_base (518)..(518): a, c, t, g, unknown or other
  misc_feature (518)..(518): n is a, c, g, or t
tcagtcgtcgctcgcacgaccggtgctcgatttagtatctgatagttgggtttggggcagagctctggagaagagctgctcagttaggacccagagggaaccatggaaacccagcgcagcttctcttcctcctgctactctggctccaggtgtcaccggagaagttgtcttgacgcagtctccgaggcaccctgtctctgtctaccgagggaaatgttactctctctcgcaaggccagtcagagtgtggcatcgacgttgcctaggtaaaccaaacaaaaccgtggaccacggcctacccagtcctcctactactacgtagtgggactactccgtaacgaggacgtacgaccggacaccgtacccgaacggtaaccgtacggtttacgaacggtcggtacccgtagggttcggggttaccggtacggggaactacgtaccttaccgtacctacctaccaacctactaccaaccaccgtaacgtcggaccgtactagacgtttatttcgacttaggttntaacgtttacgtagtctaggtattacggtagttacgggttacgtcttaaccgttaacgttccgtttaggaccggtacggggtaactaggggtacggtaacgacggtaccgaacggtaacgtaacgttcgggtaccggtctaccgtacgtacctacgg

SEQ ID NO: 50822 - DNA, 409 bp, Homo sapiens
  misc_feature: GYAE6OF02HXZK7.21.38.D05.1.454.CMB.1.raw
  modified_base (163)..(163): a, c, t, g, unknown or other
  misc_feature (163)..(163): n is a, c, g, or t
  modified_base (255)..(255): a, c, t, g, unknown or other
  misc_feature (255)..(255): n is a, c, g, or t
  modified_base (264)..(264): a, c, t, g, unknown or other
  misc_feature (264)..(264): n is a, c, g, or t
  modified_base (353)..(353): a, c, t, g, unknown or other
  misc_feature (353)..(353): n is a, c, g, or t
  modified_base (355)..(409): a, c, t, g, unknown or other
  misc_feature (355)..(409): n is a, c, g, or t
tcagtcgtcgctcgcacgaccggtgctcgatttagtatctgatagttgggtttgggatctatggggcatcctacaggatgaccggcatccccagacaggttcagtgccagtgggtctgggacagacttcatctcaccatcaacacactggccgcctgaaagtntttttgcagtgtattactgtcagatgtatggtaggtctaccgtactacctttggaccgaggggaccaagggtggaagatcgagacgactggnggctgcacntctgtcttcacttccgtcccactatctagtacctcgttctactagtcggagggtccggcgtggacgacgggaccagttaacacgtgcantnnnnnnnnnnnnnnnnnnnnnnnnnnnnnnnnnnnnnnnnnnnnnnnnnnnnnnn

SEQ ID NO: 50823 - DNA, 787 bp, Homo sapiens
  misc_feature: GYAE6OF02IK995.21.38.D05.1.454.CMB.1.raw
  modified_base (270)..(270): a, c, t, g, unknown or other
  misc_feature (270)..(270): n is a, c, g, or t
tcagtcgtcgctcgcacgaccggtgctcgatttagtatctgatagttgggtttggggcagagctctggagaagagctgctcagttaggacccagagggaaccatggaaacccagcgcagcttctcttcctctgctactctggcctcccaggtgtccaccggagtaacgttgtcttgacgcagtctccgaggcacctgtctctagtctacgaagggaatgttactctctacctgacgaagccaagtcagtagttgtgactagtcgacgttnccgtacggtaacccaaaacgtaaaccgtggaccacggacctaccctagtccctcctactactccgtaggtcgggacttactacccgtaagacggtaacgtacgaccggactaccacccgaacggtactacggttacacggtccggtaccgtagggtccggttcggtacgggaccgttaacggttaccttcgacccgttctaacccaccgtaacttacaaacgtccctaacggtcgggtaccgttacgtaacggttaaccgttagttttacgaccggttaaaggtttccgtaacgttttcctacggttaccgttaagtacggtttagggttaacgtacgggtttaacccgtacggttaacccccgttaaacgttacccggggttacccggggtaaccggtacgggggtaaacccggttaaggggtacccggttaacgtaacccggtaacggtaaacccggtttaaaccgcgggtttccgggtaacccgggttcctaagggtacccccttaaggtccgg

SEQ ID NO: 50824 - DNA, 620 bp, Homo sapiens
  misc_feature: GYAE6OF02GX4DP.21.38.D05.1.454.CMB.1.raw
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccgaggtgtcaccggagaagttgtcttgacgcagtctccaggcacctgtctctgtctccgaggggaaagagttactctctcctgcaaggccagtcagagtgttcggcatcgacgttgcctaggtaccaacaaaacctggaccaggcctccagttctcctctatcgtagtcgggggctactcctaacgacggtagtcggaccggcactacccgaagaccgtaggttcaggtcgaccgaggtgggtcgtagggacgagtacttcactcctacacctactaccacctacgacgtggacgtccgtagtaacttagtttgactagttagttacttacgtgtactacgtactacgttagtcggtactctcctaccctccgtattacgttaccttacggtttcgggaaccggtaggggtaaccgtaagggtaacgtaaacgtacgaaacggtacgttaggtacggtaccgtagtaacccg

SEQ ID NO: 50825 - DNA, 788 bp, Homo sapiens
  misc_feature: GYAE6OF02JPDKU.21.38.D05.1.454.CMB.1.raw
  modified_base (153)..(153): a, c, t, g, unknown or other
  misc_feature (153)..(153): n is a, c, g, or t
  modified_base (181)..(181): a, c, t, g, unknown or other
  misc_feature (181)..(181): n is a, c, g, or t
  modified_base (188)..(188): a, c, t, g, unknown or other
  misc_feature (188)..(188): n is a, c, g, or t
  modified_base (199)..(199): a, c, t, g, unknown or other
  misc_feature (199)..(199): n is a, c, g, or t
  modified_base (235)..(235): a, c, t, g, unknown or other
  misc_feature (235)..(235): n is a, c, g, or t
tcagtcgtcgctcgcacgaccggtgctcgatttagtatctgatagttgggtttggggcagagctctggagaagagctgctcagttaggacccagagggaaccatcggaaaccccagcgcagcttctctcctcctgctactctggctccaggtntcgaccggagagttgtctgacgcagtcnccagccncccgtgtcctntcgtcctacgaagggtaaatcttactcctcgttccngagaacggcctgtacgaggagttgtcgactatcggtacgttcgtcgtacgtaaaccaaaccgtaaacgcggaccgtcgtacctcccgtagtccctccgtacgtactcgtacggtcgggtactaccgttccgaacgacgtacgtcgggtacccggtcaaccttacccgaacgtaacgttcggtacgtacgttacggccgttaagggtccgggttacgaccggtaagtcccgtaacttccaccggtttacctaaccgtaaccgtaccggtaaacctaaccgtaccggtaaccgttccgggtaacgaccgttaaacggtacgttttacgtaccgttaaccggtagtttaccgtttaacgttaacgtttcgtaaacgttggttaaggttaccgtttaaggggttaccggtaacccgttaccgttaaaccgttacggttcccggttaagggtaacccggtaacggggtaaccgggtacgttaaacgggccgtttaataccgggtaaaccgttacccggtagggtcctacgggtcgtaccgtactacccggttaaccgg

SEQ ID NO: 50826 - DNA, 633 bp, Homo sapiens
  misc_feature: GYAE6OF02FRXTA.21.38.D05.1.454.CMB.1.raw
  modified_base (215)..(215): a, c, t, g, unknown or other
  misc_feature (215)..(215): n is a, c, g, or t
  modified_base (333)..(333): a, c, t, g, unknown or other
  misc_feature (333)..(333): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccgaggggaanagttactctctcctgcaaggccagtcagagtgtgcatcgacgttgcctggtaaccaacaaaaccgtggaccaggcctacccgagtcctccgtcatccgtagtggggcatcctacaggntacggaccggcactacccgagtacgtacggttcagtcgccgaggtcggtacgtcggacacgtacttcacctctccaacctactaaccaacgtacctacgtcggacccgtccgtagtaaacgttgtttacgacgtagttacgtaactttcgtacgtacgtagtagttggttacgttcggttacggtaccgtaacgtaccgttaccgttacgggaccggtacggggtaaccgtaaggggtacggtaacggtaactacggaacggtaacgtacgttgggtacggtcgtcggtacctacgtacg

SEQ ID NO: 50827 - DNA, 781 bp, Homo sapiens
  misc_feature: GYAE6OF02HBDIV.21.38.D05.1.454.CMB.1.raw
  modified_base (234)..(234): a, c, t, g, unknown or other
  misc_feature (234)..(234): n is a, c, g, or t
  modified_base (242)..(242): a, c, t, g, unknown or other
  misc_feature (242)..(242): n is a, c, g, or t
tcagtcgtcgctcgcacgaccggtgctcgatttagtatctgatagttgggtttggggcagagctctggagaagagctgctcagttacggacccagagggaaccagtacggaaaccccagcgcacgcttctcttccctctgcctactctggcctccgaggtctccgaccggagagttgtcttgacgtagtctccgaggccaccctgtctctcgtcacggaagggaatacgttacnctcctcgngacgaacggccagtacgagtagttggtagactagtacggtcgttcgccgtacggtaaaccaaaacaaaccgtcggaccgtacggccctaccgacgtccctactacgtactacgtacgggacggtcctaacctaccgtaacggtacgggtacgtaccggaccggtacctaaccgtaccaacggtacggttacggtacgtggtaccgccggttaagggttcggtacggacgggtaactaccgtaccgtaccgtacctactaaccctaacgtaccctaaccgtaaacccgtacgaccggttcccggaacgttaccggtaaagggtttaacgttttaacgttcggtagtttaccggtttaacgtacttacgggttcctaaggtaacggttagttacggttacggttacggtaccgttacccggttaccgttaaccgttcggtacgggtaaccgggtaacgggtacggtaacggttaacggcgttaaacggcggttaaaccggtacggtacgttacggcggtacctccgactaccgttcgtacg

SEQ ID NO: 50828 - DNA, 793 bp, Homo sapiens
  misc_feature: GYAE6OF02IWYIQ.21.38.D05.1.454.CMB.1.raw
  modified_base (399)..(399): a, c, t, g, unknown or other
  misc_feature (399)..(399): n is a, c, g, or t
tcagtcgtcgctcgcacgaccggtgctcgatttagtatctgatagttgggtttggggcagagctctggagaagagctgctcagttaggacccagagggaaccagtcggaaacccccagccgccgagtcctttctcccttccgtcctcgctacgtcgtggcctccgaggtgtcgaccggagtaagttcgtaccttgacgcacgtcctccgtacgccacccttgtccttactggtccctaccggaagggtaactacgttaccttccttaccgttaccgttcggacgaacggacccgtagttccgaaggtcggttgttacggctacgttaccggtaacgttcgacgttaccggtaaaccaaacgtaaaccgtcgaccgacgtcctcccgtctacctaccgtntacgttacgtaggtcgggaccttacgtacctaacggtcgtacgacggtaccgtacctaccggtccctaggtaacgttaccgtcggtacgtaccggtcggtacggttcggtaacggacgtacgtacggttaacttcccgtaccgtacttacccgaacctacgtaacccaagaccgttacgaccgttaccgaccggttaactaaggtttacgttcgtaaccgttagggtactttaacggttcgtacgttacggtaacgttagttacggttagggtaaccgggttaccgttaccgtaaccggttaaccgttacccgttcggtaacccgggtacgtaaccggtaggttaaccggcttaacgacgtaacgtagtaccgtagccgtacgcaccgtctacg

SEQ ID NO: 50829 - DNA, 798 bp, Homo sapiens
  misc_feature: GYAE6OF02JCNNG.21.38.D05.1.454.CMB.1.raw
  modified_base (169)..(169): a, c, t, g, unknown or other
  misc_feature (169)..(169): n is a, c, g, or t
  modified_base (215)..(215): a, c, t, g, unknown or other
  misc_feature (215)..(215): n is a, c, g, or t
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
tcagtcgtcgctcgcacgaccggtgctcgatttagtatctgatagttgggtttggggcagagctctggagaagagctgctcagttaggacccagagggaaccatggaaaccccagcgcagcttctcttcctcctgctactctggctcccaggtgtcaccggagaagttntcttgacgcagtctccaggcaccctgtctctgtctccgaggggaanagttactctctcctgcaacggcagtcagngtgtgnatcgacgtgcctaggtaccaaacaaaaccgtggaccacggcctacccgaggttcctccctcacgtactaggtcggggctacgtcccgacgtagggtactccggaccggactactacccgactacggtaggttaccgaggtacggacccgtagggttcggggtacgttacgggggaacgtaacggttaaccctttccgtaaccttcctaaccgtacccttaaccggttaacctaaacgttaacccaccggttaccggggtacccgtacccgttaacgggtaaacgttttacgtttttaccgaacggtttaagggtttaccgtttaaacgttttaccgtacggtttaccgtaaggttaactttagggtttaacgggtttacggggttaacggttccccgttaaaccggtttacccggtttaacccggtttacggggaacccgggtacggggtaaaccttacggggggtaaggtaaccggttaacgtaaccggtaacggtaaccgggttacggttacggtccggtaacgtcggttacccagtttaacccgg

SEQ ID NO: 50830 - DNA, 634 bp, Homo sapiens
  misc_feature: GYAE6OF01DI1ZY.2.53.E09.1.454.CMB.1.raw
  modified_base (311)..(311): a, c, t, g, unknown or other
  misc_feature (311)..(311): n is a, c, g, or t
tcagacgctcgacacacgaccggtgctcgatttagagagagtgtgttgggtttgggggctctgggagacgagcccagcactggaagtcgccggtgtttccattcggtgatcatcactgaacacagaggactcaccatggagtttgggctgaactgggtttcctcgttgctctttaagaggtgtccactgtcaggtgcaactggtggagtcgtgggggagcgtggtccagcctggaacgtccctgagactctcctgtgcagccctcgtgggttccaacctaacaaataaatatgctatgcacgtcgggcccnccgaggcctccgaggcgaaggggctgggaggtgggtggctagttatctacgagacgatagaaagtcaaataaactactaacacacgactaccgtaggaacgggcctattaccaccatcctaccgaagaacgaactaattacccaaagtaacgtaattagttaatacttacgtagaactaaagtacgaacgaccgtaccgtaacggacgaacccgtaggaacggtaccgacggtacctagttaagttagtttagttggtaggttacgggaccgggtactaccgtaacggttccgggtacccggggtaaccctacggttaacggg

SEQ ID NO: 50831 - DNA, 581 bp, Homo sapiens
  misc_feature: GYAE6OF01B4V8R.2.53.E09.1.454.CMB.1.raw
tcagacgctcgacacacgaccggtgctcgatttagagagagtgtgttgggtttgggggctctgggagacgagcccagcactggaagtcgccggtgtttccattcggtgatcatcactgaacacagaggactcaccatggagtttgggctgaactgggttttcctcgttgctcttttaagaggtgtccactgtcaggtgcaactggtggagtcgtgggggagcgtggtccagcctggaacgtccctgacgactctcctgtgcagcctctcgggttcacctacaataaatatgctatgcactcgggccccgccaggcctccgagggcgaagggggctgggaggtggggtggcaggttatcctcagacgatacgaaagtcaaataaactacgtacacagacctcggtagaacgggcctattaccacctatctaccagacgaacaacttaccaagtaagagttagtattatctagataaatcgaaacacgtaccgtagaacgcctaggaacggacaccggtctagtattagttagttgtgtacgggacggtactacgtaactcggtcgggtaccctagttacggg

SEQ ID NO: 50832 - DNA, 562 bp, Homo sapiens
  misc_feature: GYAE6OF01EAYKA.2.53.E09.1.454.CMB.1.raw
  modified_base (421)..(421): a, c, t, g, unknown or other
  misc_feature (421)..(421): n is a, c, g, or t
  modified_base (444)..(444): a, c, t, g, unknown or other
  misc_feature (444)..(444): n is a, c, g, or t
  modified_base (448)..(448): a, c, t, g, unknown or other
  misc_feature (448)..(448): n is a, c, g, or t
  modified_base (458)..(458): a, c, t, g, unknown or other
  misc_feature (458)..(458): n is a, c, g, or t
  modified_base (466)..(466): a, c, t, g, unknown or other
  misc_feature (466)..(466): n is a, c, g, or t
  modified_base (471)..(471): a, c, t, g, unknown or other
  misc_feature (471)..(471): n is a, c, g, or t
  modified_base (477)..(477): a, c, t, g, unknown or other
  misc_feature (477)..(477): n is a, c, g, or t
  modified_base (482)..(482): a, c, t, g, unknown or other
  misc_feature (482)..(482): n is a, c, g, or t
  modified_base (499)..(499): a, c, t, g, unknown or other
  misc_feature (499)..(499): n is a, c, g, or t
tcagacgctcgacacacgaccggtgctcgatttagagagagtgtgttgggtttgggggctctgggagacgagcccagcactggaagtcgccggtgtttccattcggtgatcatcactgaacacagaggactcaccatggagtttgggctgaacttgggttttcctcgttgctctttttaaagaggtgtccactgtcaggtgcaatggtggagtcgtggggggaggcgtgtccagcctggaacctccctgagactctcctgtgcagcctcgtggttcacctaacaaataaatatgctatgactcggtcggccccgaccgacggcctccgacgggacgaaggggtcgtggacgggtgggtgtcaaggtttaatcgtacaggacgataggaaaagtcaataaaataactaaccacagactccgngaaggccgattcaccatctccanaganaatcaagaanatgttaanatctnacaaanacaanagactagaagacctagngacgacggctatatattattgtgtaggacgggacgtacaactagtcggggaccctacgttacg

SEQ ID NO: 50833 - DNA, 772 bp, Homo sapiens
  misc_feature: GYAE6OF01A9CDT.2.53.E09.1.454.CMB.1.raw
tcagacgctcgacacacgaccggtgctcgatttagagagagtgtgttgggtttgggggctctgggagacgagcccagcactggaagtcgccggtgtttccattcggtgatcatcactgaacacagaggactcaccatggagtttgggctgtaacgtgggttttcctcgttgcttcttttaagaggtgtccactgtcaggtgcaacgtggtggagtcgtgggggaggcgtggtccagccgtggaaccgtccctgacgactctcctgtcgcagtcctcgtgggttccaacctaactaaataaactatcgtactagtcgcacggtcgggccccgcgacggcctccgagggacgaaggggtcgtgggaggtgggcggactaggttactcgtacgaagggtaagtacgtaaggaaagtaactaaattaaaaactacccttaaaaccgacgtaaacggtaacccgtacgggtaacgggaaccggggtaccgtaactttacccgaacctacctaccgtacccgaagaacgtaaacctaactaaccgtaaagtaaactaagttacgtttaatagtacgttaacgaacgtaaacgtaacgaaaccgtaccggtaaccgtacgggtaaccgtacggtaacgggaaccggtaaccggtaacggtaccgtttaagttaaacgtttagttttaacggttggggttacggttaacgggaaccgggttaaccgtaccgtaaccggtttaccggggtaaccgggtaccccgttaacggttaaaccggg

SEQ ID NO: 50834 - DNA, 565 bp, Homo sapiens
  misc_feature: GYAE6OF02GB548.2.53.E09.1.454.CMB.1.raw
tcagacgctcgacacacgaccggtgctcgatttagagagagtgtgttgggtttgggggctctgggagacgagcccagcactggaagtcgccggtgtttccattcggtgatcatcactgaacacagaggactcaccatggagtttgggctgaactgggttttcctcgttgctcttttaagaggtgtccactgtcaggtgcaactggtggagtctgggggagcgtggtccagcctggaacgtccctgagactctcctgtgcagcctctgggttcacctacaataaatatgctatgcactgggcccgcaggctccaggcaaggggctggagtgggtgcagttatctcagacatgaaagtcaataaatactacacagactccgtagaaggccgatacaccaactctaccagacgacaacttaccaagaagatagttataatactagacaaatagaacacgacctagtaagaaccgtaggacgacgacggctagtattaattagttaggttggttaggtacggggtacttaccgtaaccgttaccgtacgggggtaccctacgtttacgg

SEQ ID NO: 50835 - DNA, 584 bp, Homo sapiens
  misc_feature: GYAE6OF02IT9IT.2.53.E09.1.454.CMB.1.raw
tcagacgctcgacacacgaccggtgctcgatttagagagagtgtgttgggtttgggggctctgggagacgagcccagcactggaagtcgccggtgtttccattcggtgatcatcactgaacacagaggactcaccatggagtttgggctgaactgggtttcctcgttgctcttttaagaggtgtccactgtcaggtgcaactggtggagtcgtgggggagcgtggtccagcctggaacgtccctgagactctcctgtgcagcctctgggttccacctacaaataaatatgctatgcacgtcgggcccgcaggcctccgaggacgaaggggctgggaggtgggtgctagtatctacagacgataggaaagtcaataaactactacacgagaccgtccgtaggaacggaccgattacaccgatctacagacaactaactacaaagtaacgtattagttatatctagacaaagtagaacgacgaccgtagacgtaccgtaggaacggaccacggacttaggtactaagttatggtagtacgggacgggtacctcgtaacgtacggtacggggtaccctagttaacgg

SEQ ID NO: 50836 - DNA, 900 bp, Homo sapiens
  misc_feature: GYAE6OF02J2W03.2.53.E09.1.454.CMB.1.raw
  modified_base (195)..(195): a, c, t, g, unknown or other
  misc_feature (195)..(195): n is a, c, g, or t
tcagacgctcgacacacgaccggtgctcgatttagagagagtgtgttgggtttgggggctctgggagacgagcccagcactggaagtcgccggtgtttccattcggtgatcatcactgaacacagaggactcaccatggagttggctgaacgttggtttcctcgtgcttcgtttaagagtcgtccatgtcaggtnactacgtggtggagtcggtgggggacgtcgtggtaccgagcccgtacgggaaccgttccgtagacgtccttccttccgtggtcgcctacgcccttcgttcggggtttaccaacccttaacaaaagttaaaactaacgttcggtacttaacgttcggacccgtaaccggttcccggggcccccggttacccgaacgggtcccgttacccggaacgggggtaccgggaaaacggggggtcccgtttagggggtaacggggttcgggggttaacgggtaccggttaaaggtttaccgtttacccgtaacggaacgggtaaaccggtaagttaaacgggtaaaacggttaaacctaaaaacggtttaaaaaccttaaccgtaaaaccgaaccggtaaccggtaacccggtttaccgggaaacgggtaaccggggtacccgttaacgtacctaaccgtacttacccgacgtaacgaacgtaacctaaacgttaccgaaagttaacgtaacgttacgttaatacttacgacgtaacgtaaacgtacgaaacgtaccgtaccgtaaggtaaccgtaccggtaacggacggaccgttaccggtacgttaaggtttaacttaacgttaggtttaggacggttaacgggtaaccgggtacttaacccggaaccggttccgggtaaccgggttacccgttaacggttaaacccggg

SEQ ID NO: 50837 - DNA, 561 bp, Homo sapiens
  misc_feature: GYAE6OF02HGYHF.2.53.E09.1.454.CMB.1.raw
  modified_base (307)..(307): a, c, t, g, unknown or other
  misc_feature (307)..(307): n is a, c, g, or t
tcagacgctcgacacacgaccggtgctcgatttagagagagtgtgttgggtttgggggctctgggagacgagcccagcactggaagtcgccggtgtttccattcggtgatcatcactgaacacagaggactcaccatggagtttgggctgaactgggttttcctcgttgctcttttaagaggtgtccactgtcaggtgcaactggtggagtctgggggaggcgtggtccagcctggaacgtccctgacgactctcctgtgcagcctctgggttcacctacaataaatatgctatgcactgggccccnccaggctccaggcgaaggggctggacgtggggtgcagttatctcagacgatagaaagtcaataaatactaacactaagactccgtggaaggcgacttcaccatctcagagacaataccaagaagatagttatatactacgacaatagaacagacctgacgacgtagacgacgtacggcttagttactaattacgttagtggttaggacgggtacttacgaccgttacgggtaccggggacccttacggttacgg

SEQ ID NO: 50838 - DNA, 681 bp, Homo sapiens
  misc_feature: GYAE6OF02IA6OQ.2.53.E09.1.454.CMB.1.raw
tcagacgctcgacacacgaccggtgctcgatttagagagagtgtgttgggtttgggggctctgggagacgagcccagcactggaagtcgccggtgtttccattcggtgatcatcactgaacacagaggactcaccatggagtttgggctgaactgggttttcctcgttgctcttttaagaggtgtccactgtcaggtgcaactggtggagtcgtgggggagcgtggtccagcctggaacgtccctgacgactctcctgtgcagcctcgtgggttcacctacaaataaatatgctatgcacgtcgggccccgccaggcctaccgaggcaaggggctgggacggtgggtgctagttatctagaggacgataggaaaagtcaaataaaactactaacaacacgtaccgtaccggtaaggaacggggaccgtaacgtttaccaacccgactacctacccgaaagacgaaacctaattaacccgaaagtaaagtattaggttaaactactactacgtaactaaaagtacgaaaccacgtaccgtacgaacgtaacccgtaggaaacgggtaccgacggtacgttagttaacttagtttaagttggttacgggttaacggtaaccggggtacttaaccggtaaccggttaccgggttaccgggggtaacccccttaggtttaaccgg

SEQ ID NO: 50839 - DNA, 654 bp, Homo sapiens
  misc_feature: GYAE6OF02FISN6.2.53.E09.1.454.CMB.1.raw
  modified_base (172)..(172): a, c, t, g, unknown or other
  misc_feature (172)..(172): n is a, c, g, or t
  modified_base (180)..(180): a, c, t, g, unknown or other
  misc_feature (180)..(180): n is a, c, g, or t
  modified_base (213)..(213): a, c, t, g, unknown or other
  misc_feature (213)..(213): n is a, c, g, or t
  modified_base (293)..(293): a, c, t, g, unknown or other
  misc_feature (293)..(293): n is a, c, g, or t
  modified_base (318)..(318): a, c, t, g, unknown or other
  misc_feature (318)..(318): n is a, c, g, or t
  modified_base (368)..(368): a, c, t, g, unknown or other
  misc_feature (368)..(368): n is a, c, g, or t
  modified_base (527)..(527): a, c, t, g, unknown or other
  misc_feature (527)..(527): n is a, c, g, or t
  modified_base (538)..(538): a, c, t, g, unknown or other
  misc_feature (538)..(538): n is a, c, g, or t
tcagacgctcgacacacgaccggtgctcgatttagagagagtgtgttgggtttgggggctctgggagacgagcccagcactggaagtcgccggtgtttccattcggtgatcatcactgaacacagaggactcaccatggagtttgggctgaacttgggtttcctcattgctnttttaagnggtgtccatgtcaggtgcaactggtggagtcgngggggagcgtgtcagccgtggaacgtcctgacgtactctccgtgtcgcacgcctcgtgggttccactaacaaataaactntacgctatgactaggtcgggccccncgaggcctcgacggtcgaacggggctagggaggtgggtgactagtttacncttacgagacgtagtacgaaacgtacaaattaaacgtactaaccgacgtaacgtactccggtaaggaaccgggtaccgtacttaccaccgtaactccgtaacgaagtaacgaactaaccgttaccgaaaggacccgtacgtcgttacgttaactcgtanaaaccgttaanacgtaaacgtagtacgtaggaacgacggaccggaacggacgtacggtagttacgggtacttaacggtttagtcgttaacggaacgtaagtaacggtataggacggtacgacgtacg

SEQ ID NO: 50840 - DNA, 771 bp, Homo sapiens
  misc_feature: GYAE6OF02F9N41.2.53.E09.1.454.CMB.1.raw
tcagacgctcgacacacgaccggtgctcgatttagagagagtgtgttgggtttgggggctctgggagacgagcccagcactggaagtcgccggtgtttccattcggtgatcatcactgaacacagaggactcaccatggagtttgggctgaactgggttttcctcgttgcttcttttaagaggtgtccactgtcaggtgcaactggtggagtcgtgggggagcgtggtccagcctggaaccgtccctgacgactctcctgtgcagcctcgtcgggttcacctacaataaatatgctatgctacgtcgggccccgacgacggcctaccgaggaccgaagggggtctaggggaggtggggtggactagttactctacgaggtacgtataggaaagtcaaataaactactaacaacgacgtaccgtaccggtaggaaccggggtccgtaacgttacccaaccgtaaccttacccgtaccgtaaacggaacgtaaaccgtaaaccgtttaacccgaaaaggtaaacgtaatttaacgtttaaacgttacgttaccgtaacggtaacgtaaaacgtacgtaaaccgtaaccgtacccgtaacggtaaccggtaaccgttaacgggaacggtaaccgtaaccgggttaccgtttacggtttaaacgtttaagttttaacggtttagggttacgggttacgggtaaccggggttacccttaaccggttaaccggttacccgggttacccgggggttacccctttacggtttaaccggg

SEQ ID NO: 50841 - DNA, 676 bp, Homo sapiens
  misc_feature: GYAE6OF02JXJAX.2.53.E09.1.454.CMB.1.raw
  modified_base (201)..(201): a, c, t, g, unknown or other
  misc_feature (201)..(201): n is a, c, g, or t
  modified_base (274)..(274): a, c, t, g, unknown or other
  misc_feature (274)..(274): n is a, c, g, or t
  modified_base (299)..(299): a, c, t, g, unknown or other
  misc_feature (299)..(299): n is a, c, g, or t
  modified_base (310)..(310): a, c, t, g, unknown or other
  misc_feature (310)..(310): n is a, c, g, or t
  modified_base (346)..(346): a, c, t, g, unknown or other
  misc_feature (346)..(346): n is a, c, g, or t
  modified_base (359)..(359): a, c, t, g, unknown or other
  misc_feature (359)..(359): n is a, c, g, or t
tcagacgctcgacacacgaccggtgctcgatttagagagagtgtgttgggtttgggggcgtctgggagacgagcccagcactggaagtcgccggtgtttccattcggtgatcatcactgaacacagaggactcaccatggagtttgggctgaactgggttttcctcgttgctctttttaagaggtgtccactgtcagggtncaactggtcgagtcgtgggggaggcgtggtccagcctgggaacgtcccctgaggacctctcctgtgcagcctntggtcacctaacataatatgctatncactgggcccncacggctcaggcaagggcgtaggagtggggtccggntagttatccgtanacgtaccgtagtacgaaaggtaccaagttaaactactactaaccaagtacgtacccggtagaacggggccgttacgtaccgaccctagtcctaccgtaacgaagtaccgtaaccttacgaaagtaacgtaacttagttaaacgttactacgttacgaactaaagttaacggaacgtaaccgtaccgtacgaaccgacgtttaacggagggtacctaacgggcttaaggtaagtactttaaggtttcggtaaggttacggtaacggggtacaaccgttacggtaaccggtacccggggttacctaacggtttaccggg

SEQ ID NO: 50842 - DNA, 688 bp, Homo sapiens
  misc_feature: GYAE6OF02H4CVG.2.53.E09.1.454.CMB.1.raw
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
  modified_base (415)..(415): a, c, t, g, unknown or other
  misc_feature (415)..(415): n is a, c, g, or t
  modified_base (561)..(561): a, c, t, g, unknown or other
  misc_feature (561)..(561): n is a, c, g, or t
  modified_base (567)..(567): a, c, t, g, unknown or other
  misc_feature (567)..(567): n is a, c, g, or t
tcagacgctcgacacacgaccggtgctcgatttagagagagtgtgttgggtttgggggctctgggagacgagcccagcactggaagtcgccggtgtttccattcggtgatcatcactgaacacagaggactcaccatggagtttgggctgaactgggttttcctcgttgcttacttttaaaggaggtgtcccattgtcgtaaggtcgactaacgtggtcggagtcggtggggggagcggtggtccagtcctgggacctcccgngganaccttcctctggtgaccacgtcctcgtgggttaccaaccgtacaaataatatgactagtcgctacggtcggggtaccccacgtgggtcctaccggaaggccggaaaggggtcctaggggaggttcggggtacgacgtaacggtttacncgtacaacggtaacggtaatacggaaaacgtcctaaaagttaaactaacgtaacccaagtacgttacccgtaccgggtaggaaacgggtccgtaactaccaccaatccgtacagacactaactacgaataacgtactagtatagtnacgtanaagtacaactacgacctagacgtacgacgacggacgacggtcttacggtattcgttaagttcgtacgggtaggtaccgggtacttacgtaaccgtcgggtaccgggtaccctaggttacgg

SEQ ID NO: 50843 - DNA, 622 bp, Homo sapiens
  misc_feature: GYAE6OF02JWB9O.2.53.E09.1.454.CMB.1.raw
  modified_base (180)..(180): a, c, t, g, unknown or other
  misc_feature (180)..(180): n is a, c, g, or t
  modified_base (198)..(198): a, c, t, g, unknown or other
  misc_feature (198)..(198): n is a, c, g, or t
  modified_base (287)..(287): a, c, t, g, unknown or other
  misc_feature (287)..(287): n is a, c, g, or t
  modified_base (304)..(304): a, c, t, g, unknown or other
  misc_feature (304)..(304): n is a, c, g, or t
  modified_base (479)..(479): a, c, t, g, unknown or other
  misc_feature (479)..(479): n is a, c, g, or t
  modified_base (519)..(519): a, c, t, g, unknown or other
  misc_feature (519)..(519): n is a, c, g, or t
tcagacgctcgacacacgaccggtgctcgatttagagagagtgtgttgggtttgggggctctgggagacgagcccagcactggaagtcgccggtgtttccattcggtgatcatcactgaacacagaggactcaccatggagtttgggctgaactgggttttcctcgttgctcttttaagnggtgtccactgtcaggtncaactggtggagtctgggggagcgtggtccagcctggaacgtccctgacgacttctccgtgtcgcacgtcctcgtgggtaccaacctanaactaatatcgacttangcctacgtccgggcccgacgtaggccctccggacgggccgaacgggggtcgtcgggaacgggtggggtcgggacttacggttacttccgagaacggacgtaataggaaacgtctaaactaaacgtacctaacgacgaacgtactaccggtagaccgggtcgtaactccaaccgtntaccacgacacgaactactacaaagtactattagtatacnctacgataatagacgagtcaggtacacgtgagacgacgtctagtacgtgttactgtggtacggtcggtactacgtacgtacgggtacggtacctagttaacgg

SEQ ID NO: 50844 - DNA, 711 bp, Homo sapiens
  misc_feature: GYAE6OF02F39IR.2.53.E09.1.454.CMB.1.raw
  modified_base (182)..(182): a, c, t, g, unknown or other
  misc_feature (182)..(182): n is a, c, g, or t
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (284)..(284): a, c, t, g, unknown or other
  misc_feature (284)..(284): n is a, c, g, or t
tcagacgctcgacacacgaccggtgctcgatttagagagagtgtgttgggtttgggggctctgggagacgagcccagcactggaagtcgccggtgtttccattcggtgatcatcactgaacacagaggactcaccatggagtttgggctgaacttgggttttcctcgttgcttcttttaagnggtgtccactgtcaggtgcaactggtggagtcgtgggggaggcgtggtccagccgtggaaccgtccctgagactctcctgtgcngcctntggttccacctanaaataatatgactatgactacgtcgggcccgccaggcctcgaggccgaaggggtctgggaggttcgggtggctaggttactccgtagacggtaacggtataacggaaaacgtcgtaaacttaaaactacgttaaacacgtacgtaccgtaccggtcggaaacgggtcccgtattaccgaacctactaccgttaccgaagacgtaacttaaccgttaacgaacggtaaagtaccgttaagttaaccttacgtaccgtgtaaaccttaaagtaccgaaacggtacgtaccggtacgtaacgttaccgtacggaacggaaccggtacggtacgttgttaacgtttaacggtttatttgggttaacggttgggaacccggttacggttaccctaacgggttcccggtacgggtacccgttccgttaacggg

SEQ ID NO: 50845 - DNA, 1044 bp, Homo sapiens
  misc_feature: GYAE6OF02G6B77.2.53.E09.1.454.CMB.1.raw
  modified_base (182)..(182): a, c, t, g, unknown or other
  misc_feature (182)..(182): n is a, c, g, or t
  modified_base (261)..(261): a, c, t, g, unknown or other
  misc_feature (261)..(261): n is a, c, g, or t
  modified_base (281)..(281): a, c, t, g, unknown or other
  misc_feature (281)..(281): n is a, c, g, or t
tcagacgctcgacacacgaccggtgctcgatttagagagagtgtgttgggtttgggggctctgggagacgagcccagcactggaagtcgccggtgtttccattcggtgatcatcactgaacacagaggactcaccatggagtttgggctgaacttgggttttcctcgttgtctcttttaagnggtgtccactgtcaggtgcaacgtgggtggacgttcgtggggggacggcggtcggtccagtccgtgggaaccgttcccnggacgtacctctccgtggtnccacgccttcgttcgggttaccaacctaactaaaattaaacgtaatcgtacttagtcgccgtaccggtccggggcccccgtaccgacgggtcccgtcccgaacggggtaccggtaagggggtcgtggggtaggggttcggggtgggacgttagttactcgacgacgtacgataaggaagttacgaaattaaacgtacaacgtaacgtaacgtaccggttaccgtaacgggtaaccgggtaccgtaccgtttacccgaaccgtaccgttacccgtaacccgtaacggtaaaccgtaaaccgttaaaccgttaaaacccgtaaaaggttaaacggttaaacgttttaaggttaaactttaacccgtttagtttaaaccgtaaacgttaaaaccggttaaaccgtaaaacggtacccggttaacccggttaaaccgggttaaaccgggttaaacccggtacggggtaaaaccccgggtaaccggggttaaaccccgggttttacccgggttttaaacggttttttaaacgggttttaaaccggtttttttaaacccggggttttttacggggggtttaaacccggggtttaaacccgggggggggtttaaaaacccggggggggttttaaccccccttttaaaaaccggggggttaaaaccccccccgggtttttttacccgggggggggttaaacccccccccggggggggttttaaacccccgggttttttaaaacccccggggtttttaaaaaccccgggggg

SEQ ID NO: 50846 - DNA, 546 bp, Homo sapiens
  misc_feature: GYAE6OF01B93GW.53.65.F10.1.454.CMB.1.raw
tcagcgcgtatacacacgaccggtgctcgatttagctacgctctaaggggctgggcctaaggaagcagcactggtggtgcctcagccatggcctggaccgttctcctcctcggcctcctctctcactgcacagactctgtgacctcctatgtgctgactcagccaacctcggtgtcagtggccccaggacagacggccagcattacctgtgggggaaaccacattggagactaaaaatgtgcactggtaccagcagaagccaggccaggcccctgtgctggtcgtctataatggaagcggccggccctcatggatcccgtgggcgattctctggctcaagtctggaacacggccaccctaacatcagcagggtcgaaggccggggatggagggccgactattactgtcgaggtgtgggataagtagtaatggtagggaagttgggtggttcgggcgggagggaccgaagctgaccgtccgtaggtcagcccgaaggctcgcccccgtcggtccactccgtcgttccccaccctccctcgtcgtacg

SEQ ID NO: 50847 - DNA, 569 bp, Homo sapiens
  misc_feature: GYAE6OF01BMHSX.53.65.F10.1.454.CMB.1.raw
  modified_base (552)..(552): a, c, t, g, unknown or other
  misc_feature (552)..(552): n is a, c, g, or t
tcagcgcgtatacacacgaccggtgctcgatttagctacgctctaaggggctgggcctaaggaagcagcactggtggtgcctcagccatggcctggaccgttctcctcctcggcctcctctctcactgcacagactctgtgacctcctatgtgctgactcagccaacctcggtgtcagtggccacaggacagacggccagcattacctggtgggggaaaccacattggagactaaaaatgtgcactggtaccagcagaagccaggccaggccctgtgctggtctctataatggaagcggccggccctcagtggactcccgtgggcgtattctcgtgctacgaagtcgtacgggaacaccggaccaaccctaacatcagcgagggtacgaaggccggggatcggacggccgtatagttacgtagtcgaggtgtagggataagtagtaagtgggtagggtagttgggtgttcgggacggtaggaccaagctaggaccgtcgtagtcgacgccgaacggctccggccccgtggtccacgttccgtccgttccccncccttcccgtcgtaccg

SEQ ID NO: 50848 - DNA, 584 bp, Homo sapiens
  misc_feature: GYAE6OF01CH8DB.53.65.F10.1.454.CMB.1.raw
  modified_base (311)..(311): a, c, t, g, unknown or other
  misc_feature (311)..(311): n is a, c, g, or t
  modified_base (365)..(365): a, c, t, g, unknown or other
  misc_feature (365)..(365): n is a, c, g, or t
tcagcgcgtatacacacgaccggtgctcgatttagctacgctctaaggggctgggcctaaggaagcagcactggtggtgcctcagccatggcctggaccgttctcctcctcggcctcctctctcactgcaccagactctgtgacctcctatgtgctgactcagccaacctcggtgtcagtggccccaggacagacggccagcattacctgtagggggaaaccacattaggagactaaaaaagtgtgcacgtggtaccagcaagaagccaggccaggccctgtgctggtcgtctatatggagcggccgcctnatgactccgtggcgattctctgctccgaagtcgtaggaacacgccaacctaacntcagcgagggtcgaagccgggatcggaggccgatattacgtgtcgaaggtggtagggataagtagtaagtggtagggtaattgggtgttacgggcgggagggaccgaaggctcggacccgttcgtaggtccaacgtcccgaagggtcctacgccccccgttcggtcccaccgttcgtcccggtttacccccgaccccttcccgtccgtccggttacccg

SEQ ID NO: 50849 - DNA, 925 bp, Homo sapiens
  misc_feature: GYAE6OF01BZQW6.53.65.F10.1.454.CMB.1.raw
tcagcgcgtatacacacgaccggtgctcgatttagctacgctctaaggggctgggcctaaggaagcagcactggtggtgcctcagccatggcctggaccgttctcctcctcggcctcctctctcactgcacagactctgtgacctcctatgtgctgactcagccaaccgtcggtgtcaggtcggcccgaggacacggacggccagctacgttaccgtggtacgggggaaaccacgtagttagggaacgtaactaaaaaagttgtagacctacgttacgggtaaccgaggacgaacggaacggacccgaacgggacccgaccgggtccccgtgggtcggtccggttcgggttccggttacgttaaagtaaacgtacggggaaacggtcccggggaccccggtccccttaccgaacggtacgggtaaccgttccccggtcgggggtccgttaacgtttccgttccggttcgggtcccgttaccgaaacggttccggtaacggggaaacccgacccgggaacccctaaaccccgtaaaccgtactaccgacggaccggtacggggtacggaacggggaccggggagtacggacgggtaccgtaacttacgtttaccgtggttacgtaagggttcgggtaagggtaacttaaagtaggttaacggttggggttaagggttaaggtttcgggggttaggttaccggggacggggtaaacgggtacccgtaaaggtccggttaaccgggtacccggttaccgttaacgggtacccggtaacccggtaaccccgggtaacgggtccccggttaccccgggtaccccccccgtttccggggttacccctaaccccgttttccccggttacccccgggttcccccccttaaccccccgtttcccccgtttacccggttaccccggtttacccgg

SEQ ID NO: 50850 - DNA, 759 bp, Homo sapiens
  misc_feature: GYAE6OF01ES5FU.53.65.F10.1.454.CMB.1.raw
tcagcgcgtatacacacgaccggtgctcgatttagctacgctctaaggggctgggcctaaggaagcagcactggtggtgcctcagccatggcctggaccgttctcctcctcggcctcctctctcactgcacagactctgtgacctcctatgtgctgactcagccaacctcggtgtcagtcggcccaggacagacggccagcattaccgtggtacgggggaaaccacagttggaagactaaaaatgtgcacgtggtaccagcaagaagccaggccacggccctgtcgcgtggtcgtactataagtggaacgccggcccgccctcgagtcggactcccgtgggctacgttctcgtcggcctaccgtaaggtccgtacgggaccgaccggaccctaaccctaaccacgtacgaacggaccggtacggggtaccggaaacggggcccggggaagtacgggaacgggtacccgtaacgttaagttaaccgtggttacgagggttcggttaggggtaaagtaaacgttaaggttaaggttaggggtagggttaagggtttcgggggttacgggtttaccggggacggggtaaccgggggtaaccgaaacggtcccgttaacgggtacccggttaccgttacgggtacccgaccgggtaacccggtaacgggtcccgtacccggttcccccccggtcggtacccgtaacccgtcccgtttcccggttaccccaccccccgtttcccgttccgtccggttaacccgg

SEQ ID NO: 50851 - DNA, 794 bp, Homo sapiens
  misc_feature: GYAE6OF01DUGCR.53.65.F10.1.454.CMB.1.raw
tcagcgcgtatacacacgaccggtgctcgatttagctacgctctaaggggagtctgggcctaaggaagcagcactggtggtgcctcagccatggcctggaccgttctcctcctcggcctcctctctcactgcacagactctgtgacctcctatgtgctgactcagccaacctcggtgtcagtcggccccaggacagaccggccagcattaccgtggtacgggggaaaccactagttggagactaaaaatgtgcacgtggtaccagcagaacgccgaggccacggcccctggtgcgtggttcgtactaactaagtagggaacggccggcccggccctcgagtacggactcccggtgggccgtattccgtcgtcggcctaccgaacggtccgtacggggaaaccaccgggacccctaaacccctaacccacgtaccgacggtacggtaacgggggtacgaacgggtacccgggggattaccggggaacgggtacccgtaaacgttactttaacggtggttaccgtaaggggttcggtagggtaaattaaaggttaaggtaaggtttggggtagggttaaggttttgggggtacgggtttaccggggaacggggtacgggaaacccgtagggtaccgtaccgggtaaccccggttccggtaacgggttacccgaacccggtaccccggtaaaacgggccccttccccgggtccccccccggttaccgggtaccctacccgtttcccgtttacccccgttacccccctaccccgtttcccgttcccggtttaccccgg

SEQ ID NO: 50852 - DNA, 719 bp, Homo sapiens
  misc_feature: GYAE6OF01AUP3W.53.65.F10.1.454.CMB.1.raw
  modified_base (450)..(450): a, c, t, g, unknown or other
  misc_feature (450)..(450): n is a, c, g, or t
tcagcgcgtatacacacgaccggtgctcgatttagctacgctctaaggggctgggcctaaggaagcagcactggtggtgcctcagccatggcctggaccgttctcctcctcggcctcctctctcactgcacagactctgtgacctcctatgtgctgactcacgccaacctcggtgtcagtcggccccaggacagacggcagcattaccgtggtcgggggaaaccacgattggaagacctaaaaatggtgcactggtaccagcagaacgccaggccaggcccctgtcgcgtcggtcgtactactaagtggacgcggcccggccctcgagtcggactcccgtcggggacgtactttacgtcgtcggtcctaccgaaagtcggtaacgggaaccaccggacccctaaccctaaccacgtaccgacggacgtacgggtacgacgggccgggtancgggtaacggccgtaacgttaacgttacgtacggtacgagggttcgtagggtaacttaaagtacggttaagtcggggtaagggtagggtttggggtacggtttacggggcggggtaacgggtaaccgtaacggtcgtaaccgggtaccggttaccggtacgggttaccacgggtaccccggaacggtcccggtcccgtaccccccgtcgggtaccctccgttcccgtcccggtttaccccccccggttccgttccgtccggtaacccgg

SEQ ID NO: 50853 - DNA, 641 bp, Homo sapiens
  misc_feature: GYAE6OF02IE0KA.53.65.F10.1.454.CMB.1.raw
tcagcgcgtatacacacgaccggtgctcgatttagctacgctctaaggggctgggcctaaggaagcagcactggtggtgcctcagccatggcctggaccgttctcctcctcggcctcctctctcactgcacagactctgtgacctcctatgtgctgactcagccaacctcggtgtcagtcggccccaggacagacggccagcattacctgtgggggaaaccacattggagactaaaaatgtgcactggtaccagcagaagccaggcacggcccctgtgctggtcgtctagtaatggaaggcggccggccctcagtcgggactcccgtgggcgtacttctctggctccgaagtcgtgggaacacggccaaccctaacactcagcgacgggtcgaacggccggggatcggacgggtcccgaattacgttactcgttacgagggttggtagggaattaagttaggtaagttggggtagggtaaagtttggggttgggtttccgggacggggacggggtaaccgaaggaccgttacggaccggtccgtaggtccacggtccccgaaggtcccgtcccgtacccccggtcggtacctaccgtttccgtcccgttcccctaccccgtcccttccgttacgtacccgg

SEQ ID NO: 50854 - DNA, 926 bp, Homo sapiens
  misc_feature: GYAE6OF02GZY2F.53.65.F10.1.454.CMB.1.raw
tcagcgcgtatacacacgaccggtgctcgatttagctacgctctaaggggctgggcctaaggaagcagcactggtggtgcctcagccatggcctggaccgttctcctcctcggcctcctctctcactgcacagactctgtgaccttcctatgtgctgactcacgccaacctcggtgtcacgtcggccccgaggacagtaccggccagctacgttaccgtggtacgggggaaaccacgtagttaggacgactaaaaagtgtgaccacgttacggtaccgagtcgaaggtaacggcccgacggacccgaccgggtcccccgtaggtcggtccgttcgggttccggttacgttaacgttaaaggtacgggaacggtccgggtaccccggtccccgttacgtacgtcgggtacgttaccccggtggggtccgtaacgtttccgtcgttacgggtccttaccggtaacggttaccggttacggggaaaccgtaacccgggtaccctaaacccctaaccgtacgtaccgtaaccggacggtaaccggggttacccggaacgggggtacccgggggtagtaaccgggacggggtacccggttaactttaacgttaccgttacgggttaccggtaacggggttacggttaaggggttaaacttaaacgggtttagggttaaaacggtttcgggggtaaacggggtttaaccggtttggggggttttaccggggttacccgggggtaccgggggtaaacggggtaacccgtaacggggttacccgttaaccgggtacccgggttaacccgttaacgggtacccgtaccgggaccccggtaacggtccccgtacccggtccccggttacggttcccgtaccgttcccggtttccgttccccccgtaccctttccccgtttccgtccggttacccgg

SEQ ID NO: 50855 - DNA, 851 bp, Homo sapiens
  misc_feature: GYAE6OF02I4ZHE.53.65.F10.1.454.CMB.1.raw
  modified_base (175)..(175): a, c, t, g, unknown or other
  misc_feature (175)..(175): n is a, c, g, or t
tcagcgcgtatacacacgaccggtgctcgatttagctacgctctaaggggctgggcctaaggaagcagcactggtggtgcctcagccatggcctggaccgttctcctcctcggcctcctctctcactgcacagactctgtgacctcctatgtgctgactcacgccaacctcggtntcaggtcgccccaggaccaggaccgccagctacttacctgggtacggggaaaccactagttaggaacgaacttaaaaagtgtacgactacgttacggtaccagcgaaggtacgaccgtacggaccgacggccccgttggtcgtccgttcgggtaccgtacgttaataacggtaggggaaccgccggggtccccggacccctcggtactacgggtacccttccccggtaggggtccgtaactttccggtcgtaccgggtcccttacccgtaacggttccgggtaccgggaaaacccgtacccgggtacccccgtaaacccctaaaaccgtcgttaacccgaacgggtacccgggtaacggggtaccggtaaagggggaccccgggtaggtacggaaccgggaccgtaacgttacggttacctcgggtacgtacgggttagggtacggtaacgttaacgttaagggtaacggtttaggggtacgggttagggtttacggggtcgggttacggggacgggtaacgggtaaccgaacggtccgttaccgggaccgttaccgggttacgccgtaccggtaacccggacggtcccgtcccggtacccccggtcggtacccgttaccgttcccgtccccgttaccccgtcccccggtttaccctcccggttccgtaaccccgg

SEQ ID NO: 50856 - DNA, 877 bp, Homo sapiens
  misc_feature: GYAE6OF02IYFGS.53.65.F10.1.454.CMB.1.raw
tcagcgcgtatacacacgaccggtgctcgatttagctacgctctaagggctgggcctaaggaagcagcactggtggtgcctcagccatggcctggaccgttctcctcctcggcctcctctctcactgcacagactctgtgacctcctatgtgctgactcgacgccaaccgtggtgtcaggtcggcccgaggacgacgacgccagcacttaccgtggtacggggaaaccacgattaggagaactaaaaagtgtacgactacgtacgtaccagacgaagaacgccacggccgacggcccctggtcgcgtacggtcgttactaagtaagtacggaacggccgggacccggcccgtacgaacgtcggtaccgtcccggtagggtcgtaactttccgttcgtcggtaccgtaaccgaacggttccggtaacgggaacccgtaaccccgggacccctaaaccccgtaaaccgtaacgtaccgtaacggaccggtaacggggtaaccgggaaaccggggtacccgggggtaatacggggaaccgggtacccgtaacgtttaaacgtttaccgacggggttaccggtaaggggttacgggttaaggggtaaactttaaacgggttaaggttaaaagggttcgggggtttaaaggggttaacggtttttcggggggttaccgggttaccgggggaacgggggtaaaccgggtaaaccggtaacgggttacccgttacccgggtaacccggtttaacgtaccggggttaccgaacccgggtaacccggaacggtcccgttcccccggtaccccggtttaccggtaccctaccgtttcccgttccccgttaacccccgtacccgtttcccgttccgtacccgttacgg

SEQ ID NO: 50857 - DNA, 152 bp, Homo sapiens
  misc_feature: GYAE6OF02GHFLP.41.20.B09.1.454.CMB.1.raw
  modified_base (152)..(152): a, c, t, g, unknown or other
  misc_feature (152)..(152): n is a, c, g, or t
tcagtctatactatcacgaccggtgctcgatttagtgtagtgtgagggaaagggaccaaagtggaaatcaaacgaactgtggctgcaccatctgtcttcatcttcccgccatctgaatagtatagactgagcgggctggcaaggcgcatagn

SEQ ID NO: 50858 - DNA, 152 bp, Homo sapiens
  misc_feature: GYAE6OF02IQP4G.41.20.B09.1.454.CMB.1.raw
  modified_base (151)..(152): a, c, t, g, unknown or other
  misc_feature (151)..(152): n is a, c, g, or t
tcagtctatactatcacgaccggtgctcgatttagtgtagtgtgagggaaagggaccaaagtggaaatcaaacgaactgtggctgcaccatctgtcttcatctcccgccatctgaatagtatagactgagcgggctggcaaggcgcatagnn

SEQ ID NO: 50859 - DNA, 438 bp, Homo sapiens
  misc_feature: GYAE6OF01DFQWN.24.62.F07.1.454.CMB.1.raw
  modified_base (436)..(438): a, c, t, g, unknown or other
  misc_feature (436)..(438): n is a, c, g, or t
tcagactactatgtcacgaccggtgctcgatttagtagtcgcataaagggaagggactggagtggattggccatatctacgccaatgggagaaccaggtacaacccctccctccagagtcgagtcaccatttcactggaccgtccaagaaccaattgtccctgagtctgaattctgtgaccgccgcagacacggccacttattactgtgcgagagaggcgcagtggccgcaactaagtcgtttctactattatggtatggacgcctggggccgagggaccacggtcaccgtctcctcagcctccaccaagggcccatcggtcttccccctggccaccctcctccaagacgcacctctggggcacagcggccctgggctgcctggtcaaggactacttccacatagtagtctgagcgggctgggcaaggcgcatagnnn

SEQ ID NO: 50860 - DNA, 443 bp, Homo sapiens
  misc_feature: GYAE6OF01A04M6.24.62.F07.1.454.CMB.1.raw
  modified_base (436)..(443): a, c, t, g, unknown or other
  misc_feature (436)..(443): n is a, c, g, or t
tcagactactatgtcacgaccggtgctcgatttagtagtcgcataaagggaagggactggagtggattggccatatctacgccaatgggagaaccaggtacaacccctccctccagagtcgagtcaccatttcactggacccgtccaagaaccaattgtccctgagtctgaattctgtgaccgccgcagacacgggccacttattactgtgcgagagaggcgcagtggccgcaactaagtcgtttctactattatggtatggacgcctggggccgagggaccacgggtcaccgtctcctcagcctccaccaagggcccatcggtcttccccctggcaccctcctccaagagcacctctgggggcacagcgcctgggctgcctggtcaagggactacttccacatagtagtctgagcgggctggcaaggcgcatagnnnnnnnn

SEQ ID NO: 50861 - DNA, 579 bp, Homo sapiens
  misc_feature: GYAE6OF01B5V5K.24.62.F07.1.454.CMB.1.raw
  modified_base (214)..(214): a, c, t, g, unknown or other
  misc_feature (214)..(214): n is a, c, g, or t
  modified_base (323)..(323): a, c, t, g, unknown or other
  misc_feature (323)..(323): n is a, c, g, or t
  modified_base (474)..(474): a, c, t, g, unknown or other
  misc_feature (474)..(474): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctccagatgggtcctgtcccaggttcaacttcaggagtcgggcccaggactggtgaagccttcacagaccctgtccctnacttgcactgtctctggtgctccatcaatagtggtacttactattggagctggatcggaagcccgcgggaaggactggagtggattggccatatctacgcaagtggganaaccaggtaccaacccctcctaccagacgtcgagtcacatttcactggaccctcaaagaaccaattcgtccctgacgtctagtaattctgtcgacccgccgcaacgacacggccaactttatactgtgcgagagagcgcagtcggaccganaacgtaagtccgtttactaactatttacgtgggttataggggaccgtccgttaggggggacccgtaaggggacccctacgggtccaacccggttcgtcccgtacg

SEQ ID NO: 50862 - DNA, 527 bp, Homo sapiens
  misc_feature: GYAE6OF01B35XT.24.62.F07.1.454.CMB.1.raw
  modified_base (323)..(323): a, c, t, g, unknown or other
  misc_feature (323)..(323): n is a, c, g, or t
  modified_base (401)..(401): a, c, t, g, unknown or other
  misc_feature (401)..(401): n is a, c, g, or t
  modified_base (519)..(519): a, c, t, g, unknown or other
  misc_feature (519)..(519): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatgtgtacttactattggagctggatccggaagcccgcgggaaggactggagtggattggccatatctacgccaatggganaaccaggtacaacccctcctccagagtcgagtcacatttcactggaccctcaagaccattgccctgagtctgaattcngtgaccgccgcagacacggcctacttatactgtgcgagagaggcgcaggtcggccgcaactagtcgtttctacttattatggtatggacgcgtggggccagggcccacggtcaccgtntccgtacg

SEQ ID NO: 50863 - DNA, 438 bp, Homo sapiens
  misc_feature: GYAE6OF01BKD8N.24.62.F07.1.454.CMB.1.raw
  modified_base (434)..(438): a, c, t, g, unknown or other
  misc_feature (434)..(438): n is a, c, g, or t
tcagactactatgtcacgaccggtgctcgatttagtagtcgcataaagggaagggactggagtggattggccatatctacgccaatgggagaaccaggtacaacccctccctccagagtcgagtcaccatttcactggacccgtccaagaaccaattgtccctgagtctgaattctgtgaccgccgcagacacggccacttattactgtgcgagagaggcgcagtggccgcaactaagtcgtttctactattatggtatggacgcctggggccgagggaccacggtcaccgtctcctcagcctccaccaagggcccatcggtcttccccctggcaccctcctccaagagcacctctggggcacagcggccctgggctgcctggtcaaggactacttccacatagtatctgagcgggctgggcaaggcgcatagnnnnn

SEQ ID NO: 50864 - DNA, 446 bp, Homo sapiens
  misc_feature: GYAE6OF01CVDTZ.24.62.F07.1.454.CMB.1.raw
  modified_base (442)..(446): a, c, t, g, unknown or other
  misc_feature (442)..(446): n is a, c, g, or t
tcagactactatgtcacgaccggtgctcgatttagtagtcgcataaagggaagggactggagtggattggccatatctacgccaatgggagaaccaggtacaacccctccctccagagtcgagtcaccatttcactggacccgtccaagaaccaattgtccctgagtctgaattctgtgaccgccgcagacacggccacttattactgtgcgagagaggcgcagtggccgcaactaagtcgtttctactattatggtatggacgccgtggggccgagggaccacggtcaccgtctcctcagcctccaccaagggccccatcggtcttccccctcggccaccctcctcccaacgagcacctcgtcgggggcacagcggccctgggctgcctggtcaaggactacttccacatagtagtctgagcgggctggcaggcgcatagnnnnn

SEQ ID NO: 50865 - DNA, 539 bp, Homo sapiens
  misc_feature: GYAE6OF01BO0RR.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtggctccatcaatagtggtacttactattggagctggatccggaagcccgccgggaaggactggagtggattggccatatctacgccaatgggagaaccaggtacaacccctcctccagagtcgagtcaccatttcactggacccgtcaagacccaattgtccctgagtctgaattctgtgacccgccgcagaccacgggccacttattactgtgcgagagaggcgcagtggccgcaactagtctttcacttattatggtatggacgcctggggcccagggaccacgggtcaccggttctcccgtcg

SEQ ID NO: 50866 - DNA, 441 bp, Homo sapiens
  misc_feature: GYAE6OF01B9ZAE.24.62.F07.1.454.CMB.1.raw
  modified_base (434)..(441): a, c, t, g, unknown or other
  misc_feature (434)..(441): n is a, c, g, or t
tcagactactatgtcacgaccggtgctcgatttagtagtcgcataaagggaagggactggagtggattggccatatctacgccaatgggagaaccaggtacaacccctccctccagagtcgagtcaccatttcactggacccgtccaagaaccaattgtccctgagtctgaattctgtgaccgccgcagacacggccacttattactgtgcgagagaggcgcagtggccgcaactaagtcgtttctactattatggtatggacgcctggggccgagggaccacggtcaccgtctcctcagcctccaccaagggcccatcggtcttccccctggccaccctcctccaagagcacctctggggcacagcggccctgggctgcctggtcaaggctacttccacatagtagtctgagcgggctggcaaggcgcatagnnnnnnnn

SEQ ID NO: 50867 - DNA, 556 bp, Homo sapiens
  misc_feature: GYAE6OF01B7IOT.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggcgaagccttcacagaccctgtccctcacttgcactgtctctggtggctccatcaatagtggtacttactattggagctggatccggaagcccgccgggaagggactggagtggattggccatatctacgccaatgggagaaccaggtaccaacccctcctccagagtcgagtcaccatttcactggaccctccaagaacccaattcgtccctgagtctgaacttctgtcgacccgccgcagaccacggcctacttattactgtgcgagagaggcgcgaggtcggcccgacaacgtaagttccgtttactacttatttagtggtatggacgccgtggggccgagggaccacggtcaccgtctccgtcg

SEQ ID NO: 50868 - DNA, 625 bp, Homo sapiens
  misc_feature: GYAE6OF01B76MA.24.62.F07.1.454.CMB.1.raw
  modified_base (216)..(216): a, c, t, g, unknown or other
  misc_feature (216)..(216): n is a, c, g, or t
  modified_base (419)..(419): a, c, t, g, unknown or other
  misc_feature (419)..(419): n is a, c, g, or t
  modified_base (429)..(429): a, c, t, g, unknown or other
  misc_feature (429)..(429): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtcccctnacttgcactgtctctggtgctccatcaatgtggtacttactattggagctggatccggaagcccggacggggaaggctggagtggattggccatatctacgccaagtgggacaaccgaggtaccaacccctcctaccagacgtcgagtccacgtatttccacgtcggacccctacaacgaacctaattcgtccctgacgttcngtaacttcgngtcgacccgtcgacaagacacggccctaagtttactacgtgcgtacgagacggtaggccgtacgaagggtcgaccgtactaacgttagttccgtttactaacttacttagtgggttaactgggaaccgtccgggttaggggacccgtaaggggtaacccctacggggttacccaccggttcccgttccctaccggg

SEQ ID NO: 50869 - DNA, 552 bp, Homo sapiens
  misc_feature: GYAE6OF01D3R8Y.24.62.F07.1.454.CMB.1.raw
  modified_base (464)..(464): a, c, t, g, unknown or other
  misc_feature (464)..(464): n is a, c, g, or t
  modified_base (476)..(476): a, c, t, g, unknown or other
  misc_feature (476)..(476): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatagtggtacttactattggagctggatccggaagcccgcgggaaggactggagtggattggccatatctacgccaatgggagaaccaggtaccaacccctcctccagagtcgagtcaccatttcactcggacccgtcaaagaacccaattcgtccctgagtctgaattctgtgacccgccgcacgacgacggccactttattactgtcgcgagaggaggcncgaggtggccgnaacgttagtcgtttctactattatgggtatgggaccgccgtggggcccgagggaccacgggtccaccgtcgtctcg

SEQ ID NO: 50870 - DNA, 578 bp, Homo sapiens
  misc_feature: GYAE6OF01D6O0I.24.62.F07.1.454.CMB.1.raw
  modified_base (324)..(324): a, c, t, g, unknown or other
  misc_feature (324)..(324): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatagtggtacttactattggagctggatccggaagcccgcggaaggactggagtggattggccatatctacgccaatggganaaccaggtacaacccctcctcagacgtcgagtcacatttcactggaccctcaagaaccaattcgtccctgacgtctgaactttctgttcgaccgcacgacgaccgcgacctactttactacgtgtcgacgagagcggacgcgtaggtccggaccactaacgtacgtttccgttactacttattagtggttacgtaggaccgtcggtcggggaccggacggtaccgtacggtacccgtaccgtccgtccgtaccg

SEQ ID NO: 50871 - DNA, 556 bp, Homo sapiens
  misc_feature: GYAE6OF01DLTVC.24.62.F07.1.454.CMB.1.raw
  modified_base (450)..(450): a, c, t, g, unknown or other
  misc_feature (450)..(450): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatagtggtacttacattggagctggatccggaagcccgcggggaaggactggagtggattggccatatctacgccaatgggagaaccaggtacacccctcctcagagtcgagtcacatttcactggaccctcaagaaccaattcgtccctgacgttctagaactttctgtcgacccgccgcaagaccacggcctaattactactggtncggagagacggcacgaggtcggccgactaacgtagttcgtttctaactatttatggttatggaccgtccgttggggcccgagggaccacgggtcaccggtctctcg

SEQ ID NO: 50872 - DNA, 437 bp, Homo sapiens
  misc_feature: GYAE6OF01C1PEA.24.62.F07.1.454.CMB.1.raw
  modified_base (207)..(207): a, c, t, g, unknown or other
  misc_feature (207)..(207): n is a, c, g, or t
  modified_base (399)..(399): a, c, t, g, unknown or other
  misc_feature (399)..(399): n is a, c, g, or t
  modified_base (416)..(416): a, c, t, g, unknown or other
  misc_feature (416)..(416): n is a, c, g, or t
  modified_base (426)..(426): a, c, t, g, unknown or other
  misc_feature (426)..(426): n is a, c, g, or t
  modified_base (432)..(437): a, c, t, g, unknown or other
  misc_feature (432)..(437): n is a, c, g, or t
tcagactactatgtcacgaccggtgctcgatttagtagtcgcataaagggaagggactggagtggattggccatatctacgccaatgggagaaccaggtacaacccctccctccagagtcgagtcaccatttcactggacccgtccaagaaccaattgtccctgagtctgaattctgtgaccgccgcagacacggccacttattacngtgcgagagaggcgcagtggccgcaactaagtcgtttctactattatggtatggacgctggggccgagggaccacggtcacgtctcctcagcctcaccaagggcccatcggtcttccccctggccaccctcctccaagagcacctctgggggcacagcggccctggggctgcctggtcaaggctacttccanatagtatctgagcgggntggcaaggcncatagnnnnnn

SEQ ID NO: 50873 - DNA, 622 bp, Homo sapiens
  misc_feature: GYAE6OF01BD6EH.24.62.F07.1.454.CMB.1.raw
  modified_base (456)..(456): a, c, t, g, unknown or other
  misc_feature (456)..(456): n is a, c, g, or t
  modified_base (605)..(605): a, c, t, g, unknown or other
  misc_feature (605)..(605): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatgtgtacttactattggagctggactccggaagcccggacggggaaggactgggagtggattggcctatatcctacgccaagtggggaacaaccgaggtaccaaccccctcctaccagacgtcgacgtcacctatttcacgtcggacccgtacaaagtaacctaattcgtccctagtacgttctagtaactttctaggtcgaacccgccgtanaacggaccgaccggtcctaatttactacgtggtcgacgtaggacgacggcgacgaggtcggaccgactaacgttacgttcgtttctaattagttagtggtactcggaccgtccggtagggggacccaaggggtaccccacgggttaccncccgttcgtcctaccgg

SEQ ID NO: 50874 - DNA, 521 bp, Homo sapiens
  misc_feature: GYAE6OF01AV0Q2.24.62.F07.1.454.CMB.1.raw
  modified_base (219)..(219): a, c, t, g, unknown or other
  misc_feature (219)..(219): n is a, c, g, or t
  modified_base (233)..(233): a, c, t, g, unknown or other
  misc_feature (233)..(233): n is a, c, g, or t
  modified_base (243)..(243): a, c, t, g, unknown or other
  misc_feature (243)..(243): n is a, c, g, or t
  modified_base (381)..(381): a, c, t, g, unknown or other
  misc_feature (381)..(381): n is a, c, g, or t
  modified_base (457)..(457): a, c, t, g, unknown or other
  misc_feature (457)..(457): n is a, c, g, or t
  modified_base (460)..(464): a, c, t, g, unknown or other
  misc_feature (460)..(464): n is a, c, g, or t
  modified_base (467)..(468): a, c, t, g, unknown or other
  misc_feature (467)..(468): n is a, c, g, or t
  modified_base (472)..(472): a, c, t, g, unknown or other
  misc_feature (472)..(472): n is a, c, g, or t
  modified_base (482)..(482): a, c, t, g, unknown or other
  misc_feature (482)..(482): n is a, c, g, or t
  modified_base (488)..(488): a, c, t, g, unknown or other
  misc_feature (488)..(488): n is a, c, g, or t
  modified_base (490)..(490): a, c, t, g, unknown or other
  misc_feature (490)..(490): n is a, c, g, or t
  modified_base (505)..(506): a, c, t, g, unknown or other
  misc_feature (505)..(506): n is a, c, g, or t
  modified_base (509)..(509): a, c, t, g, unknown or other
  misc_feature (509)..(509): n is a, c, g, or t
  modified_base (511)..(511): a, c, t, g, unknown or other
  misc_feature (511)..(511): n is a, c, g, or t
  modified_base (513)..(514): a, c, t, g, unknown or other
  misc_feature (513)..(514): n is a, c, g, or t
  modified_base (516)..(517): a, c, t, g, unknown or other
  misc_feature (516)..(517): n is a, c, g, or t
tcagactactatgtcacgaccggtgctcgatttagtagtcgcataaaagggaaaaggggacgtggaggtggattggccatagtctacgccaatgggagaacccagggtacaaccccctcctccagaccgtcgagtcaccatttcactggacccgtccaagaaccaattcgtccctgagtctgaattctgtgaccgccgcagacacggccacttattacngtgcgagagaggcncagtggccgnaactaagtcgtttcactattatggttatggacgcctggggccgagggaccacggtcaccgtctcctcagcctccaccaagggcccaagtcggtcttcccccgtggccacccctcctcccaagcgcacctcgtggggcncgacgcggcctgggctgccgtggtcaaggactacttccacatagtagtctgagcgggctggacgaaggcgcatagntgnnnnnacnnacgntagtctgagngtgcgnancgcgtagctagctgnngcncncnncnngtcg

SEQ ID NO: 50875 - DNA, 653 bp, Homo sapiens
  misc_feature: GYAE6OF01A0FQH.24.62.F07.1.454.CMB.1.raw
  modified_base (262)..(262): a, c, t, g, unknown or other
  misc_feature (262)..(262): n is a, c, g, or t
  modified_base (324)..(324): a, c, t, g, unknown or other
  misc_feature (324)..(324): n is a, c, g, or t
tcagactactatgtcacgaccggtgctcgatttagtagtcgcataaaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatgtgtacttactatgganctggatccggaagcccgcgggaaggactggagtgattggccatatctacgccaagtgggaanaaccaggtaccaaccccctcctaccagacgtcgacgtcactatttcactcggaccctcaaagaaccatttcgaccctgacgtctagtaattcagttcgacccgccgacagaccgaccggacctaactttattaccgtgtacggcgaaggacggtacgggccgacgtaagggtccgggacccgacctaaacgttaacggttccggttttacaaccgttaagtttacgtagggttaacgttgggaacccggttcccggttagggggggaccccgaaagggggtaaccccctacgggggtttacccaaccccgggttcctaccccggttccg

SEQ ID NO: 50876 - DNA, 562 bp, Homo sapiens
  misc_feature: GYAE6OF01ANVDF.24.62.F07.1.454.CMB.1.raw
  modified_base (482)..(482): a, c, t, g, unknown or other
  misc_feature (482)..(482): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtccccaggttcaacttcaggagtcgggcccaggactggtgaagccttcacagaccctgtcccctcacttgcactgtctctggtgctccatcaatagtggtacttactattggagctggatccggaagcccgcgggaagggactggagtggattgggccatatctacgccaatgggagaaccaggtaccaacccctccctccagacgtcgagtcaccatttcactggacccgtccaagaaccaattcgtccctgacgtctgaattctgtcgaccgccgcagaccacggcctattacttactgtcgcgagagacggcgcgaggtggcccganaacgtagtcgtttacacttattagtggtatggacgccgtgggggcccgagggacccgacggtccgacccgtctccgtacg

SEQ ID NO: 50877 - DNA, 608 bp, Homo sapiens
  misc_feature: GYAE6OF01CIFQ7.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatagtggtacttactattggagctggatccggaagcccggcgggaaggctgggagtggattggccatatctacgccaatgggagaaccaggtaccaaccccctcctccagacgtcgagtccaccatttcacgtcggaccctccaaagaaccctaattcgtacccctgacgtctagaatttccgtgtcgacccgccgacaggaccaccgggaccctactttattactgtcgcggaagaggacgggcgcagggtcggacccgactaaccgttagttaccgtttctaacttagttagttggtacgttgggaccgtccgtgggggacccacggggtaccccacgggttcccacccggttccgtccgtccg

SEQ ID NO: 50878 - DNA, 624 bp, Homo sapiens
  misc_feature: GYAE6OF01DKDW8.24.62.F07.1.454.CMB.1.raw
  modified_base (310)..(310): a, c, t, g, unknown or other
  misc_feature (310)..(310): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatagtggtacttactattggagctggatccggaagcccggcggggaaggctggagtggattggccatntctacgccaaagtgggacaaccgaggtaccaaccccctcctaccagtacgtcgatccacctatttcacgttcggaccccgtacaaacgaacctaattcgtacccctagtacgtctagtaattcgtagtcgacccgccgacacggaacaccggctaacttattacgtgtcgacgagaggacgcgacagggtcggacccactaaacgttacggttcgttttacctacttaattacgtagggttactacgggaccggtccggtcggggggaccgtaacgggcccgtaacggtcccgacccgttccgcccgttacccg

SEQ ID NO: 50879 - DNA, 719 bp, Homo sapiens
  misc_feature: GYAE6OF01CU61D.24.62.F07.1.454.CMB.1.raw
tcagactactatgtcacgaccggtgctcgatttagtagtcgcataaagggaaagggtctgtgaaggcttcaccagtcctggacctcctgtgcaaagaacatagaaacatctgtggttcttcctcctcctggtggcagctcccagatgggtcctgtcccaggttcaacttcaggagtccgggcccaggactggtgaacgccttcacacgaccctgtccctcacttgcactgtctcgtggtgctccatcaatgtgtacttactattggagctggactccggaagcccggacgggaaggactggagtggagttcggactagtatcctaacgcctaaagtgggaacaaccgtacggtaacccaacccctacccgtccaaggacgtcgacgtccactactttacacgtcggaccctacgaaagtaacctaagttcgtaccctagtacgttacgtacgtaatttcgtcgtacgacccgccgtacgaacgaaccgaccggtccctaactttacgttacgtcgttacggacggtaaggtacgggaacggtccgacgtaacgggtccggacccgtaacgtaaccgttaccggtttccgtttaacttaaccgtttagtttaacggtacggttaacggttaccgggtaaccggtcccgggtacgggggaccccggtaacggggtaaccccgttacgggtacccgtaccccggttccgtaccccgtaccgg

SEQ ID NO: 50880 - DNA, 610 bp, Homo sapiens
  misc_feature: GYAE6OF01A3D05.24.62.F07.1.454.CMB.1.raw
  modified_base (328)..(328): a, c, t, g, unknown or other
  misc_feature (328)..(328): n is a, c, g, or t
  modified_base (353)..(353): a, c, t, g, unknown or other
  misc_feature (353)..(353): n is a, c, g, or t
  modified_base (419)..(419): a, c, t, g, unknown or other
  misc_feature (419)..(419): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtcccctcacttgcactgtctctggtgctccatcaatgtggtacttactattggagctggatccggaagcccgacggggaaggactggagtggattggccatatctacgccaagtggganaaccaggtaccaacccctcctcagngtcgagtcacctattcacgtcggaccctcaaagaacctaattcgccctgacgtctgtaactttcgngtcgacccgccgacagaccacggacctaacttattacctgtcgacgaagagacgggcgacgaggtcggacccgtacaacgttacgttccgttttacaacttagtttagtagggttatcggggaaccggtcccggtaggggggacccgaacggggtaccccacgggttccaaccccggttcttcccgtaccg

SEQ ID NO: 50881 - DNA, 442 bp, Homo sapiens
  misc_feature: GYAE6OF01EN9QE.24.62.F07.1.454.CMB.1.raw
  modified_base (436)..(442): a, c, t, g, unknown or other
  misc_feature (436)..(442): n is a, c, g, or t
tcagactactatgtcacgaccggtgctcgatttagtagtcgcataaagggaaagggactggagtggattggccatatctacgccaatgggagaaccaggtacaacccctccctccagagtcgagtcaccatttcactggacccgtccaagaaccaattgtccctgagtctgaattctgtgaccgccgcagacacggccacttattactgtgcgagagaggcgcagtggccgcaactaagtcgtttctactattatggtatggacgcctggggccgagggaccacggtcaccgtctcctcagcctccaccaagggcccatcggtcttccccctggcaccctcctccaagagcacctctgggggcacagcggccctgggctgcctggtcaaggactacttccacatagtagtctgagcgggctggcaaggcgcatagnnnnnnn

SEQ ID NO: 50882 - DNA, 580 bp, Homo sapiens
  misc_feature: GYAE6OF01D7FR3.24.62.F07.1.454.CMB.1.raw
  modified_base (475)..(475): a, c, t, g, unknown or other
  misc_feature (475)..(475): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatagtgtacttactattggagctggatccggaagcccggacgggaaggactggagtggattggccatatctacgccaagtgggagaaaccgaggtaaccaaccccgtccctccagacgtcgagtcaccatttcactggaccctcaaacgaacctaagttcgtccctagacttctagaacttctgtcgacccgcgacagaccacggcctacttattactgtgcgagagagcganagtcgggccataactaggttcgtttactactatttagtggtaatgggaccgtccgtagggggcccgaaggggtacccacgggttccaacccggttctcccgtacg

SEQ ID NO: 50883 - DNA, 694 bp, Homo sapiens
  misc_feature: GYAE6OF01EIH2J.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcgaggagtccgggcccaggactggtagaacgtccttcacacgaccctcgtccctcacttgcactgtctcgtggtgcctcatcaatagtgtacttactagttggagctggactccggaacgcccggacggggaaggacgtggagtggtagttcggccatactcgtacgccgaagtgggaacgaaccgacggtaacccaaccccctccctacacgacgtcgagtccactattcacgtcggaccctacaaacgaacctaagttcgtccctagacttctagtaacttctgtacgacccgccgacaagacccgaccgggtccctaactttaacgttacgtggttcgaccgggtaagaacgggacgggccgacgtacgggtcgggacccgactaaaccgttaagtttcccgttttacctaacgtttaatttacggttagggttaacgttgggaacccggtcccgggttacgggggacccggtaaacggggtaccccgtacgggttacccgaacccggttccgtcccgtaaccg

SEQ ID NO: 50884 - DNA, 446 bp, Homo sapiens
  misc_feature: GYAE6OF01ET583.24.62.F07.1.454.CMB.1.raw
  modified_base (351)..(351): a, c, t, g, unknown or other
  misc_feature (351)..(351): n is a, c, g, or t
  modified_base (438)..(446): a, c, t, g, unknown or other
  misc_feature (438)..(446): n is a, c, g, or t
tcagactactatgtcacgaccggtgctcgatttagtagtcgcataaagggaaagggactggagtggattggccatatctacgccaatgggagaaccaggtacaacccctccctccagagtcgagtcaccatttcactggacccgtccaagaaccaattgtccctgagtctgaattctgtgaccgccgcagacacggccacttattactgtgcgagagaggcgcagtggccgcaaataagtcgtttctactattatggtatggacgcctggggccgagggaccacggtcaccggtctcctcagcctccaccaagggccccatcggtcttccccctggcaccctcctccaagngcacctctggggcacagcggccctgggctgcctggtcaaggactacttccacatagtagtctgagcgggctgggcaaggcgcatagnnnnnnnnn

SEQ ID NO: 50885 - DNA, 600 bp, Homo sapiens
  misc_feature: GYAE6OF01A36PD.24.62.F07.1.454.CMB.1.raw
  modified_base (216)..(216): a, c, t, g, unknown or other
  misc_feature (216)..(216): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtcccctnacttgcactgtctctggtggctccatcaatagtggtacttactattggagctggatccggaagcccgcgggaaggactggagtggattggccatatctacgccaagtgggacgaaccaggtaccaacccctccctccagagtacgagtcacctatttcacgtcggacccgtccaaagaaccctaattcgtccctagtacgtctagaatttctgtcgacccgccgacacgacaccgggcctaactttacttacgtgtgacgagagacggcgactaggtcggccgactaacgtaagttccgtttactaacttattagttgggtattgggaccgtccggtgggggacccgacggggaccctacggtaccacccgttcctccgtaccg

SEQ ID NO: 50886 - DNA, 708 bp, Homo sapiens
  misc_feature: GYAE6OF01BR7NN.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatgtggtacttatattggagctggatccggaacgcccggacggggaagggactggagtggattggcatatcacgcaagtgggagaaccaggtaccaacccctcctacagacgtcgagtcacctattcactcggaccctcaaagaaccaattcgtccctagacgttctgtaaacttctgtacgacccgtccgacaacgactaccggccttaacgttaacttacgtgttacgacggtaagacggaacgggccgacgtaaggggttccgggcccgtaactaaaaccggtttaacggttccgttttaacccgttaacgtttaaagttttaacgtagggggtttaaacgttaccgggggtaacccggtccccggggtttacggggggggacccccggtaaacggggggtaaccccctaacccgggggtttacccgtaaacccccgggtttccgtaacccccgttacccggg

SEQ ID NO: 50887 - DNA, 446 bp, Homo sapiens
  misc_feature: GYAE6OF01CF8OZ.24.62.F07.1.454.CMB.1.raw
  modified_base (441)..(446): a, c, t, g, unknown or other
  misc_feature (441)..(446): n is a, c, g, or t
tcagactactatgtcacgaccggtgctcgatttagtagtcgcataaagggaagggactggagtggattggccatatctacgccaatgggagaaccaggtacaacccctccctccagagtcgagtcaccatttcactggacccgtccaagaaccaattgtccctgagtctgaattctgtgaccgccgcagacacggccacttattactgtgcgagagaggcgcaggtggccgcaactaagtcgtttctactattatggtatgggacgccgtggggccgagggaccacggtcaccgtctcctcagcctccaccagggcccatcggtctccccctggcaccctcctccaagacgcacctctcgggggcacacgcggccctgggctggcctggtcaaggactacttccacatagtagtctgagcgggctgggcaaggcgcatagnnnnnn

SEQ ID NO: 50888 - DNA, 447 bp, Homo sapiens
  misc_feature: GYAE6OF01B2N5D.24.62.F07.1.454.CMB.1.raw
  modified_base (264)..(264): a, c, t, g, unknown or other
  misc_feature (264)..(264): n is a, c, g, or t
  modified_base (332)..(332): a, c, t, g, unknown or other
  misc_feature (332)..(332): n is a, c, g, or t
  modified_base (437)..(447): a, c, t, g, unknown or other
  misc_feature (437)..(447): n is a, c, g, or t
tcagactactatgtcacgaccggtgctcgatttagtagtcgcataaagggaagggactggagtggattggccatatctacgccaatgggagaaccaggtacaacccctccctccagagtcgagtcaccatttcactggacccgtccaagaaccaattgtccctgagtctgaattctgtgaccgccgcagacacggccacttattactgtgcgagagaggcgcagtggccgcaactaagtcgtttctactattatggtatggacnccgtggggccgagggaccacggtcaccgtctcctcagcctccaccaagggcccatcggttttcccccnggccaccctcctccaagacgcacctctggggcacgagcggcctgggctgcctggtcaacggctacttccacatagtagtctgagcgggctggcaaggcgcatagnnnnnnnnnnn

SEQ ID NO: 50889 - DNA, 644 bp, Homo sapiens
  misc_feature: GYAE6OF01CWKIG.24.62.F07.1.454.CMB.1.raw
  modified_base (324)..(324): a, c, t, g, unknown or other
  misc_feature (324)..(324): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatgtggtacttacattggagctggatccggaagcccgcgggaaggctggagtggattggccatactctacgccaagtggganaaccaggtaccaacccctcctacagacgtcgagtccactatttcactggaccctcaagaaccattcgtccctgactctagaactttctagtcgacccgccgcaacggaccaccgggcctaactttacgttacgtcgttcggcgtaaggaacggcgggccgacgaagggttcggacccgtactaaaccgttaacgttccggttttacctaacgttaacgttttagtagggttaacttcggggaacccgtccgggttacggggggaccccgtacgggggtaacccctacggggttcccaacccggttccgttccccgtaccg

SEQ ID NO: 50890 - DNA, 588 bp, Homo sapiens
  misc_feature: GYAE6OF01EJJJH.24.62.F07.1.454.CMB.1.raw
  modified_base (329)..(329): a, c, t, g, unknown or other
  misc_feature (329)..(329): n is a, c, g, or t
  modified_base (474)..(474): a, c, t, g, unknown or other
  misc_feature (474)..(474): n is a, c, g, or t
  modified_base (571)..(571): a, c, t, g, unknown or other
  misc_feature (571)..(571): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatagtggtacttactattggagctggatccggaagcccggccgggaagggactggagtggattggccatatctacgccaagtggganaaccaggtaccaacccctccctccagagtcgagtcacatttcactcggacccgtaccaagaaccctaattcgtccctagacgtctagtaattctgtgtacccgccgcagaccacggcctacttacttactgtgcgagagacggcncgagtcggccacgtaacgttaagtcgtttactacttattacgtggtacttgggaccgtcccggttggggcccggaacggggtaccctaccgggtacncccggttctcccgtacg

SEQ ID NO: 50891 - DNA, 445 bp, Homo sapiens
  misc_feature: GYAE6OF01DNHCP.24.62.F07.1.454.CMB.1.raw
  modified_base (434)..(434): a, c, t, g, unknown or other
  misc_feature (434)..(434): n is a, c, g, or t
  modified_base (439)..(445): a, c, t, g, unknown or other
  misc_feature (439)..(445): n is a, c, g, or t
tcagactactatgtcacgaccggtgctcgatttagtagtcgcataaagggaagggactggagtggattggccatatctacgccaatgggagaaccaggtacaacccctccctccagagtcgagtcaccatttcactggacccgtccaagaaccaattgtccctgagtctgaattctgtgaccgccgcagacacggccacttattactgtgcgagagaggcgcagtggccgcaactaagtcgtttctactattatggtatggacgcctggggccgagggaccacggtcaccgtctcctcagcctccaccaagggccccatcggtcttccccctggccaccctcctccaagagcacctctgggggcacagcggccctgggctgcctggtcaagggactacttccacatagtagtctgagcgggctgggcaaggcgnatagnnnnnnn

SEQ ID NO: 50892 - DNA, 712 bp, Homo sapiens
  misc_feature: GYAE6OF01C4MKM.24.62.F07.1.454.CMB.1.raw
  modified_base (246)..(246): a, c, t, g, unknown or other
  misc_feature (246)..(246): n is a, c, g, or t
  modified_base (326)..(326): a, c, t, g, unknown or other
  misc_feature (326)..(326): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatgngtacttacattggagctggatccggaagcccgcgggaaggctggagtggatttggcctatactcgtacgccaagtggganaaccgaggtaccaaccccgtccctaccagtacgtcgaagtcaacctatttcacttcggacccgtccaaaggaacccaattcgtccctagacgtctaggatttcctgtcgaaccgtccgctaacgacgaccgggcctaacgtttactactggttcgacggtaagtacggaacgggccggtacgtaacgggttcgggaccccgtacgttaaaccgttagggtttacccgtttttaaccgtaaaccgtttaacgttttaacgacggggtttaacttcgggggaaacccggttccccgggtttagggggggacccccgtaaaggggggttaaaccccctaccggggtttacccgtaaacccccgggttccgttaccccggttaacccggg

SEQ ID NO: 50893 - DNA, 601 bp, Homo sapiens
  misc_feature: GYAE6OF01AYY5F.24.62.F07.1.454.CMB.1.raw
  modified_base (455)..(455): a, c, t, g, unknown or other
  misc_feature (455)..(455): n is a, c, g, or t
  modified_base (469)..(469): a, c, t, g, unknown or other
  misc_feature (469)..(469): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatagtggtacttactattggagctggatccggaagcccggcggggaaggctgggagtggattggccatatctacgccaagtgggacaccaggtaccaacccctcctcagacgtcgagtcactatttccactcggaccctcaaacgaaccaattcgtccctgacgtctagtattcagtcgacccgcgcagaccacggactacttactacgtcgngacgagagacggcncgaggtcggaccactaacgttacggttcctttacgtattacgttagttagggtacttaggggacccgtccgggttcggggggaccctaagggggacccctacgggtacctacccggttccttccccgtaccg

SEQ ID NO: 50894 - DNA, 443 bp, Homo sapiens
  misc_feature: GYAE6OF01DGAR8.24.62.F07.1.454.CMB.1.raw
  modified_base (434)..(443): a, c, t, g, unknown or other
  misc_feature (434)..(443): n is a, c, g, or t
tcagactactatgtcacgaccggtgctcgatttagtagtcgcataaagggaagggactggagtggattggccatatctacgccaatgggagaaccaggtacaacccctccctccagagtcgagtcaccatttcactggacccgtccaagaaccaattgtccctgagtctgaattctgtgaccgccgcagacacggccaactttattactgtgcgagagaggcgcagtggccgcaactaagtcgtttcactattatggtatggacgcctggggccgagggaccacggtcaccgtctcctcagctccaccaagggcccatcggtcttcccctggcaccctcctccaagagcacctctggggcacagcggccttgggctgcctggcaaggactacttccacatagtagtctgagcgggctggcaagggcgcagtagnnnnnnnnnn

SEQ ID NO: 50895 - DNA, 469 bp, Homo sapiens
  misc_feature: GYAE6OF01C4RQ2.24.62.F07.1.454.CMB.1.raw
  modified_base (448)..(448): a, c, t, g, unknown or other
  misc_feature (448)..(448): n is a, c, g, or t
  modified_base (455)..(469): a, c, t, g, unknown or other
  misc_feature (455)..(469): n is a, c, g, or t
tcagactactatgtcacgaccggtgctcgatttagtagtcgcataaagggaaagggactggagtggattggccatatctacgccaatgggagaaccaggtacaacccctccctccagagtcgagtcaccatttcactggacccgtccaagaaccaattgtccctgagtctgaattctgtgaccgccgcagacacggccacttattactgtgcgagagaggcgcagtggccgcaactaagtcgtttctactattatggtatggacgcctggggccgagggaccacggtcaccgtctcctcagcctccaccaagggccccatccggtccttccccctggccaccctcctccaagacgcacctcgtcggggcacgacgcggcccgtgggcctcgcccgtggtacaacggactaccttccacagtagtagtctgaggcgggctggcaaggcncgatagnnnnnnnnnnnnnnn

SEQ ID NO: 50896 - DNA, 566 bp, Homo sapiens
  misc_feature: GYAE6OF01BU2HX.24.62.F07.1.454.CMB.1.raw
  modified_base (326)..(326): a, c, t, g, unknown or other
  misc_feature (326)..(326): n is a, c, g, or t
  modified_base (473)..(473): a, c, t, g, unknown or other
  misc_feature (473)..(473): n is a, c, g, or t
  modified_base (483)..(483): a, c, t, g, unknown or other
  misc_feature (483)..(483): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccagggactggtgaaggccttcacagaccctgtccctcacttgcactgtctctggtgctccatcaatgtggtacttactattggagctggatccggaagcccgccgggaaggctggagtggattggccatatctacgccaatggganaaccaggtaccaacccctcctacagagtcgagtcaccgatttcactcggaaccctccaaagaccaattcgtaccctgagtctagtaattctgtcgacccgtccgcagtaccacgggaccaactttatactgtcgacgagagaggcgnaggtcggccnaactagtctttctaactattagtggtagtgggacgtccggtagggcccgagggtacccacgggtacacccggtcgtccgtccg

SEQ ID NO: 50897 - DNA, 839 bp, Homo sapiens
  misc_feature: GYAE6OF01B1786.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcggcccaggactggtgaagccttcacacgaccctgtccctcacttgcactgtctctggtgctccatcaatgtgtacttactattggagtctaggactccgggaacggccccggacggggaaagggaccgtgggaaggttgggaacgtttcgggaccctaagttactccgtaaaccggccctaaaggttcggggaacgaaacccgtagggttaaccccaaacccccgttccctaccgaagaaccgtcgaacgtccaacctaatttccaaccgtacggaaccccgtacaaacgtaaccctaattcgtaccctggtacttcgtagtaacttctggtaccgacccgtccgacgaacgtacccgaaccgggtcccttaacgtttaactttaccgtcggttacggacggtaacggaacgggtacgggaccgtacggaacggggttaccgggacccggtaaaccttaaaccggtttaaaccgggttttcccgttttaaacccgttaaacgtttacgttttaaaacgggttcgggtttaaacggttacgggggtaaaccccggtttcccgggggttaccgggggggtaacccccgtaaacggggggtaacccccgttaaccccgggggttaacccgtaccccccgggtttcgttaccccccggtaaccccggg

SEQ ID NO: 50898 - DNA, 698 bp, Homo sapiens
  misc_feature: GYAE6OF01B4B7H.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatggtcctgtcccaggttcaacttcaggagtcgggcccaggactggtgaagccttcacacgaccctgtccctcacttgctactgtctcgtggtgctccatcaatgtgtacttactattggagctggactccggaacgcccggacggggaagggactggagtggattcggccattactctacgcctaagtcgggaacaaccgacggtaccaacccccgtcctaccgagacgtcgagtcactattcacgtcggaccctacaacgtaacctagttcgtccctaggacgttctagtaactttcgtaggtcgaccccggtccgacgaacgaacccgtaccggtccttaaattttaccgttaacgttcggtacggacggaagggaacggtacggccgaccgtacggggtccgggaccctacggttaaacgttaaccggttttccgtttaaccgttaactttaacgtttaaggttcgggttaacgttcggggaacccgttccgggtacgggggtacccggaacgggtacccgacggttacccgtacccggtccttcccgtacg

SEQ ID NO: 50899 - DNA, 598 bp, Homo sapiens
  misc_feature: GYAE6OF01AFJGO.24.62.F07.1.454.CMB.1.raw
  modified_base (545)..(545): a, c, t, g, unknown or other
  misc_feature (545)..(545): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtcccctcacttgcactgtctctggtgctccatcaatagtggtacttactattggagctggatccggaagcccggccggggaagggactgggagtggattgggccatatctacgccaagtgggacgaaccaggtaccaacccctccctaccagacgtcgagtccacctatttcacgtcggacccgtcaacgaacctaattcgtccctagagtcctagtaattctgtcgacccgccgacagaccacggccctaacttattactgtcgacgagagaggcgcgaggtcggccgactaacgtagttccgtttacacttattacgtagggtactgggaaccncggttacgggggacccgacgggtacccacgggtcacccggttctcccgtaccg

SEQ ID NO: 50900 - DNA, 699 bp, Homo sapiens
  misc_feature: GYAE6OF01CX4PB.24.62.F07.1.454.CMB.1.raw
  modified_base (215)..(215): a, c, t, g, unknown or other
  misc_feature (215)..(215): n is a, c, g, or t
  modified_base (260)..(260): a, c, t, g, unknown or other
  misc_feature (260)..(260): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccagggactggtgaagccttcacagaccctgccctnacttgcactgtctctggtgctccatcaatgtgtacttcattgganctggatccggaagcccgaccggggaaggactggagtggattggccatatctaccgaccaagtgggacgaaaccgaggtaacccaaccccctcccgtaccacgaacgtcggtacgtaccaacctaactttaccgacgttcgggaaccccttacccgaaacgtaaaaccctaaagtttccggtaacccccttggaacgtttcccgtaagtaactttcctcggtacgaacccgcccgtacaaaggcccgtacccgggacctaacttacttacgtcgttcggaccggtaagacggaagggccgtaatacggggtcggcccgtaactaaacgttacggttaccgtttcctaccgtaaatttgtacggttaaagtcgggaaccgtccggtacgggggacccgaagggtacccccgaagggttccaacccggttcctccgtacccg

SEQ ID NO: 50901 - DNA, 633 bp, Homo sapiens
  misc_feature: GYAE6OF01C78GD.24.62.F07.1.454.CMB.1.raw
  modified_base (330)..(330): a, c, t, g, unknown or other
  misc_feature (330)..(330): n is a, c, g, or t
tcagactactatgtcacgaccggtgctcgatttagtagtcgcataaagggaaagggtctgtgaaggcttcaccagtcctggacctcctgtgcaagaacatgaaaacatctgtggttcttcctcctcctggtggcagctcccagatgggtcctgtcccaggttcaacttcaggagtcgggcccaggactggtgaagccttcacacgacccctgtccctcacttgcactgtctctggtgctccatcaatagtggtacttactattggagctggatccggaagcccgccggggaaggactggagtggattggccatatctacgcaagtggganaaaccgaggtaaccaccccgtcccctacagacgtcgacgtcacctatttcacgtcggaccccgtacaaacgtaaccaagttcgtacccctggacgtctagaactttctaggtcgacccgccgacaacgaccgaccggtcctaactttacttactgtcgacggaagaggcgggtccacgtaggtcgggaccctacaacgttacggttccgtttaccttaactaagtttacgtggttagtgggaccggtcccggtgggggacccgtacggggaacccacgggttccacccgtcttccccgtacgg

SEQ ID NO: 50902 - DNA, 606 bp, Homo sapiens
  misc_feature: GYAE6OF01ANFS5.24.62.F07.1.454.CMB.1.raw
  modified_base (460)..(460): a, c, t, g, unknown or other
  misc_feature (460)..(460): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtcccctcacttgcactgtctctggtgctccatcaatagtggtacttacattggagctggatccggaagcccgcgggaaggactggagtggattggccatatcctacgccaatggggagaaccgagggtaccaaaccccgtccctcccgaagacgtcgagttcaccatttcactggacccgtcaagaaccgaattgtccctgacgtcctgaattctgtcgtaccgccgtacagaccacggccacttattacngtgcgagagaggcgacgagtcggaccgcaaccgttaagtccgtttacgtaacttacgttaagtcggttatcgggaactccccggttagggggccccgtaacggggaacccaccgggttccaaacccggttccgtaccccgtaccgg

SEQ ID NO: 50903 - DNA, 592 bp, Homo sapiens
  misc_feature: GYAE6OF01BC2J7.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtcccctcacttgcactgtctctggtggctccatcaatagtggtacttactattggagctggatccggaagcccggaccggggaagggactgggagtggattggccatatctacgccaagtgggaacgaaccgaggtaaccaaccccctcccctaccagacgtcgacgtcaccatttcactcggacccgtaccaaagaaccaattcgtccctagacgtctgaacttcgtgtcgacccgccgacacgaccacggcctacttactactgtgcgagagagcgcaggtcggaccgacaacgtagtcgtttactacttattagtaggttactgggaccgccggttggggaccgacgggaccaccgggtacacccggttctcccgtaccg

SEQ ID NO: 50904 - DNA, 462 bp, Homo sapiens
  misc_feature: GYAE6OF01BJ5Y8.24.62.F07.1.454.CMB.1.raw
  modified_base (451)..(462): a, c, t, g, unknown or other
  misc_feature (451)..(462): n is a, c, g, or t
tcagactactatgtcacgaccggtgctcgatttagtagtcgcataaagggaagggactggagtggattggccatatctacgccaatgggagaaccaggtacaacccctccctccagagtcgagtcaccatttcactggacccgtccaagaaccaattgtccctgagtctgaattctgtgaccgccgcagacacggccacttattactgtgcgagagaggcgcagtggccgcaactaagtcgtttctactattatggtatggacgctggggccgagggaccacggtcaccgtctcctcagcctccaccaacggcccatcggtccttccccctggccaccctcctccaacgagccacctcgtggggcacgacgccggcccgtgggctgccgtggtcgaaggacctacgtcccacatagtagtctggacgcgggctggacgaaggcgacatagnnnnnnnnnnnn

SEQ ID NO: 50905 - DNA, 701 bp, Homo sapiens
  misc_feature: GYAE6OF01D026F.24.62.F07.1.454.CMB.1.raw
  modified_base (262)..(262): a, c, t, g, unknown or other
  misc_feature (262)..(262): n is a, c, g, or t
  modified_base (375)..(375): a, c, t, g, unknown or other
  misc_feature (375)..(375): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatgtgtacttactattgganctggactccggaacgcccggcgggaaggctggacgtggattggccagttatcgtacgaccaagtgggacaaaccgtcggtaaccaccccctcctccagacgtcgtatcacctntttcacgtcggacccgtacaagaacctaattcgtccctagacgttctaggtaaacttcgtaggttacgacccgtccgtacaacggaccaaccgggtccttaacgttactttaacgtgttacggaccgtaaggtacgacgggtcgtacgagggttcgggaacccgtctaaaaccgttacggtttccgttttaccgtaacgtttaacttttacggtacggggtttaacgttagggaccccggttccgggttacggggggtaaccccgaagggggttaccccctaacgggggttaaccccctacccgggttccgttccccggtaacccg

SEQ ID NO: 50906 - DNA, 654 bp, Homo sapiens
  misc_feature: GYAE6OF01D6F4N.24.62.F07.1.454.CMB.1.raw
  modified_base (458)..(458): a, c, t, g, unknown or other
  misc_feature (458)..(458): n is a, c, g, or t
  modified_base (473)..(473): a, c, t, g, unknown or other
  misc_feature (473)..(473): n is a, c, g, or t
  modified_base (645)..(645): a, c, t, g, unknown or other
  misc_feature (645)..(645): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtcccctcacttgcacttgtctctggtgctccatcaatagtgtacttactagttggatctggactccggaacgcccggacggggaaggactgggagtggtattcggaccattactcgtacgccaagttggggaacaaccgacggtaccaaccccctcctccgaagtcgtacgagtccaacctactttcaccgttcgggacccctacaaacgaacccgtaatttccgaccctggactcgtagtaatttcgngtacgacccgccganacggaccaccgggcctatttacgtaccgtggtcacgggaagagcggccgactaggggtccgcccgactaaaccggttagttccgtttaccagtttacttagtcgggttatcggggaacctcgggtacgggggacccgtaacggggtaccccacgggttcccaccggtttccnccggtaccg

SEQ ID NO: 50907 - DNA, 448 bp, Homo sapiens
  misc_feature: GYAE6OF01EZME6.24.62.F07.1.454.CMB.1.raw
  modified_base (216)..(216): a, c, t, g, unknown or other
  misc_feature (216)..(216): n is a, c, g, or t
  modified_base (364)..(364): a, c, t, g, unknown or other
  misc_feature (364)..(364): n is a, c, g, or t
  modified_base (374)..(374): a, c, t, g, unknown or other
  misc_feature (374)..(374): n is a, c, g, or t
  modified_base (440)..(448): a, c, t, g, unknown or other
  misc_feature (440)..(448): n is a, c, g, or t
tcagactactatgtcacgaccggtgctcgatttagtagtcgcataaagggaaagggactggagtggattggccatatctacgccaatgggagaaccaggtacaacccctccctccagagtcgagtcaccatttcactggacccgtccaaagaaccaattgtccctgagtctgaattctgtgaccgccgcagacacggccacttatactgtgcgagngaggcgcagtggccgcaaataagtcgtttctactattatggtatggacgcctggggccgagggaccacggtcaccggtctcctcagcctccaccaagggcccatcggtctccccctggcaccctcctccaagagcacctctgggggcncagcggcccngggctgccctggtcaaggactacttccacatagtagtctgagcggggctgggcaagggcgcatagnnnnnnnnn

SEQ ID NO: 50908 - DNA, 576 bp, Homo sapiens
  misc_feature: GYAE6OF01A775Z.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatagtggtacttactattggagctggatccggaagcccgcgggaggactggagtggatggccatatctacgccaatggagaaccaggtaccaacccctcctccagacgtcgagtcacctatttccacgtcggacccgtaccaaacgaaacctaagttcgttacccctaggtacgtcctagtaactttcgtgttcggacccgccgcaacgaccaccgggcctacttattacgtgtcgcgagagacggcgcgagtcggccgacaactacgtcgtttctacttattagtggtatggacgccgtggggccgagggaccacggtccaccgtctccgtcg

SEQ ID NO: 50909 - DNA, 618 bp, Homo sapiens
  misc_feature: GYAE6OF01DVWRO.24.62.F07.1.454.CMB.1.raw
  modified_base (267)..(267): a, c, t, g, unknown or other
  misc_feature (267)..(267): n is a, c, g, or t
  modified_base (453)..(453): a, c, t, g, unknown or other
  misc_feature (453)..(453): n is a, c, g, or t
tcagactactatgtcacgaccggtgctcgatttagtagtcgcataaaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactgggtgaagccttcacacgaccctgtccctcacttgcactgtcctcgtggtgctccatcaatagtgtacttatattgganctggactccggaacgcccggacgggaaggactggagtggattcggacctatactcgtacgccaagtgggaacaaccgacggtaacccaacccctcctacagacgtcgacgtccaacctattcacgtcgaccctacaagaacctagttcgcctagctcgtatacttgtgtcgacccgcgacacgacnccgactacttattactgtacgacgagcggacggccgacgtggtcgacccgtaacgtaacgttacggttctttactaacttagtttagtacggtagtacgggaccggtccggtacggggcccgaacgggtacccgtacggtaccctaccgttccgtacccgtaccg

SEQ ID NO: 50910 - DNA, 459 bp, Homo sapiens
  misc_feature: GYAE6OF01DPF9I.24.62.F07.1.454.CMB.1.raw
  modified_base (209)..(209): a, c, t, g, unknown or other
  misc_feature (209)..(209): n is a, c, g, or t
  modified_base (267)..(267): a, c, t, g, unknown or other
  misc_feature (267)..(267): n is a, c, g, or t
  modified_base (411)..(411): a, c, t, g, unknown or other
  misc_feature (411)..(411): n is a, c, g, or t
  modified_base (448)..(459): a, c, t, g, unknown or other
  misc_feature (448)..(459): n is a, c, g, or t
tcagactactatgtcacgaccggtgctcgatttagtagtcgcataaagggaaagggactggagtggattggccatatctacgccaatgggagaaccaggtacaaccccctcctccagagtcgagtcaccatttcactggacccgtccaaagaaccaattgtccctgagtctgaattctgtgaccgccgcagacacggccacttattacngtgcgagagaggcgcagtggccgacaactaagtcgtttcacttattatggtatggacnccgtggggccgagggaccacggtcaccgtctcctcagcctccaccgaagggccccatcggtccttcccccgtggccaccctcctccaagagcacctcgtggggcacaggccggcctgggctgcctggtacaaggactacttcanatagtagtctgaggcgggctggacaagggcacatagnnnnnnnnnnnn

SEQ ID NO: 50911 - DNA, 781 bp, Homo sapiens
  misc_feature: GYAE6OF01EUW28.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatgtggtacttatagttggagctggactccggaacgccccggaccggggaaggacgtagggagtggacgttggcctagtactacctacggaccaaggtcggggaacaaccgtacgggtaaccctaaacccccctcccgtaccgaagtacggtacgaacggttccaacccgttactttaccgaccgttaccgggaaccccgtccgaaaaacggaacccttaagtttccgtaccctaggtaacgtttctaacggttaactttccgtaggttaccgaaccccggccgtacgaaacggacccgaccggtacccttaactttacgttacgtcggtcggtaccgaggaaggcgggccgacgtacgggtcggacccgtaactaaaccgtttaacggtttccgtttaaccttaacggttttaacttaaggttcgggtaacgttacgggggacccggttaccccggggttagggggggaacccccgtaacgggggtaaccccgtacccgggtttaccccacccggttttcccgtaccccggtaacccg

SEQ ID NO: 50912 - DNA, 573 bp, Homo sapiens
  misc_feature: GYAE6OF01BCCFK.24.62.F07.1.454.CMB.1.raw
  modified_base (175)..(175): a, c, t, g, unknown or other
  misc_feature (175)..(175): n is a, c, g, or t
  modified_base (525)..(525): a, c, t, g, unknown or other
  misc_feature (525)..(525): n is a, c, g, or t
  modified_base (529)..(530): a, c, t, g, unknown or other
  misc_feature (529)..(530): n is a, c, g, or t
  modified_base (533)..(533): a, c, t, g, unknown or other
  misc_feature (533)..(533): n is a, c, g, or t
  modified_base (535)..(535): a, c, t, g, unknown or other
  misc_feature (535)..(535): n is a, c, g, or t
  modified_base (537)..(537): a, c, t, g, unknown or other
  misc_feature (537)..(537): n is a, c, g, or t
  modified_base (539)..(540): a, c, t, g, unknown or other
  misc_feature (539)..(540): n is a, c, g, or t
  modified_base (542)..(542): a, c, t, g, unknown or other
  misc_feature (542)..(542): n is a, c, g, or t
  modified_base (544)..(545): a, c, t, g, unknown or other
  misc_feature (544)..(545): n is a, c, g, or t
  modified_base (547)..(547): a, c, t, g, unknown or other
  misc_feature (547)..(547): n is a, c, g, or t
  modified_base (549)..(552): a, c, t, g, unknown or other
  misc_feature (549)..(552): n is a, c, g, or t
  modified_base (554)..(557): a, c, t, g, unknown or other
  misc_feature (554)..(557): n is a, c, g, or t
  modified_base (559)..(559): a, c, t, g, unknown or other
  misc_feature (559)..(559): n is a, c, g, or t
  modified_base (561)..(561): a, c, t, g, unknown or other
  misc_feature (561)..(561): n is a, c, g, or t
  modified_base (563)..(568): a, c, t, g, unknown or other
  misc_feature (563)..(568): n is a, c, g, or t
  modified_base (570)..(571): a, c, t, g, unknown or other
  misc_feature (570)..(571): n is a, c, g, or t
  modified_base (573)..(573): a, c, t, g, unknown or other
  misc_feature (573)..(573): n is a, c, g, or t
tcagactactatgtcacgaccggtgctcgattttagtagtcgcataaagggaaaggggactggagtggattggccatatctacgccaatgggagaaccaggtacaacccctccctccagagtcgagtcaccattcactggaccgtcaagaccaattgtccctgagtctgaattcngtgaccgccgcagacacggccacttattactgtgcgagagaggcgcagtggccgcaactaagtcgtttcactattatggtatggacgccgtggggccgagggaccacggtcaccgtctcctcagcctccaccaacgggccccatccggtccttcccccgtggccaccctcccgtccaacgacgctaccttcgtgggggccacgacgcggtcccgtcggggcctcggccctgggtccgaaacgggtaccgtaacctttcccgaacctaacgttaacggttacgttaccgttaggtaacggtccggggaccgttacgggaccgtaaacggggccgacgtaaccgttagcgangacnngcngngngnngntnntngnnnntnnnngngngnnnnnncnngn

SEQ ID NO: 50913 - DNA, 686 bp, Homo sapiens
  misc_feature: GYAE6OF01CAWT9.24.62.F07.1.454.CMB.1.raw
  modified_base (464)..(464): a, c, t, g, unknown or other
  misc_feature (464)..(464): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctcatcaatagtggtacttactattggagctggactccgggaagcccggacggggaaggctgggagtggattggccatacgtctacgctaagtgggactaaccgaggtaacccaaccccgtcctaccgaggacgttcggaacgttccaactactttcaccgttacggtaaccccgtaccaaagtaacccaaagtttcgtaccccgtagtaacgttctaggaacttttcgnggttacgaaccccggccgtacgtacgaccgacggtaccctaactttatttaccgtggtcgtacgtaagggagacggtccgacggtagtccgggaccctacgtaaaccgttaggttacccgttttactaacttagtttagtgggttaactgggtacccgttccgggtgggggtaccccggaggggtaccccaacgggttcctaacccgttcgttccccgtacg

SEQ ID NO: 50914 - DNA, 487 bp, Homo sapiens
  misc_feature: GYAE6OF01C06H5.24.62.F07.1.454.CMB.1.raw
  modified_base (459)..(459): a, c, t, g, unknown or other
  misc_feature (459)..(459): n is a, c, g, or t
  modified_base (461)..(487): a, c, t, g, unknown or other
  misc_feature (461)..(487): n is a, c, g, or t
tcagactactatgtcacgaccggtgctcgatttagtagtcgcataaagggaagggactggagtggattggccatatctacgccaatgggagaaccaggtacaaccccctccctccagagtcgagtcaccatttcactggacccgtccaagaacccaattgtccctgagtctgaattctgtgaccgccgcagacacggccacttattactgtgcgagagaggcgcagtggccgcaactaagtcgtttcactattatggtatggacgccgtggggccgagggaccacggtcaccgtctcctcagcctccaccaagggccccatcggtccttccccctggccaccctcctccaagacgcacctcgtcgggggcacagccggcccgtggggctgccgtggtcgaaggactacttccacatagtagtctgaggcgggtcgtgggaccgaagggcgacgactagngnnnnnnnnnnnnnnnnnnnnnnnnnnn

SEQ ID NO: 50915 - DNA, 828 bp, Homo sapiens
  misc_feature: GYAE6OF01BD5D2.24.62.F07.1.454.CMB.1.raw
  modified_base (268)..(268): a, c, t, g, unknown or other
  misc_feature (268)..(268): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggccaggactggtagaagccttcacagaccctgtccctcacttgcactgtctcgtggtgctccatcaagtgtggttacttacgtagttggancgtggactaccggaacgcccggacggggaagggactgggaggtggtaacgttcgggacctaagttacgtaccgtaacggacctaaagggttcggggaaccgtaaacccgtaacgggtaaccccctaaaccccccgttcccgtaccgaacggtaacggttaccgaacgttacccaaaccgttaactttccgaacccgttacgggtaaccccgtaccaaaacgtaaaccccttaagtttccggtaccccgtagtaacgtaccttaagggttaactttccgtcgggttaaccgacccccggtccgtacgaaaccgggtacccgaacccggggtcccttaaacttttaccgttaacggtcgggtacggaccggtaaagggtacgggacggaccggtccgtaaggggtcccggtaacccgaacgttaaaccgttaacgggtttccttttaacgtaacgtttaagtttaacggtcggttaacggtcggggtaacccgtcggttacggggggtaacccgaaccgggtaccgtaccgggttacccacccggttcccgtccgtaaccgg

SEQ ID NO: 50916 - DNA, 602 bp, Homo sapiens
  misc_feature: GYAE6OF01EM7IQ.24.62.F07.1.454.CMB.1.raw
  modified_base (470)..(470): a, c, t, g, unknown or other
  misc_feature (470)..(470): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtggctccatcaatagtggtacttactattggagctggatccggaacgcccggccgggaagggactggagtggattggccatactctacgccaagtgggacgaaccacggtaccaacccctcctccagacgtcgacgtcacctatttcactcggacccgtacaaacgaacctattcgtaccctgacttctacgtaatttcgagtcgacccgcgacagaccacggcctaacttattacgnggtgaccgagaggacggcgcgaggtcggaccactaacgttacgttcgtttactaacgttagttatcgggtacttcgggacgtcccgggtggggaccgaacggtacccgacggttaccaccgttccgtccacg

SEQ ID NO: 50917 - DNA, 595 bp, Homo sapiens
  misc_feature: GYAE6OF01BHJY9.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtcccctcacttgcactgtctctggtgctcatcaatagtggtacttactattggagctggatccggaagcccgccgggaaggactggagtggattggccatatctacgccaagtgggagaacccgaggtaaccaaccccctccctccagacgtcgagtccaccattttcaacgtggaccccgttccaaacggaacctaaattcgtccctagtacgtctagtaacttctgtcgacccgccgcaagaccacggcctacttattactgtcgcgagagaggcgcaggtcggccgacaaccgttaagttccgtttctaacttattagtggtactaggccgtccgtcggggaccgacggggacccacgggtaccacccggttcgtcccgtccg

SEQ ID NO: 50918 - DNA, 514 bp, Homo sapiens
  misc_feature: GYAE6OF01BPM8Q.24.62.F07.1.454.CMB.1.raw
  modified_base (495)..(514): a, c, t, g, unknown or other
  misc_feature (495)..(514): n is a, c, g, or t
tcagactactatgtcacgaccggtgctcgatttagtagtcgcataaagggaagggactggagtggattggccatatctacgccaatgggagaaccaggtacaaccccctccctccagagtcgagtcaccatttcactggacccgtccaagaaccaattgtccctgagtctgaattctgtgaccgccgcagacacggccacttatactgtgcgagagaggcgcagtggccgacaactaagtcgtttctaactattatggtatggacgtccgtggggccggagggaccacggtcaccggtctcctcacgccctccaccaacgggcccatccggtccttcccccgtggccaccctcctacccaagacgccaccctcggtcgggggacaccgacggccggcccgtgggccgtcgccgtcggtacgaacggacttaccttccaactacgtagttacgtcgtggacggcgggacgtgggcgaaagggtcgacgaagtacgnnnnnnnnnnnnnnnnnnnn

SEQ ID NO: 50919 - DNA, 754 bp, Homo sapiens
  misc_feature: GYAE6OF01B4L29.24.62.F07.1.454.CMB.1.raw
tcagactactatgtcacgaccggtgctcgatttagtagtcgcataaaagggaaagggtctgtgaaggcttcaccagtcctggacctcctgtgcaagaacatgaaacatctgtggttcttcctcctcctggtggcagctcccagatggggtcctgtcccaggttcaacttcaggagtcggcccaggactggtgaagccttcacagaccctgtccctcacttgcactgtctctggtgctccatcaatagtggtacttatagttggagctggatccggaacgcccgccggggaagggactggagtggattggaccatactctacgccgaagtgggaacaaccgaggtaacccaacccctccctaccgagtacggtcgacgtccacctatttccacgtcgggaacccgtaccaaaacgaaccctaagtttccgtaccccgttagacgttactagtaaactttccgtaggttacgaccccggtccgacgtaacgaccgaccgggtccctaacgtttaacgttacgtcggttacggaccggtaagaacgggtacgggacgacgtaacggggtcgggaccccggtaactaaaccggttaacggtttcccgttttaacgtaacgtttaaacgtttaggttacggggttaaacgttaccgggggtaacccggttcccgggttagggggggaacccccggaaaggggggtacccccgtaacggggttaccccgtaaccccgggttcccttaccccgtacccggg

SEQ ID NO: 50920 - DNA, 799 bp, Homo sapiens
  misc_feature: GYAE6OF01CGN29.24.62.F07.1.454.CMB.1.raw
  modified_base (740)..(740): a, c, t, g, unknown or other
  misc_feature (740)..(740): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagcctcccagatgggtcctgtcccaggttcaacttcaggagtcgggcccaggactggtgaacgccttcacacgaccctgtccctcacttgacactgtctcgtggtcgctccatcaagtgtcggttactttacgtatttgggaacgcgttagggacgttacccgggaaacggccccgggtaccgggggtaaacggggaccgttaggggacgttagggaacgttttcgggaccctaagttacctaccgttaaccggacccaaaagggttcggggaaaccgaaacccgtaacgggtaaacccctaaacccccccttcccgtacccgaaggtaccggtaccgacgttacccaaccgtttacttttccgaacccgtccgggtaaacccccgttcccgaaaaacggtaacccctaaagttttcccggtacccccttagggtaaccgttccgttaaggtaaccttttctacgggtttccgacccccggtaccgcgaaacgacccgaccgggtaccctaattttaccgtacgtggtacgtggaagagtacgggctcggacgtcggaacccgtactaaggttacgttccgtttacaagttattagttcggttaacncgggacctccgggcggggaccgtacgggaccctacggtcccgacccgttctccccgtgg

SEQ ID NO: 50921 - DNA, 659 bp, Homo sapiens
  misc_feature: GYAE6OF01C6HGF.24.62.F07.1.454.CMB.1.raw
  modified_base (262)..(262): a, c, t, g, unknown or other
  misc_feature (262)..(262): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctcatcaatagtgtacttactattgganctggatccggaagcccgaccgggaaggctggacgtggattggccatatcacgccaagtcgggagaaccaggtaaccaacccctcctccgagacgtcgacgtcaacctatttcgactcggaccctccaaagtaaccaattgtacccctagacgtcttggaaatttcgtagtcgacccgtccggacaacggaaccctacgggacccttaactttaagttacctggtcgacgaagaggacggccgtacagggttcggcccgtaactaacgttaacggttccgtttaactaacttaacgtttagttacgggttaactcggggtaaaccgtccggttacggggggaaccccgagggggtaaccccctaacgggtcccgtaacccggttcgtccccgtaaccg

SEQ ID NO: 50922 - DNA, 689 bp, Homo sapiens
  misc_feature: GYAE6OF01AK7ZD.24.62.F07.1.454.CMB.1.raw
  modified_base (216)..(216): a, c, t, g, unknown or other
  misc_feature (216)..(216): n is a, c, g, or t
  modified_base (334)..(334): a, c, t, g, unknown or other
  misc_feature (334)..(334): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtcccctnacttgcactgtctctggtgctccatcaatgtggtacttactagttggagctggatccggaagcccggccggggaaggactgggagtggattcgggccatactctacgccaagtggganaaccgaggtaccaaccccctcctacaggacgtcgagtccaaccgtatttacacgttcggaacccgtaccaaacgtaaccctaagtttccgtcccctaggtacgttcctagtaactttccgtggtaccgaccccggccgacgacggaccaccgggccttaactttacgtacttggtacgaccggtaggaacggtggaccggtacgtacggtccgggccgaacctaacggttaacgttccgtttactaacgtttagtttacgtaggttacggtacgggtaaccggtcccggtacgggggacccggtaacggggtaccccgtacgggttaccccacccggtttccgtcccggttaccg

SEQ ID NO: 50923 - DNA, 637 bp, Homo sapiens
  misc_feature: GYAE6OF01CFZ6S.24.62.F07.1.454.CMB.1.raw
  modified_base (263)..(263): a, c, t, g, unknown or other
  misc_feature (263)..(263): n is a, c, g, or t
  modified_base (326)..(326): a, c, t, g, unknown or other
  misc_feature (326)..(326): n is a, c, g, or t
  modified_base (364)..(364): a, c, t, g, unknown or other
  misc_feature (364)..(364): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctccagatgggtcctgtcccaggttcaacttcaggagtcgggcccaggactggtgaagccttcacagaccctgtccctcacttgctactgtctctggtgctccatcaatgtgtacttactagttgganctggatccggaagcccggacgggaaggctggagtggattggcctatatctacgcaagtggganaaccaggtaccaacccctctacagacgtcgagtcactnttcactcggaccctcaaagacctagttcgaccctgacgtctagaatttcgtagtcgacccgcgacgaacgtaccaccggtacctaacttttaacgttaccgtggtacgacggaagtacggacggccgacgaggtcgggacccacgtaaaccgtttaggttccgtttaactacgttactttggacggttaactaggggaccctccgggttaacggggggacccctaacggggtaccccacgggttaccctaacccggttgtacccccggtaccg

SEQ ID NO: 50924 - DNA, 683 bp, Homo sapiens
  misc_feature: GYAE6OF01C0YQN.24.62.F07.1.454.CMB.1.raw
  modified_base (320)..(320): a, c, t, g, unknown or other
  misc_feature (320)..(320): n is a, c, g, or t
  modified_base (529)..(529): a, c, t, g, unknown or other
  misc_feature (529)..(529): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctccagatgggtcctgtcccaggttcaacttcaggagtcgggcccaggactggtgaagccttcacacgaccctgtccctcacttgcactgtctctgggtcgctccatcaagtagtggtacttactattggagctggatccggaagcccggacggggaagggactgggagtggattggaccaatanctacgccaagtgggaacgaaccaggtacctaaaccccctcctaccgaagtacgtacggagtaccaactatttccgacgtcgggtaaccccgtaccaaaacgaaaccctaaatttccggtaccctaggacgttcgtagtaaactttccgtggtacgaaccccggcccgacaacgaaccgtaccgggacccttaaactttaactttaccgnggtacgaggaacggaaggacgggccaccgaggttcggaccccgtaataaacgttagttccgtttacctaactatttaaggtacggtagtcgggaccgtccggtacgggggacccgaaggggacccctacgggttacaccccggttgtccctacg

SEQ ID NO: 50925 - DNA, 753 bp, Homo sapiens
  misc_feature: GYAE6OF01AI32F.24.62.F07.1.454.CMB.1.raw
  modified_base (214)..(214): a, c, t, g, unknown or other
  misc_feature (214)..(214): n is a, c, g, or t
  modified_base (261)..(261): a, c, t, g, unknown or other
  misc_feature (261)..(261): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctccagatgggtcctgtcccaggttcaacttcaggagtcgggcccaggactggtgaagccttcacagaccctgtccctnacttgcactgtctcgtggtgctccatcaatgtgtacttatattgganctggactccggaagcccggacggggaaggtctgggagtggtattcgggccaattctccgtaacggcctaaaggttcggggaactaaaccgtagggtaacccctaacccccgttcctaccgaaggtacgtccgaaggtcccaaccgttagttttaccaccgttacgggaaccccgttaccgtaaaacggtaaacccctaagtttcccgtaccccgttaggtaaccgttccgtaagtaactttccggtaggttaccggaccccggtccgtacgtaaaccggtacccgaaccgggtacccttaaacgttttacgttaccgttacggtcggaaccgtaacgggtaacggtcgggaccgtacggtacgggttacgggacccgtaactaaccggtttacgttccgtttaactacttaacgttgtacgggttactcggggaccttccgggtcggggacccgtagggtacccctacggtcctacccgttgtcccgtacgg

SEQ ID NO: 50926 - DNA, 479 bp, Homo sapiens
  misc_feature: GYAE6OF01DVWMD.24.62.F07.1.454.CMB.1.raw
  modified_base (464)..(479): a, c, t, g, unknown or other
  misc_feature (464)..(479): n is a, c, g, or t
tcagactactatgtcacgaccggtgctcgatttagtagtcgcataaagggaaagggactggagtggattggccatatctacgccaatgggagaaccaggtacaacccctccctccagagtcgagtcaccatttcactggacccgtccaagaaccaattgtccctgagtctgaattctgtgaccgccgcagacacggccacttattactgtgcgagagaggcgcagtggccgcaactaagtcgtttctactattatggtatggacgccgtggggccgagggaccacggtcaccgtctcctcacgcctccaccaacgggccccagtccggtccttcccccgtggccaccctcctccaagacgccacctcgtcggggcacgacgccggcccgtgggctcgccgtcggtcaacgggtactactccactatagtagtctgacggcgggcgtggcgaaggcgacagtagnnnnnnnnnnnnnnnn

SEQ ID NO: 50927 - DNA, 643 bp, Homo sapiens
  misc_feature: GYAE6OF01ATJIG.24.62.F07.1.454.CMB.1.raw
  modified_base (263)..(263): a, c, t, g, unknown or other
  misc_feature (263)..(263): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaacgccttcacagaccctgtccctcacttgcactgtctctggtgctccatcaatgtgtacttactattgganctggactccggaagcccggacgggaaggctgggagtggattcggccatcgtctacggcaagtgggacaccgaggtaccacccctcctcgagacgtcgacgtcaacctatttcacgtcggaccctacaaacgtaacctaagttccgtacccttaagtctagtaacttcgtagtacgacccgtccgacgaacgacccacgggccctaacgtttactacgtcggtacgcgtaagaggcggcgacgacggtcgcccgagttaaacgttacgttcctttacgtactagtttacggtaggttacgtacgggtaccgtccgggtcggggacccggacgggtaccccgtacgggttccctaacccggttccttcccgtccgtacccgg

SEQ ID NO: 50928 - DNA, 815 bp, Homo sapiens
  misc_feature: GYAE6OF01D868Y.24.62.F07.1.454.CMB.1.raw
tcagactactatgtcacgaccggtgctcgattttagtagtcgcataaaagggaaagggtctgtgaaggcttcaccagtcctggacctcctgtgcaagaacatgaaacatctgtgttcttcctcctcctggtgcagcctccagatgggtcctgtcccaggttacaacttcgaggagtccgggcccaggactggtagaacgtcccttcacacgaccctgtacccctcaccttgacctactcggttctcttagggtcgcctaccattacaagttaggttcggttaaccttacgtagtttggaatcgtaggactaccggaagtcccggacggggaaaggtctagggtacggtacggtacttacgggacctaatttacgtaccgttaaccgaccgtaaaggttacggggaaactaaacccggtacggttaaacccctaaccccctccgttacaacggtacgtaccgacgtaccaacgttacttcgaccgttcgggaacccctactaacgaacctagtttccgaccgtagtacgttactaacgtactttcgcggtactccccggacgtacgaacggccgtaacccggtcctaaacttttaacgtaccgttggcggaacgtaagggtaacgacgggtacgtacgtaagggttacccgacccgttaaacgttaaaccgtaacggttttcccgtttacttaaaaccgtttagttaccgggttagggttaacccggtaggggaacccgtccgggggttacgggggaacccggtaacgggtacccggtttaacgggaccctaaccgggtttccctaccccgtacgg

SEQ ID NO: 50929 - DNA, 455 bp, Homo sapiens
  misc_feature: GYAE6OF01A3QSU.24.62.F07.1.454.CMB.1.raw
  modified_base (232)..(232): a, c, t, g, unknown or other
  misc_feature (232)..(232): n is a, c, g, or t
  modified_base (428)..(428): a, c, t, g, unknown or other
  misc_feature (428)..(428): n is a, c, g, or t
  modified_base (444)..(455): a, c, t, g, unknown or other
  misc_feature (444)..(455): n is a, c, g, or t
tcagactactatgtcacgaccggtgctcgatttagtagtcgcataaagggaaagggactggagtggattggccatatctacgccaatgggagaaccaggtacaacccctccctccagagtcgagtcaccatttcactggacccgtccaagaaccaattgtccctgagtctgaattctgtgaccgccgcagacacggccacttattactgtgcgagagaggcgcagtggccgnaactaagtcgtttctactattatggtatggacgcctggggccgagggaccacggtcaccgtctcctcagcctccaccaagggcccactcggtcttcccccctggccaccctccgtccaagagcacctctgggggcacgagcggccctgggctgccctggtcaagggactacgttccacatagtagtctgagcgggntggcaaggcgcatagnnnnnnnnnnnn

SEQ ID NO: 50930 - DNA, 639 bp, Homo sapiens
  misc_feature: GYAE6OF01EVNXG.24.62.F07.1.454.CMB.1.raw
  modified_base (264)..(264): a, c, t, g, unknown or other
  misc_feature (264)..(264): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatagtggtacttactattgganctggatccggaagcccgcgggaaggactggagtggattggccatatctacgccaagtgggacgaaccaggtaccaaccccctcctccagagtcgagtcaacctattccacgtcggacccgtacaaacgaacctaattcgtccctaggtactctgtaacttctcgtacgacccgccgacgaacgaccgacgggtccctaacgtttactttacgtgtacgacggagaggacggcgaccgtagggtcggaccgactaaacgttagttccgtttacgtaactttattagtttacgttagtacgggtaccgtccggtcgggggacccgtaacgggggacccctaccggggttacccaccccggttccctcccggtacccg

SEQ ID NO: 50931 - DNA, 443 bp, Homo sapiens
  misc_feature: GYAE6OF01DW1MY.24.62.F07.1.454.CMB.1.raw
  modified_base (436)..(443): a, c, t, g, unknown or other
  misc_feature (436)..(443): n is a, c, g, or t
tcagactactatgtcacgaccggtgctcgatttagtagtcgcataaagggaaagggactggagtggattggccatatctacgccaatgggagaaccaggtacaacccctccctccagagtcgagtcaccatttcactggacccgtccaagaaccaattgtccctgagtctgaattctgtgaccgccgcagacacggccacttattactgtgcgagagaggcgcagtggccgcaactaagtcgtttctactattatggtatggacgcctggggccgagggaccacggtcaccgtctcctcagcctccaccaagggcccatcggtcttccccctggccaccctcctccaagagcacctctggggcacagcggccctgggctgcctggtcaaggactactccacatagtagtctgagcgggctgggcaaggcgcatagnnnnnnnn

SEQ ID NO: 50932 - DNA, 769 bp, Homo sapiens
  misc_feature: GYAE6OF01DKZ2F.24.62.F07.1.454.CMB.1.raw
  modified_base (217)..(217): a, c, t, g, unknown or other
  misc_feature (217)..(217): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacacgacccctgtccctnacttgcactgtctctggtgctcatcaatgtgtacttactagttggatcgtggacgtaccggaacgcccggacgggaaggctgggagtggattggccatactctacgcaagtgggacaaccgacggtacccaacccccgtcctaccgaagtacgtcgaacgtacctaacctagttttaccgaccgttaccgggaaccccgttaaccaaaacgtaaaacccttaagtttccggttaccccgtaggtaaccgttcgttaacggttaactttccgtcggttaccggaccccggtacccgacgaaccggtaaccgacccgggtacccttaaacgtttaacgttaaccgtggttacggacgtaaggaacggtacggaccgacggtacggtacgggaccctacgtaaaccgttacggttccgttttacctaacgttaacgtttaggttacgggttactacggggtaacccgttcccgggttaacgggggaccccgggtaaacgggtacccccggtaaccggttaacccggtacccccggttccgtacccgttaccccgg

SEQ ID NO: 50933 - DNA, 754 bp, Homo sapiens
  misc_feature: GYAE6OF01DBUSC.24.62.F07.1.454.CMB.1.raw
  modified_base (310)..(310): a, c, t, g, unknown or other
  misc_feature (310)..(310): n is a, c, g, or t
tcagactactatgtcacgaccggtgctcgatttagtagtcgcataaagggaaagggtctgtgaaggcttcaccagtcctggacctcctgtgcaagaacatgaaacatctgtggttctttcctcctcctggtggcagctcccagatgggtcctgtcccaggttcaacttcagggagtcgggcccaggactggtgaagccttcacacgaccctcgtccctcacttgctactgtctcgtggtcgctaccatacaatagtggtacttacgtagttggagtcgtggacgtccggaacgcccggacggggaagcgnggatggacgtggacctagtctacgtaccgactaaggtgggaacgaacccgaggtaaccaaccccctccaccgagacgtcgagacacctattcgacgtccggtacccgtaacaaacgtaactaacgttcgtacccgtaggcgttacgtacgttaacgttccgtaggttaccgaccccggtaccgacgaaccggaccgtaacccgggtaaccttaaccgttttaacgttaacccggttggtttacgggtaaggaacgggtacggacggggttccgacggtacgggtacccgtaaccgtacccggtaaaagttacccggttttccgttttaaacgttaacgttaaacgtttggttaacgggtaggtaccgggaccggtcccggttacggggggaccgtaacggggacccgtacgggttaccctaacccggtccgttcccgtacccgg

SEQ ID NO: 50934 - DNA, 919 bp, Homo sapiens
  misc_feature: GYAE6OF01ED4YA.24.62.F07.1.454.CMB.1.raw
tcagactactatgtcacgaccggtgctcgatttagtagtcgcataaaagggaaagggtctgtgaaggcttcaccagtcctggacctcctgtgcaagaacatgaaacatctgtggttcttcctcctccgtggtggcagcctcccagatcgggtcctgtcccaggttcaacttcgaggacgtcgggcccaggactggtagaacgtccttacacgacgtaccctcgtccctcaccttgacctactcgttctcgtggtcgtcctaccaatctaaagttaggttacggttaaccttaacttagttggaacgtcgttacgggaactacccgggaaacggccccgggaacgggggaacgggtaccgtagggtacggttggggtaacgttcgggacctagttaacgttccgtaaccggtaccgaaagggtcggggtaaaacgaaaccccggtaacggttaaacccccgtaaaccccccccttcccgtaaccgaacgggtaaccggttaccggtaaaccgtaacccgaaccctttaaccgtttacccgaaacccggtttacccgggtaaaccccggttaaccccgaaaaaacggtaaaccccttaaagttttcccggtaaccccgttagggtaacgttaccgttaacggtaaactttccgtacgggtaccgaaccccgtccgtacgaaccgacccggtacggtacccttaaacgtttactttaccgtcgggtaacggtacggaacggaacggtccgggaccaccggtagggttacccgggacctaacgtaaaccgtttaagggttccctttaaccttacgttaattacggttagggtaccgttacggggaccggtacccggggaccggggaaccgtaccggggtaaccccttacgggtaccccttacccggttcgtccccgtaacccg

SEQ ID NO: 50935 - DNA, 725 bp, Homo sapiens
  misc_feature: GYAE6OF01A27LN.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacacgaccctgtcccctcacttgccactgtctctggtgctccatcaatagtggtacttactagttggagcgtggactaccgggaacgcccggccggggaagggacgtgggaggtggtacgttggcctatactccgtaaccggccaaggttgggaacgaacccgtacgggtaaccccaaccccccttcccctaccgaagaccggttacggacgtaccaacctatttccgaaccgttaccggtaaccccgtaccaaacgtaaaccctaagtttccgtaccctggtactcgttagtaactttcgtcggtacgacccgccgactaacgaccaccgggtacctacgtttacgtacgttggtcgtaccggaggtacggacgggccgacggtaggtccgggaccgtacgtaaaccgttacggttccgtttccgtaactttagttaacgttacgggtacgttcgggaccggtccgggtacggggacccggtagggaccccgtacgggtacccacccggttccgtcccgtacccg

SEQ ID NO: 50936 - DNA, 781 bp, Homo sapiens
  misc_feature: GYAE6OF01DXP3V.24.62.F07.1.454.CMB.1.raw
  modified_base (626)..(626): a, c, t, g, unknown or other
  misc_feature (626)..(626): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtgcagctccagatgggtcctgtcccaggttcaacttcaggagtcgggcccaggactggtagaagtccttcacagaccctgtccctcacttgcactgtctcgtggtgctccgatcaagtgtgtacttactagttcggagtccgtaggtactacccgggtaagccccgggaccgggggtaacgggacttcggggaaggtggtaacgtttcgggacctaagttaccgtacgtaccgacctaaggtcggggaacgtaacccgtaagggttaaccccaaacccccgtcctaaccgaggtaccgtcgtaacgtccgtaaccctatttaccgaccgttaccgggtaacccctaccgaaaacggtaaacccttaaacgtttccggtaccccttagggacgtttaccgtagtaaactttccggtagtccggtaacccgccgaccgtaagaccgtaccggtactaaccgttttaacttcgtaggcgaacgaggtacggaacggtccncggtaacgggtccggacccgtacgttaaacgtacggttttacctttaccgtaatttacgttaggttaacggtcggtacggtacccggtacgggtccgggggaaccgtaaccgggtaccctacggggttccctacccggttccttaccggtacccg

SEQ ID NO: 50937 - DNA, 918 bp, Homo sapiens
  misc_feature: GYAE6OF01B8OKD.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacacgaccctgtccctcacttgcactgtctcgtggtgctccatcaatagtggtacttactattggagcttgggactccgggaacgccccggaccgggggaaagggactggggaggttgggagtttcgggaccattacgtccgttaaccgccgtaaaggtcggggaacgaacccgaacgggtaaccctaaccccccttccccgtacccgaaggacgttacggacgtaccaaccctagttttaccaaccgttaccgggaaaccccgttccgaaaacgtaaaccccgtaatttaccggtacccccgttaggtaacgttccgttaagtaaacgtttttcccgtaggttacccggtacccccggaccccggaccgtaaacgggaaccccggtaacccggggtaccccttaaccgttttaaccgtttaaccgttccgggttcggtaacccggggttaagaaacggggtacggggtaccccggtaacgggtaccggggttaccggggaaccccggtacccgttaaaaaccggtttaaccgggtttccggtttttaaacccttaaccgtttttaaaggtttaaacgggttttacggggttaaacggtttccgggggaaacccgggttcccggggttacgggggggacccccgggaaaccgggggtaacccccgttaccggggtttacccccggtaaccccgtttccgtccccccgggtttaacccgg

SEQ ID NO: 50938 - DNA, 766 bp, Homo sapiens
  misc_feature: GYAE6OF01BV1FP.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctccgtggtggcagcctcccagagtcgggtcctcgtcccgtaggttctaacttcgaggacggtccgggcccgaggacgtggtgaacgtccttcacacgtaccctcgtccctctacttgctactgtctcgtggtcgcctcatcaagtgttcggttacttacttagttggagtcgtggtacgtaccggaacggtcccggaccggggaacggtacggtaggaggtaggtagttcggacctatacgtaccgtacgaccgtaagtagggaacgaaccgaccggtaacccctaaccccctcccgtaccgagtacgtacgtacgtacctacgttacttccgtacgtaccggtaccccgtaccgtaaacgtaaccctaacgttccgtacccgtaggtacgtacgtacgtaacttacgtacgtacgacccgtaccgacgaccgaccgtaccgtacccgttaacttaacgttacgttaggttcgtaggtacgacggacggacggacgtacggtacggaccgtacgtaacgttacgttacgttacgttacgttacttagggggggggggggggttacgtacggtacggtacggtccgggtacgggtaccgggaccgggtaccggtaccggtaccgtcccgttcccgtccgtaccg

SEQ ID NO: 50939 - DNA, 615 bp, Homo sapiens
  misc_feature: GYAE6OF01DV591.24.62.F07.1.454.CMB.1.raw
  modified_base (262)..(262): a, c, t, g, unknown or other
  misc_feature (262)..(262): n is a, c, g, or t
  modified_base (325)..(325): a, c, t, g, unknown or other
  misc_feature (325)..(325): n is a, c, g, or t
  modified_base (453)..(453): a, c, t, g, unknown or other
  misc_feature (453)..(453): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatgtgtacttactattgganctggatccggaagcccggacgggaaggactggagtggattggccatatctacgcaagtggganaaccgaggtacaacccctcctcagacgtcgagtcacctattcactcggaccctacaaagaacctaagttcgccctaggtactactagaatttctgtcgaccgcgacagaccacggcctacttattacngtagcgaagagacggacgcaggtcggacccgactaaacgttacgttccgtttaccgtaacttaagtttaagtcgggttaacgttacggggaccgtcccggttcggggggacccgtaacggggaccctaaccggggtccaacccggttccgtaccccgtaccg

SEQ ID NO: 50940 - DNA, 591 bp, Homo sapiens
  misc_feature: GYAE6OF01BYLCY.24.62.F07.1.454.CMB.1.raw
  modified_base (528)..(528): a, c, t, g, unknown or other
  misc_feature (528)..(528): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatgtggtacttactattggagctggatccggaagcccggacgggaaggactggagtggattggccatatctacgccaagtgggaacaaccaggtaccaaccccctcctcagacgtcgagtcacctatttcacgtcggacccgtcaaacgaaccctaagttcgccctgacgtctagtaattcgtgtcgacccgcgacagacccgacggcctacttacttacgtgtcgacgagagaggcgacgagtcggccgtacaacgttacgttccgtttacattattagtaggtntagggaccgccggtaggggcccgacgggtaccctacgggtacctacccgttcgtcccgtaccg

SEQ ID NO: 50941 - DNA, 741 bp, Homo sapiens
  misc_feature: GYAE6OF01CUOI7.24.62.F07.1.454.CMB.1.raw
  modified_base (143)..(143): a, c, t, g, unknown or other
  misc_feature (143)..(143): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagntgggtcctgtcccaggttcaacttcaggagtcgggcccaggactgggtagaacgcccttcaccgacgacccccttgtcccctcacttgccacgtgtcctcgtggtacgcctccatcaaagttggtgttacttactagttggacgtagttggacgtacccgggaacggccccgggaccggggaagggacctagggacggtggtaacgttcggacctatactccgtacgaccgtaagtgggaacgaaccgtaacggtaaccccaaccccccttcccgtaccgaacggtacgtccgtacgtaccctaacgttactttccgaaccggtccggaacccccgttaacgaaaaccgtaaccttaagtttcccgtacccgtagtacgtacgtacgtacgtttcgtcggtacgacccgtccgacacggacaccggtactacttacgtacgtgtacgcgtaagcggacggtccgcttacggcggtaccaacttaacgttaccgtttcggttacctaacgtatttaagtacgggttacgtacggaccgggtccgtccgggggacgacgggtaacccgtaacggccctaacccggttcctccggtacccg

SEQ ID NO: 50942 - DNA, 940 bp, Homo sapiens
  misc_feature: GYAE6OF01BUGPQ.24.62.F07.1.454.CMB.1.raw
  modified_base (92)..(92): a, c, t, g, unknown or other
  misc_feature (92)..(92): n is a, c, g, or t
  modified_base (189)..(189): a, c, t, g, unknown or other
  misc_feature (189)..(189): n is a, c, g, or t
tcagactactatgtcacgaccggtgctcgatttagtagtcgcataaagggaagggactgggagtggattggccatatctacgccaatggganaaccagtacaacccctccgtccagagtcgagtccaccatttcactggacccgtccaagaaccaattgtccctgagtctgaattcgtgtgaccgccgnacgacacggcctatttattacgtgtcgcgagaggtaggccgactaggtcgggcccacgtaaaccgttaacgtttcccggtttacctaacgttaagttttagtggggttaacttacggggaaccgttccggttacgggggtacccggtaacggggtacccgtaccggggttaccctaacccggtttcccttacccgtaccgaaccgtacccccgttaccccgaaaccccggtaaaccggggtacccccgtaacggtttcccgggtttaccccgtttacccccccggttacggggtaccccctaacccccggtttccccgttaacccggtaaaaccgggtaaccggtaccccgttaaccccggtttccgggttaccggggggaccctaacccgggtaaccgggtccccggggtaacccccgggttcgggggtcccgttcgggtaccccggtttaacggggttaacccggtaaacccggggttaaccctttaacccgtttaaccccgtaaccgttaaacgttaacgggtttaccggtttaacccgtacgggtaacccggggtccggggttaccgggtaacggggtaacccggtaaacggggtaccctaacccggttaaagttaacggtcgtacgcgtcagtctaggcgtacgtagtactagtacgtacgtgtcgtacggtacgtcgtagcggtacgtagtccgtagtcgacgtccggtcgtaccgaccgtccgtacgactccgtccgtccgtcg

SEQ ID NO: 50943 - DNA, 711 bp, Homo sapiens
  misc_feature: GYAE6OF01BKY2X.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctcgtggtgctcatcaatagtgtacttactattggagctggactccggaagcccggacggggaagggactgggacgtggattcggcctaagtactcgtacgaccaagtcgggaacaaaccgacggtaaccaaccccctcctacacgacgtacgacgtcacctactttcacgtcggaccctacaaacgaacctaattcgtccctgacgtctagtacttcgtacgtcgacccggccgacaacgaacccgaccgggtacccttaacgtttaaccgtttacgtcgtacgaccggaaggtaggacggtcgaccgtagggtaccggccgaacttaaccggttaacgttccgttttaactaacgtttagttaaacggttcgggttaacgtaccggggtaaccggtccccgggttaggggggaaccccgggaaaccggggttaccccgtaacgggggttacccctaccccggggttacccttccccggtaccg

SEQ ID NO: 50944 - DNA, 701 bp, Homo sapiens
  misc_feature: GYAE6OF01BX9RM.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctctggtggcagctcccagatgggtcctgtcccaggttcaacttcaggagtcgggcccaggactggtagaagcccttcacacgaccctgtccctcacttgcactgtctcgtggtgctccgatcaagtgtgttacttactattggactcgtggactccggaaagtccccggacggggtaaggacttgggaagttcgggatttacgggcctaagttaccgtccgtaaaccggcctaaaggttcggggaacaaaccccgtaggtaaccccaacccctccgtacaacgaacgtcgaagttccaacgtactttcaacgtcggaaccctacaaacgtaaccaatttcgaccgtgtagtactacgtaacttcgtacgtcgtacccgcgacacgtaccgaacgtaccctaacgtttacttaccgtaggtagtacccggaagacggacggtccggaacgtaggcgtaccgacgtaaacgtcgttaccgttactaagttacgtttaagtacggttagtacggtccggtaccgtcgggggtaccgaaccgggtacccacgggttacccaacccggttcctacccgtaccg

SEQ ID NO: 50945 - DNA, 763 bp, Homo sapiens
  misc_feature: GYAE6OF01AZOFF.24.62.F07.1.454.CMB.1.raw
  modified_base (754)..(754): a, c, t, g, unknown or other
  misc_feature (754)..(754): n is a, c, g, or t
tcagactactatgtcacgaccggtgctcgatttagtagtcgcataaagggaaagggtctgtgaaggcttcaccagtcctggacctcctgtgcaagaacatgaaacatctgtgttcttcctctcctggtgcagctcccagatgggtcctgtcccaggttcaacttcgaggagtccgggcccaggactggtgaagcccttcaccacgaccctgtcccctcacttgctactgtcctcgtggtcgctccatcaagtgtgtacttatagttgagcgtggctaccggaacgtccccggacggggaaggacgtaggaggtaggtagttcggcctagttacgtaccgtacgaccgtaaaggtggggaaacgtaacccgtacggtaaccccctaaccccccttcccgtaccggaacgtaacggtccgtaacgttaccctaacccgttaccgtttaccgaccggtaccggtaacccccgtaacgaaaccgtaaacccgttaacgtttccgtcccgttacgtacggtttacctaaggtaacctttcgtacggtaccggaccccgtaccgacgaacgtaacccgaccgtccttaaacgtttcgtaactcggtgaccgaaggtacgggaccgcgtacgtaggggtaccccgaccgttaacgaaacggtttacgtttccgtttaacgtaacctttagtaacgttggtaacgtgggaacccgttccgggtagggacccgtaacgggacccgtacgttccacccggttcnccgtaaccg

SEQ ID NO: 50946 - DNA, 777 bp, Homo sapiens
  misc_feature: GYAE6OF01B9S5K.24.62.F07.1.454.CMB.1.raw
  modified_base (347)..(347): a, c, t, g, unknown or other
  misc_feature (347)..(347): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctcatcaatgtgtacttactattggagctggactccggaagcccggcgggaaggactggagtggattggccatatctacgccaagtgggacaaccaggtaccaaccccgtccncagacgtacgagtcacctatttccgactcggaacccctacgaaacgtaaccctaagtttcgtaccccgtagtaacgttccgttagtaaacgttttcctaggttacccggaccccggtcccgacgtaaacggaacccgtaccccgggaccctttaaacgttttacgtttaaccccttgggttaaccgggcccggtaaagggagggtaccgggtaccgggtacccttaagggggtccgggtaccccgaaccgttaaaaccggtttaaccggttttccgggttttaaccttaaccgtttaaacgttttaacgggtttacggggtaaacttaccggggtaccccggtaccgggttacgggggggtaccccgaaacggggggttacccccaccggggtttacccaaccccgggttttcccgtacccgttacccgg

SEQ ID NO: 50947 - DNA, 669 bp, Homo sapiens
  misc_feature: GYAE6OF01DAMVU.24.62.F07.1.454.CMB.1.raw
  modified_base (217)..(217): a, c, t, g, unknown or other
  misc_feature (217)..(217): n is a, c, g, or t
  modified_base (244)..(244): a, c, t, g, unknown or other
  misc_feature (244)..(244): n is a, c, g, or t
  modified_base (313)..(313): a, c, t, g, unknown or other
  misc_feature (313)..(313): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacacgaccctgtcccctntacttgctactgtctcgtggtgctccntacaatagtgtacttactattggagtctggactccggaagccccggacggggaagggctagggagtggngttaggaccattactacgtacgacctagtcgggaacgaaccgacggtacccaacccctcccgtacgaagtacgacgtacgtacctacctactttccacgtaaccggtaccccgtaaccaaacgtaaaccctaagtttccgtacccgtaggtacgttcgtagtaacttcgtgtaccgtacccgcggtaccacggtaaccgaccggtaccttaacgtttacttaaccgtggtaccggtagtacggaggtaggccgacgtaacgggtccggacgtactaacgttacgttcgttctaatgttagtgtcgtgacggtcgtacggggccgaacgggtacaccggttacgcctctcccgtacg

SEQ ID NO: 50948 - DNA, 773 bp, Homo sapiens
  misc_feature: GYAE6OF01AO0X3.24.62.F07.1.454.CMB.1.raw
tcagactactatgtcacgaccggtgctcgatttagtagtcgcataaagggaaagggtctgtgaaggcttcaccagtccctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatgtggtacttactagttggagtcgtggacgtaccgggaacgccccggacggggaagggtacgtggggacggttgggtatttcgggacctagttactccgtaccgaccgaagtggggaacaaacccgtaggtaacccaaccccctcccgtaccaaggacgtaccggacgtaccaaccctatttccgaacgtcggaaccccgtaccaaaacgtaacctaacgtttccgtaccctggtacgtctagtaactttcgtgtacgaccccgcgtcgtaacgaccgaccgggtaccctaactttaagtttacccgtggtaccggtacggaacggtacgggacgggtaccgacggtaagggtccggacccgtactaaaaccggttaggtttcccgttttactaaccgtttaaagtttacgttacggggtttaacgtcggggtaaacccggttcccggggttaccgggggggaacccgtacgggggtaaccccgtaccggggttacccgaaccccggtttcccgtccccggttaaccgg

SEQ ID NO: 50949 - DNA, 688 bp, Homo sapiens
  misc_feature: GYAE6OF01BA2Q2.24.62.F07.1.454.CMB.1.raw
  modified_base (192)..(192): a, c, t, g, unknown or other
  misc_feature (192)..(192): n is a, c, g, or t
  modified_base (272)..(272): a, c, t, g, unknown or other
  misc_feature (272)..(272): n is a, c, g, or t
  modified_base (303)..(303): a, c, t, g, unknown or other
  misc_feature (303)..(303): n is a, c, g, or t
  modified_base (316)..(316): a, c, t, g, unknown or other
  misc_feature (316)..(316): n is a, c, g, or t
  modified_base (334)..(334): a, c, t, g, unknown or other
  misc_feature (334)..(334): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactgggtnaagccttcaacacgaccctggtccctcacgtttgactactgtctctgggtcgctccatcaatgtggtactactattgganctggatccggaagcccgcgggaagctggagnggatggccatacnctacgacaagtcgggaanaaccgagtaccaaacccctcctcgagacgtcgattaccacgtactttcgaacgtcggaacccgtacgaaacgtaaccctaagttccgtacccttagacttctacggtaaattccgtgtacgaccctcggacagtaccaaccgggtccttaacttaacgtttactgggttacgacgtaacggaccggagggtacccggagtaacgggtcccggaccaaacggtaaactttaacggtccgtttttaacaacctttaaggtttactacgggggttaacttccgggggacgtcccggggttacgggaccgggaaaccgggtccccggtaacggtacctaacccggttctacccgtcgg

SEQ ID NO: 50950 - DNA, 640 bp, Homo sapiens
  misc_feature: GYAE6OF01EY9R4.24.62.F07.1.454.CMB.1.raw
  modified_base (192)..(192): a, c, t, g, unknown or other
  misc_feature (192)..(192): n is a, c, g, or t
  modified_base (314)..(314): a, c, t, g, unknown or other
  misc_feature (314)..(314): n is a, c, g, or t
  modified_base (427)..(427): a, c, t, g, unknown or other
  misc_feature (427)..(427): n is a, c, g, or t
tcagactactatgtcacgaccggtgctcgatttagtagtcgcataaaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtnaagccttcacagaccctgtccctcacttgcactgtctctggtgctccatcaatgtggtactactattgagctgatccggaacgcccggacggggaaggctgggagtggattcggcctatacnctacgccaagtcgggacaaccaggtaacccacccctcctccagacgtcgagtcacctatttcacgtcggaccctacaaacgactacttcgacctgacgttactgaactttcgngtacgacccgccgacagacccgacggtcctacgtttataccgtgtacgtacgaggacggacggtcacgtaggtccggacccgacttaaacggttacgtttccgtttaactacgtttacttaaaggtcggttaacgtcggggaccgtcccggggtcgggggaacccggtacggggaccccgtacgggttacccctacggttccctccgtaccgg

SEQ ID NO: 50951 - DNA, 505 bp, Homo sapiens
  misc_feature: GYAE6OF01CKR0L.24.62.F07.1.454.CMB.1.raw
  modified_base (233)..(233): a, c, t, g, unknown or other
  misc_feature (233)..(233): n is a, c, g, or t
  modified_base (474)..(474): a, c, t, g, unknown or other
  misc_feature (474)..(474): n is a, c, g, or t
  modified_base (476)..(505): a, c, t, g, unknown or other
  misc_feature (476)..(505): n is a, c, g, or t
tcagactactatgtcacgaccggtgctcgatttagtagtcgcataaagggaaagggactggagtggattggccatatctacgccaatgggagaaccaggtacaaccccctccctccagagtcgagtcaccatttcactggacccgtccaagaaccaattgtccctgagtctgaattctgtgaccgccgcagacacggccacttattactgtgcgagagaggcgcagtggccgnaactaagtcgtttctactattatggtatggacgccgtggggccgagggaccacggtcaccgtctcctcacgcctccaccacgggcccagtcggtcctcccccgtggccacccgtcctaccagacgccacccgtgtcgggggcacgaggccggcccgtggggcctcggccgtgggcaagggtactaccgtccactatacgtagtcgtgacggcgggcgtggacgaacgggcgacgagtagcngnnnnnnnnnnnnnnnnnnnnnnnnnnnnnn

SEQ ID NO: 50952 - DNA, 755 bp, Homo sapiens
  misc_feature: GYAE6OF01B6511.24.62.F07.1.454.CMB.1.raw
tcagactactatgtcacgaccggtgctcgatttagtagtcgcataaaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctcgtggtgctcatcaatgtgtacttactattggagctggactccgggaacgcccggaccggggaagggtacctgggacgttgggagtttcgggacctaagttacttaccgtaaccggcccgtaaaggtggggaacgtaaacccgacgggtaaccccaacccccgtccctaccgagtacgtcgacgtacaccgtatttcacgtacggaccctacaaagtaaccctaagttcgacccttaggacgttacgtagtaactttcgtggtacggaccccgcgtacaacgacccgacggtacccttaacgtttaacgtacgttcggtaggaccgtaaggacgggcggaccggtacgtaacggggttccgggaaccccgtactaaaaccgggtttaacgtttccggttttaacctaacgtttaacgtttaaggttacggggttactacggggaacccggttccgggtaacggggggtacccgacggggtaaccccgtacccgggttaccctaacccgttccgtacccgtaacccg

SEQ ID NO: 50953 - DNA, 960 bp, Homo sapiens
  misc_feature: GYAE6OF01BV4YD.24.62.F07.1.454.CMB.1.raw
tcagactactatgtcacgaccggtgctcgatttagtagtcgcataaagggaaagggtctgtgaaggcttcaccagtcctggacctcctgtgtaagaacatgaaacatctgtgttcttcctcctccgtggtgcagctcccagatgggtcctcgtcccaggttcaacttcgaggacgtccgggcccaggactggtagaacgtccttcacacgtaccctcgtcccctacacgttgccacttgtccttcgtgggtcgcctccatacaattaggttcgttaactttactagttggacgtcgtaggacgtaccggaacggccccgggacggggtaacgggacgtgggaggtggtacgttcgggacctaagttactaccgtaaccgaccgtaaaggtacggggaaacctaacccggtaacgggttaaaccccctaaccccccgttccccgtaacggtaacggttaaccggttaccggaaccgttacccgaaacccgtttaactttttacccgaaccggtttaccccggggtaaacccccttaaccgtaaaacccgtaaaacccttaaggttttccccggtaccccgtaggttaacggttaccgttaaggtaaccttttccgtacgggtaccggaacccccgggttcccgtaaccggaaaccggtaacccgtaacccgggttaacccctttaaacgtttttaaccgttaccgggttagggtaaccggtacccggttaaaggggaaccgggtaacggggtccgtaaccggttaacggggtcccggggaaccccgttaacgttaaaaacccgttttacgggtttaccccggttttaactaaccgttttaagtttacgggtcgggtttaaacgtcccggggtaaccggtcccgggttaaggggggcccccgtaaacggggtacccgtaccgggttaccctaacccgggttccttccccggagtacccccgg

SEQ ID NO: 50954 - DNA, 764 bp, Homo sapiens
  misc_feature: GYAE6OF01CUP59.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctccagatgggtcctgtcccaggttcaacttcaggagtcgggcccaggactggtgaagccttcacagaccctgtccctcacttgcactgtctctggtggctccatctaacttgtaggtactttactatttggagctggactccggaaggcccgccggggaaggcgtggaggtgtagtcggccgtaatctactaccgaccaaggttcgggaacgaaaccgtacgggtaacccctaaaccccccgtcccctacccgaaggtaccgttccggtaacggttaccaacccgttacttttaccgaaccgttaccgggaacccccgtaacctaaaccggtaaaaccctaaacgtttaccggttcccctaggtaaccgtttccgttaagtaaacctttcgttacggttaccgggaccccgtcccggacgtaacggaacccgtacccgggtacccttacgtttaacgttacgttgtaacggtcgtaagggaacggtcgggaccgcgacggttacggccgtaactaaccgtacgtttccgtttacttacgttattactagggttacgtggtacccggtccgggttacggggcccggacgggtacccgtaacgggccctaaccggtccttcccgtaccgg

SEQ ID NO: 50955 - DNA, 793 bp, Homo sapiens
  misc_feature: GYAE6OF01A8853.24.62.F07.1.454.CMB.1.raw
  modified_base (209)..(209): a, c, t, g, unknown or other
  misc_feature (209)..(209): n is a, c, g, or t
  modified_base (267)..(267): a, c, t, g, unknown or other
  misc_feature (267)..(267): n is a, c, g, or t
tcagactactatgtcacgaccggtgctcgatttagtagtcgcataaaagggaaaggggtctgtgaaggtcttcaccagtcctagggaaccgtcctgtcgcaagaactatgaaacactctgtgttcttcctcctcctggtgcagctccagatgggtcctgtccaggttcaacttcgaggagtccgggccaggactggtgaagccttcacncgaccctgtccctcacttgctactgtctctggtcgctccatcaatgtgtacttacgtnttggagtctggtactccggaacgcccggtacggggaacggtcgtgggagtggacgttcggaccgattacgtcgtacgccaagtcgggaacaaccgtaggtaacccaaccccctcctaccgaggtacgtacgacgtaccgaacctactttccaccgttacggacccccgttacaaacgaaacccttagttcccgttaccctagacggtttcctacggttaactttccgacggttaccggaccccgtaccgacgtaaaccggaccgtacccggtaccctttaaacgtttacgttacgtcggttaaccggtacggaacggtacggtaccgggacggtaccgacggggttacccggaccttaacgtaaaaccgttacggttttccgtttaaccgtaacgttacgttttaacggtcggttaagggtaccggggtaaccccggtcggggttaaacccgggggaccccggaacgggggttaaacccctacgggggttaccccctaacccggttttccggtaccccctaaccgg

SEQ ID NO: 50956 - DNA, 746 bp, Homo sapiens
  misc_feature: GYAE6OF01B19UF.24.62.F07.1.454.CMB.1.raw
  modified_base (627)..(627): a, c, t, g, unknown or other
  misc_feature (627)..(627): n is a, c, g, or t
tcagactactatgtcacgaccggtgctcgatttagtagtcgcataaagggaaagggtcgtgtgaaggcttcaccagtcctggacctcctgtgcaagaacatgaaacatctgtggttcttcctcctcctggtggcagctccagatgggtcctgtcccaggttcaacttcaggacgtcggcccaggactggtgaacgccttcacacgacccctgtccctcacttcgcactgtctcgtaggtcgtctccactctaagtacgtggttaacttacgttagttacggagtccgttagggaccttcccgggaaccggccccgggaccgggggtaaagggtacctggggaacgttggtacgtttcgggcctagttactaccgtaaccggccgtaaaagtcggggaaagaaaccccgtacggtaaccccaacccccgtccgttaaccgaaggtaccgtccggaacgttccgaaccctttagtttccgaaccgttcggaaccccttacgaaaacgtaaccctagttccgtaccctaggtacgttctacgaactttctacggtcgaccccggtcgtacgacgaccgtaccggtacctaacgtacttaacgtgtacgcgaagtagtacggccgtaacgnggtccggactacgtaacgtacgtcgttacctacgtaagttcgtaggttaacgtgggaaccgtccgggtacgggggtacccgagggtacccgtacggtccctaccggttctcccgtaccg

SEQ ID NO: 50957 - DNA, 605 bp, Homo sapiens
  misc_feature: GYAE6OF01BLEDL.24.62.F07.1.454.CMB.1.raw
  modified_base (263)..(263): a, c, t, g, unknown or other
  misc_feature (263)..(263): n is a, c, g, or t
  modified_base (327)..(327): a, c, t, g, unknown or other
  misc_feature (327)..(327): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatagtgtacttactattgganctggatccggaagcccgacggggaagggactgggagtggattggccatatctacgcaatggganaaccaggtaccaacccctcctcagagtcgagtcaccattcactcggaccctcaaagaaccaattcgtccctggactctgtaattctagtcgacccgcgacagaccacggcctactttactacgtgtcgacgagagacggcacgaggttcggcccgactaaacgttaagttccggttttacaactttagttagttgggttacttaggggtaccctcgggttacggggggcccgaacgggggtaccccacgggttacccacccggttcctccccgtaccg

SEQ ID NO: 50958 - DNA, 973 bp, Homo sapiens
  misc_feature: GYAE6OF01BN1IX.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctccagatgggtcctgtcccaggttcaacttcgaggagtcgggcccaggactggtgaagccttcgacacgaccctcgtccctcacttgcactgtctctggtcgctccatacaagtagtagttacttacttagttaggacgtcttaggacgtacccggaaacggtccccggaccgggggaaagggaccgttggggaggttagggaacgtttcgggacctaattacgttaccgtaaccggaccgtaaaggttcggggaaacgaaacccgtaacgggttaacccctaaacccccccgttaccccgttaacccggaacggtaacggttacccggaaacggttacccgtaaaccccgttactttttacccgaaacccggtttaccggggtaaacccccccggttaaccgaaaaacccgggtaaaaccccttaaacggttttacccggttaaccccccggtttaggttaaccgggtttaccgtttaacgggtttaaaccgttttccgttacgggttaacccggtaaaccccccggccccggtaaccgtaaaccgggtaaccccggtaacccgggtaaccctttaaaccgttttaacgttttacccggttacgggttaccggaacccgggttaagggaacgggacgggaccgggtcggtaaacggggttcccggggacccgtaaaccgtaaccggttaaacgtttcccggtttacctttaacgttaaagtttacggttacgggtaacgtttaccggggtacccggttcccgggttccgggggaaccggttaaccggggtacccgtacccggttaccgggtaaccccgttccttcccggtacccgg

SEQ ID NO: 50959 - DNA, 818 bp, Homo sapiens
  misc_feature: GYAE6OF01CS7BM.24.62.F07.1.454.CMB.1.raw
  modified_base (670)..(670): a, c, t, g, unknown or other
  misc_feature (670)..(670): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctctggtggcagctcccagatgggtcctgtcccaggttcaacttcaggagtcgggcccaggactgggtgaagccttcacacgacccctgtcccctcacttgcactgtctcgtggtgctccatcaatgtgtacttactattggagcttggacttccgggaacgccccgggaccgggggtaagggaccgttaggggaggttagggatttcgggaccctaagtacgtccgttaccggaccgtaaaggttcggggaacgtaaacccgtaacgggttaacccctaaccccccgtaccccgtaccgaagggtaccggttaccggaacggtaccctaacccgttaactttttacccggaaccgtttaccggggaaccccccgttaaccgaaaaccggtaaaaccccgttaaacgttttccggttacccccgtaggtaccggttaccgtttaacggtaacttttccggtacggttaccggaacccccgtccggaacctaacgggaccgtaaccgggaccttaaccgtttaacttaccgtggttaggccgtaagggngtacggccgagtacgggtcggaccgtaacgtaacgttacggtaccttttactacgtttaagtttaggtaggttacgtggggtacccgtcggtacgggggacccgtaacggggacccttaccgggtacctacccggttcctcccgtacg

SEQ ID NO: 50960 - DNA, 665 bp, Homo sapiens
  misc_feature: GYAE6OF01DUVDT.24.62.F07.1.454.CMB.1.raw
  modified_base (295)..(295): a, c, t, g, unknown or other
  misc_feature (295)..(295): n is a, c, g, or t
  modified_base (458)..(458): a, c, t, g, unknown or other
  misc_feature (458)..(458): n is a, c, g, or t
  modified_base (655)..(655): a, c, t, g, unknown or other
  misc_feature (655)..(655): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctcatcaatagtggtacttactattggagctggactcggaacgccgccgggaaggactggngtggatggccatactctacgcagtgggacacgaggtaccaacccctcccgtaccagacgtcgacgtcaactactttcgactcggacccgtaccaagaaccgaattcgtaccctagacgttacgtagtaactttctaggtcgaccccgtccgaccaaaggaccnccgggtaccaacgttttactaccgttggtacgccggtaagacgggacggtccgtacgtaacgggttacgggccccggtaactaaaccggtttaagttcccggttttaacttaacgttaaatttggttacggttacgttgggaacccggttccggtacgggggcccgaagggtaccccgacgggttccacccggtttncccgttaccg

SEQ ID NO: 50961 - DNA, 696 bp, Homo sapiens
  misc_feature: GYAE6OF01D31TA.24.62.F07.1.454.CMB.1.raw
  modified_base (661)..(696): a, c, t, g, unknown or other
  misc_feature (661)..(696): n is a, c, g, or t
tcagactactatgtcacgaccggtgctcgatttagtagtcgcataaaagggaagggactggagtggattggccatatctacgccaatgggagaaccaggtaccaaccccctccctccagagtcgagtcacccatttcactcggacccgtccaaagaacccaatttcgtccctgacgtctgtaatttcctgtcgacccgccgacagaccgaccggcctaacttttacttactcggtggacgagaggacggccgcgtaggtcggcccgtaacaaaccttaaggtttccgttttacctaacttagtttagtcggtagtcgggaccgtccggtcgggggccggtaacggggaccgtaccggtccacccggttcctccgtaccaccgtccctacccgaacccggaaccgggcccctacggttcccggttcccctttaccccccggcggtccccctaacccccttcccgtaccgaaaccgtccgacccgtacccgtacgggtccgggggaccaaccgacggtccccggtaccgtcggggtacctcgggtcccgtacggggtaacaaccgggttaaccttccttaccccgaagtaacgttacggttacgtaccgttagggccgggtaccggtcggtacgggacgtaaccgggccacgtacgagtcagnnnnnnnnnnnnnnnnnnnnnnnnnnnnnnnnnnnn

SEQ ID NO: 50962 - DNA, 745 bp, Homo sapiens
  misc_feature: GYAE6OF01B788B.24.62.F07.1.454.CMB.1.raw
  modified_base (577)..(577): a, c, t, g, unknown or other
  misc_feature (577)..(577): n is a, c, g, or t
  modified_base (601)..(601): a, c, t, g, unknown or other
  misc_feature (601)..(601): n is a, c, g, or t
tcagactactatgtcacgaccggtgctcgatttagtagtcgcataaagggaaagggtctgtgaaggcttcaccagtcctggacctcctgtgcaagaacatagaaacatctggtggttccttcctcctcctggtggcagctcccagatgggtcctgcccaggttcaacttcaggagtccggcccaggactgggtgaagcccttacaacacgtaccccttcgtcccctctacttcgcctactgttcttcgtgggtcgcctaccatactaattacggttacggttacttaacgtagttgggagtcgttggacgtccgggaaacgccccggggaacgggggaacggtacgtgggaggtggtaacgttcgggaccttattactccgtaaccgaccgtaaaggtacgggaaacgaaccgtaacggtaaccccaaccccctcccgtacaacggacgtacgacgtaccaacctattacgaccgtcggaacccgtacaaaacgaacctagttccgtccctagtacgttctagtaacttcgttaggcgacccgcgacaacgaccgaccggtactaacttacttacgngtacgtagagtaggcgcggtacgngggtaccgcccgtaactaacgttacggtttccgttacttacttagtttaaccggtggttaacgtcggaacccgggtccggtcgggggtaaccggaccgggcccggttaaccggtaccgttacccgtcggttaacccctaccggg

SEQ ID NO: 50963 - DNA, 753 bp, Homo sapiens
  misc_feature: GYAE6OF01E5PHR.24.62.F07.1.454.CMB.1.raw
  modified_base (200)..(200): a, c, t, g, unknown or other
  misc_feature (200)..(200): n is a, c, g, or t
  modified_base (277)..(277): a, c, t, g, unknown or other
  misc_feature (277)..(277): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagcctccagatgggtcctgtccaggttcaacttcaggacgtcgggcccaggactggtgaacgccttnacacgtaccctcgtccctcacttgccactgtctcgtggtacgcctacatacaatggttagttactttactagttagntcgtaggacgtccggaacgcccggacggggaacgggtctacgggaggtgtacggttcggacgtatactccgtacgaccgtaagtcgggaacgtaacccgacggtaaccccaacccccgttccaccgaggtacgtaccgacgtaccgtaccttactttcccgaaccgtccggtaaccctaccgaaacgaacccttaacgttccgtaccgtactacggttactacgtaattcgtaggtaccgtaccgtacccgtacgaacggtaccgacccggttactaaccgtttacgtaacgttcgtacgaccggaagtacgggacggtacgacggtacgggtaccggaccgtacgtaaacgttaccggttctttaccgttaacgttacttagggtagttaccgtacgggtacccgaccgggtccggggaacccgggtaccgggaccgttacccggtaaccgtccccggttacgtcccgtacccgg

SEQ ID NO: 50964 - DNA, 803 bp, Homo sapiens
  misc_feature: GYAE6OF01AG7GU.24.62.F07.1.454.CMB.1.raw
tcagactactatgtcacgaccggtgctcgatttagtagtcgcataaagggaaagggtctgtgaaggcttcaccagtcctggacctcctgtgcaaagaacatgaaacatctgtggttcttcctcctccgtggtggcagctcccagagtggtcctgtcccaggttcaacttcgaggagtccgggcccaggactggtagaacgtccttcacgacgtacccccttgtcccctacacgttgccactgttctcgtggtcgcctacctatcaattacggttacggttaaccttttaacgtaggttgggacgtacgttacgggacgttaccgggaaaccggcccccggggaccgggggtaaaagggccttaggggacggttgggtacgttcgggaccctaataccgttaccgtaacggaacccgtaaggtggggaaacccgtaaacccggaaccggtaacccctaaacccccccgtttcccgaccgtaaggaccgtttaccggacttaccctaaacccttacgttttccgacccgtaccgggaaccctaacccgaaaagaaaccctttagttacccgcccgttagtaacgttcgtatacgttcgtacggtccgaccggtccactaacggacccgcgtacctatttagagtcgtaggacgacgtaggccgggtacacgggtcgcgtacccgaacttacgtaacgtttccgttaacctagtttagttaccggtagttccgtcgggtaaccgtccgggtaaccgggtcccggaacggttaccccgtgggtaccctaccccgtgttaacccgacg

SEQ ID NO: 50965 - DNA, 912 bp, Homo sapiens
  misc_feature: GYAE6OF01BJP3K.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtgcagctcccagatgggtcctgtcctaggttacaacttcaggagtccgggcccaggactgggtagaacgtcccttacaccacgtaccccttcgtacccctctacgttcgacctacgtcgtcctcgtggtcgtcctcctatacaagtacggttacggttaacttacgttagtcggtacgtcgtagacgtccgggtaacgcccgggtaaccggggaacggtccgtagggaggttagggacgtttagggacctattacgtaccgtaccggtaccgaaggtacgggaacgaacccgtaagtaacccctacccccctcctacgacggtacgtaccgacgtaccctaacgttacttacgaacccgttaccggtaaccccgtaccggaaaactaaaccgtttacgtaccggttacccttagtaaccgtttcgtacgttaacgtttccgtacgggtacccgacccccggtccgaccgaaaccgtaccggtacccgttaaccccttaaacgttttaaccgttaacccggtttgtccgggtaacggtaaaccggggtagggaacccgggtccgaaccgggttacggggtcccgggtaacccgtaaaccgttaaaccggtttaacccggtttaccgtttttaacccgtaaaggtttttaacgtttaaccgggttaggttacccgggttaaccggggtaaccccggttcccggggtaagggggttaacccccgggacgggttaaccccggcccgggttaacccctaccccgggttccgttccccgtaacccccgg

SEQ ID NO: 50966 - DNA, 932 bp, Homo sapiens
  misc_feature: GYAE6OF01BTGUR.24.62.F07.1.454.CMB.1.raw
tcagactactatgtcacgaccggtgctcgatttagtagtcgcataaaagggaaagggtctgtgaaggcttcaccagtcctggacctcctgtgcaagaacatgaaacatctgtggttcttcctcctcctggtggcagctcccagatgggtcctgtcccaggttcaaccttcgaggacgtccgggcccaggacgtgggtgaacgtccttacacacgtaccctcgttcccctctacgttcgcctactgttctcgtggtgcctccatcaagttgtacggttacttacgttagttaggcgtcgtaggaccgtaccgggtaaaccggcccccgggacgggggaaacgggaccgtggggtaaggtgggtacggttcggacccgtaacttacgtaccgtaccgacctaaaggttacggggaaaccggtaaaccccgtacgggttaaacccccctaacccccccttacccccttaaccgaacggtacgggttacccgaaccggttaaccctaacccgttaactttccgtaacccggttcccgggtaaccccggtaacccgtaaaaacccggtaaacccttaaacgtttcccgtaccccgttagggtaaccggtttccttaacggtaaccgttttaccgttacggttaccggtacccccggtacccggtacgaacccgggaaccctacccgggtaaccccttaacgttttaactacggttcggttacggcggaccggtaagggccgggtacgccggtaacgggtccggtcccgtaacgttaaaccgttacggtttcccggtttaacttaaccggtttaagttaaccgttgggttaaacgggtaccgggttaccgggtcccggggtaaacccgggggtaccgggtacccgggtaaccgggtccccggttaaccggtaacccgttccccgtcgttaacccccgg

SEQ ID NO: 50967 - DNA, 885 bp, Homo sapiens
  misc_feature: GYAE6OF01BZGPI.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtccggggcccaggactgggtagaacgcctttcacgtacgacccctgttcccctcaccttgactacctgttcctaccgtgggtggtcctacctataccaaagttaggttacggtttaacttacttagttggaacgtcgtggtacgtaccgggaacggccccggtaacgggggaacgggtacgtacgggtaggttaggtactttaccgggacctaacgtttaacgttcccgttaacggaccccgtaaaggtacggggaaaccgtaaacccgtaaccgggttaaaccccctaaacccccccgttccccggtaacccgaaacggtaccgggtacccgtacggttacccaaaccccgggtttacttttaacccgaacccggtttaccggggtaaccccccgtaacctaaaaccggtaaacccttaaacgttttcccgtaccccgttaggtacgtttacctaggtttaacttcgttacggtacccgtaccccgggaccgacgtacggaaacccgccggtcccgtttaaacttacgtttaccgtgttcgggaacgtaaggacggacggtaccacggtaggttccggaccctaagtaaaccgttcgtttaacggtttcctaacgttacgtttagttagggtacgtacggaacccggtcgggtacgggacccgggtaacggaccccggttaggtacccccgtagttcccccgtgtaccccg

SEQ ID NO: 50968 - DNA, 740 bp, Homo sapiens
  misc_feature: GYAE6OF01AKSG7.24.62.F07.1.454.CMB.1.raw
  modified_base (245)..(245): a, c, t, g, unknown or other
  misc_feature (245)..(245): n is a, c, g, or t
tcagactactatgtcacgaccggtgctcgatttagtagtcgcataaagggaaagggtctgtgaaggcttcaccagtcctggacctcctgtgcaagaacatgaaacatctgtggtccttcctcctcctggtgcagctaccagatcgggtcctgtcccaggttccaacttcgaggacgtccgggcccaggactggtcgaacgccttcacacgtaccctcgtccctcacttgctactgtctcgtggtntctcatcaatgtcgtacttacgtagtggacgtcgtaggaccgtaccggaaccgcccgggacggggtaaggtcgtgggacggtggtagttcggactaagtctaccgtaccggaccgtaaggtacgggaaccgtaaccgaccggtaacccctacccccgtaccgtaccgaacggtcgtaccggtactaccctaaccttacgtttacccgaccggtacccggtaacccgtaaccgaaaccgtaacccttacgttcccgtaccgtagtacgttaccgtagtactttcgtacgtaccggacccgaccggacgacgacccgaccgtaccttaacgttactacgtacgtacgacggacgtacggcggacgacggtacggtcggaccctaacgtaaccttagttccttactacgttagtaggtacgttcggtccggtaccggtccggtacggggacccgtaccgggtacccgtaccggttacccgtcccgtcccgccgtaccg

SEQ ID NO: 50969 - DNA, 643 bp, Homo sapiens
  misc_feature: GYAE6OF01BGD0P.24.62.F07.1.454.CMB.1.raw
  modified_base (220)..(220): a, c, t, g, unknown or other
  misc_feature (220)..(220): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcggcccaggactggtgaagccttcacacgaccctgtccctcacttncactgtctctggtcgctcgatcaatgtgtactactagttggagcgtaggactccggaacggcccggtacggggaacggacggtggaggtggtacttggacctattatcctacgacaagtgggactaaccgaggtaacccaacccctccgacgacgacgtcgacgtcactattcactcggacctacaaacgtacatcgctagatctatacttcgtgacgacgcgcaagaccgtacgcctaagtttctacgtgtacgacgtgtaagcgccgagtacgggtacggtacccacgtaaacttacgggtttccttacgtaactttacgttaacggttacggtaggtacgggtaaccggttccgggtacgggggaaccctacggggtaaccccgtacgggttaccgaacccggttccgtccgtaacccgg

SEQ ID NO: 50970 - DNA, 957 bp, Homo sapiens
  misc_feature: GYAE6OF01E3ACW.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagcctcccagatgggtcctgtcccaggttcaacttcaggagtccgggcccaggactgggtagaacgtccttacgaaccacgtaccccgtgtcccctactacgtttcgcaccgttgttccgtcgttgggtcgaccttcccaagtcaaagttggttacggttaacctttacgtagtttacggacgtacgttacgggacttacccggggaacgccccgggaccggggaaaacgggtaccgtaggggtaaggttcgggtaacgtttcgggaccttaattaacgtaccgtaccggtacccgtaaaggttccggggaaacaaccccgttaacgggttaacccccaaaccccccggttccccctaaccgtaaacggtccggttaacggtaaaccggttaccctaaacccgttagtttttaacccgaccccgttacggggaacccccgttacgaaaaaccggtaaaccctaaacgtttccgtaccccgttaggtaaccgtttccgtacggttaaacgtttcgtaacggtaccgtaccccgttacccggacgtaaccgtaaccgtaacccgggacctttaaacccgtttagttaaccgttcgggtccgtaaacggtacgggtaacgtaacggggccctacgtaaccggggttccgggaccctaggttaaaacccgttacggtttacccgtttaacgttaacgttaaccgtttagtaccggggtttacttaccgggaacccgggttcgggttaaccgggggaccccggttacggggtaaaccccggtggttaacccccgttaaccggggttcccgttaaacccccgtttccggg

SEQ ID NO: 50971 - DNA, 892 bp, Homo sapiens
  misc_feature: GYAE6OF01BP1UM.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcggcccaggactggtgaagccttcacacgaccctgtccctcacgttgctactgtcctcgtggtcggcctcgatcaattagttcggtacttactagttggactcgtaggtacgtaccgggtaacgccccgggtaccgggggaaagggtaccgtaggggacggttgggtaagtttcggggacctagttacgttaccgtaccggaccgtaaaaggtggggaaccgtaaacccgtaagggttaacccctaaacccccgttacccctaaccgaagggtaaccggttaccggaacggttaccctaaacccgtaactttaccggaacccggttacgggttaaacccccgtaccgaaaaaccggtaaaaccctaagttttccggtaaccccgtaggtaaccggtttacccgttaaggttaaccttttcggtcggttaacccggtaccccgacccggttaacaaacccggtaaccggtacccggtaaccctttaaaccggtttaagtttaccccgttgggtaaccggaaccggtaaggtacgggggaacccggtcggtaaacccgggttacgggtacccggggacccttaacgaaaccggttttaacgtttccggttttaacttacgtttacttaaaggttcggttaacgtcggggacccgttccgggtgggggaaccccggagggtaaccccgttacggacccgtaacccgtcttcccgtaaccgg

SEQ ID NO: 50972 - DNA, 755 bp, Homo sapiens
  misc_feature: GYAE6OF01CCYOO.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatgtggtacttactattggagctggactccgggaacgcccggacggggaagggacgtgggaggtggagtttcgggcctaagttactccgtaccggccctaaagttcggggaacgtaaacccgagggttaacccctaaacccccgtcccctacccgaaggtacgtcgacgtccaacccgtattttccacgtcgggaaccccgtaccaaacggaaaccctaagtttccgtccctaggacgttccttagtaactttcgtcggtacggacccggtccgacaacggtaccgaccgggtacccttaacgtttaacgttacgtggttacgaccggtaaggacggtacgggccgacgtaacgggttcgggacccgtacgtaaacgttaacgttccgttttacctaacgttagtttaacgtgggttaacgtggggtaacccggtccgggttacggggggaccccggtaacggggtaacccgtacggggttaccccgaacccggtttcccgtccccgtaacgg

SEQ ID NO: 50973 - DNA, 532 bp, Homo sapiens
  misc_feature: GYAE6OF01AHI9J.24.62.F07.1.454.CMB.1.raw
  modified_base (190)..(190): a, c, t, g, unknown or other
  misc_feature (190)..(190): n is a, c, g, or t
  modified_base (210)..(210): a, c, t, g, unknown or other
  misc_feature (210)..(210): n is a, c, g, or t
  modified_base (357)..(357): a, c, t, g, unknown or other
  misc_feature (357)..(357): n is a, c, g, or t
  modified_base (492)..(492): a, c, t, g, unknown or other
  misc_feature (492)..(492): n is a, c, g, or t
  modified_base (497)..(497): a, c, t, g, unknown or other
  misc_feature (497)..(497): n is a, c, g, or t
  modified_base (499)..(517): a, c, t, g, unknown or other
  misc_feature (499)..(517): n is a, c, g, or t
  modified_base (519)..(532): a, c, t, g, unknown or other
  misc_feature (519)..(532): n is a, c, g, or t
tcagactactatgtcacgaccggtgctcgatttagtagtcgcataaagggaaagggactggagtggattggccatatctacgccaatgggagaacccaggtacaaccccctccctccagagtcgagtcaccatttcactggacccgtccaagaaccaattgtccctgagtctgaattctgtgaccgccgnagacacggccacttattacngtgcgagagaggcgcaggtggccgcaactaagtcgtttctactattatggtatggacgccgtggggccgagggaccacggtcaccgtctcctcagcctccaccaacgggcccatccggtccttccccctggccaccctcctccaagngccacctcgtggggccacgacgccggcccgtgggccgtcgccgtggtcgaacgggtaccttaccgttcccaactagttacgttacgtccgtgggacggccggggcgtcgggacgaagggccgacgtaacgagtcntagcngnnnnnnnnnnnnnnnnnnngnnnnnnnnnnnnnn

SEQ ID NO: 50974 - DNA, 959 bp, Homo sapiens
  misc_feature: GYAE6OF01D44Q3.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagcctccagactgggtcctgtcccaggttcaacttcaggagtcgggcccaggactggtcgaacgtccttcacacgacccgtcgtccctacacttgacactgtctctggtcgctcatcaagtcgtagtacttactattggactgtacggactaccgggaacgcccggacggggaaacgggtactggaaggttcggtagttacgggacctaagttaacgttcccggtaaccggaaccgtaaggttccggggaaaaccgtaaaccgtaacggggttaacccctaaaacccccccgttcctaccgtaacgggtaaccgtaccggtaacgttaccgtaaacccttacgtttaaccgtaacccggttaccgggaacccccgtttaacggaaaaacccgggtaaaccctaacggtttacccggttaccccgttacgggttaaacgttaccgtttaaacgggttaaaccttttccgggtaacccgggttaccggtaaccccgggtacccgtaacggtaaaccggggaacccgtaaccccggggtaccctttaaaacgggttttaaccttttaaccgggtaggtttaaccggggtaccgtaaaacgggtacgggacgggttaccggtaacccggtaaggggttccggggaacccgtaacggttaaacccgtttacgggtttcccggttttaacttaaccggtttaaacggttttacggacggttttaaccgggtacggggaccccgttaacggggtcccgggggacccggttaaaccggggaccccgtttaacgggtaccccgttaaacccggttccggttaaccccgtacccgg

SEQ ID NO: 50975 - DNA, 796 bp, Homo sapiens
  misc_feature: GYAE6OF01BH8N6.24.62.F07.1.454.CMB.1.raw
  modified_base (143)..(143): a, c, t, g, unknown or other
  misc_feature (143)..(143): n is a, c, g, or t
  modified_base (283)..(283): a, c, t, g, unknown or other
  misc_feature (283)..(283): n is a, c, g, or t
  modified_base (685)..(685): a, c, t, g, unknown or other
  misc_feature (685)..(685): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagntgggtcctgtcccaggttcaacttcgaggagtcgggcccaggactggtgaacgccttcacgacgacccctgtcccctcacttcgcctactgtctcgtgggtcgcctccatacaagtaggttcgttacttacgtattggancgtaggactcccgggacgcccggacggggaagggactggggagtaggtacgttcgggcctagtactccgtaacgacctaaggtcggggaacgaacccgtacgggtaacccctaacccccgttccccaccgtaacggtacgttaccggacgttacccaaccgttactttccgaaccgtaccggaccccgtaaccaaaacgaacccttagttccggttcccctagggtacttaccgtagtaaccgtttcgtacggtaccggaaccccggcgtaaccgacgaaacccgggtccgtaccccgttaattacgtttaccgcggttaacggtacggaggacgggcggccggtaccggagggtccggaaccctacggtttaaactacggtttaccgtttctaaacgtttntaaccggttggaccgttaccggggtacccggttcccgggggaccggggggacccggtaaccggggtaaccccgttacgggtacccgtaccccggttcctccccggtacccg

SEQ ID NO: 50976 - DNA, 945 bp, Homo sapiens
  misc_feature: GYAE6OF01AZADO.24.62.F07.1.454.CMB.1.raw
tcagactactatgtcacgaccggtgctcgatttagtagtcgcataaagggaaaggtctgtgaaggcttcaccagtcctggacctcctgtgcaagaacatgaaacatctgtggttctccctcctcctggtggcagctcccagatgggtccctgtcccaggttcaacttcgaggaggtcgggccccaggacgttggtgaacgcctttcacacgaccctcgtccctcacttcgcacttcgtctcgtggtgcctctatacaatagtcggtacttacgtagtggagtcgtggacgtccggaccgcccggaccgggacggtacgtggagtcggtagtcggactactataccacgacctaaggtcgggaacgtaaaccgaccggtaacccctaaccccccgttcccgtacccgacggtaacgtccggaaccgttccgaaccctttagtttaccctaaccgttaccgggacccccgttaaacccggaaaccgtaaacccttaaccgtttacccggtaccccgtttacggtaaccggtttaccgttaaggttaaaccctttttccgggttaccggtaacgggtaccccccggtacccgttaaccggtacccggtaaacccggacccgggttaaacccccgtttaacccgttttaagtttaacccgggttcggttaacggaaccgggtaaccgggacggggtaaaccgggccccgtacggggtttaacggtccccgggggaaacctaaccgtttaaaccgggtttacgttttaccccggtttaacttaccgttttaaaaccgtgggttttacccggggttaaacgttaccgggggtaacccccggttcccgggggtaacccgggggggtaaccccggaaccggggttaaacccccccggttaaaccggggttaccccccgtaaccccggtttcccggttaaacccccgtcccggg

SEQ ID NO: 50977 - DNA, 835 bp, Homo sapiens
  misc_feature: GYAE6OF01AROAD.24.62.F07.1.454.CMB.1.raw
  modified_base (457)..(457): a, c, t, g, unknown or other
  misc_feature (457)..(457): n is a, c, g, or t
  modified_base (509)..(509): a, c, t, g, unknown or other
  misc_feature (509)..(509): n is a, c, g, or t
tcagactactatgtcacgaccggtgctcgatttagtagtcgcataaagggaaagggtctgtgaaggcttcaccagtcctggacctcctgtgcaagaacatgaaacatctgtgttcttcctcctcctggtgcagctccagagtcggtcctgtcccaggttacaacttcgaggcgtcggcccaggacgtggtacgaacgccttcaacgacgtaccctcgtcccctcacgttcgctacgtctcgtcgtacggtgacctaccgatacgaagttggtacgttaccttaagtggttggacgtcgtagaccgtacggaacggtccccggaggggaggactgggaagtcgtagttcggctatactccgacgcaggtcgggaacacgtcgaaccctccctccgagaacgactcggactccgaacctcttacgacgtaccggaccctacgaacgaactaggtttccnccgttagactactacggtaacttcgtacggtacgtaccccgaccggtaaccncgaacccgggtaccccttacgttaaaccgttaccgtttaacgtcggtaaaccggtcgggaacggtaacgggcggtaacccgtcggtaaccgggtaccggtacccgttaaacggttaaacccgtttacgggttttaaccctttaccggttaaaacgttaacggtttaaacgggtttccggggttaaacccggttaccgggggttaacccgggtcccgggggttaaaccggggggttaaccccgggtacccggggtttaaaaccccgggacccccggggtttaaccgttacccccccggttaacgttaccccggtttaaaccccccgg

SEQ ID NO: 50978 - DNA, 789 bp, Homo sapiens
  misc_feature: GYAE6OF01BVIYY.24.62.F07.1.454.CMB.1.raw
  modified_base (191)..(191): a, c, t, g, unknown or other
  misc_feature (191)..(191): n is a, c, g, or t
  modified_base (607)..(607): a, c, t, g, unknown or other
  misc_feature (607)..(607): n is a, c, g, or t
tcagactactatgtcacgaccggtgctcgatttagtagtcgcataaagggaaagggtctgtgaaggcttcaccagccctggacctcctgtgacaagaacatagaaacatcgtgtggttcttcctcctctggtggcagctccagatggtcctgtcccaggttcaacttcgaggtagtccggccaggactggngaacgccttacacgagtacccctgtccctcacttgcctactcggtactcgtgggtcgcctccactacgaagttaggtacggtaaccttagtagttggactacgtgggaactaccgggaaccgccccgggaccggggaaagggtcgtagggaggtaggtatcggacagtacaccgtacgaccgaagtacgggaacaaaccgaacgggttaaccccaaccccctaccccgaccgtaaggaccgtaacgtaccgtacaaaccccgttattccgaaccgtacggggaacccctaaccgaaaaagtaaccccaaagttttcccggaaccttacgggaacgttacgtacggttaaattcctacggtaccgacccggacccgaacgacggtaacgacccggacctaacgtttactaaccggtntacggaacgtagaacgggacgaccggtaccgtaagggtccgacccgaacgttaaaacgtacggtttccgttacttaagtaaccgtttaggtacgggtaaggtcgaaaccgggtccggacggggggtacccgaagggtaaaccccggcggttaacccgccgtttacccgtcccgtaaacccgg

SEQ ID NO: 50979 - DNA, 854 bp, Homo sapiens
  misc_feature: GYAE6OF01ARJ7C.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccagggactggtgaacgccttcaaccacgaccccttgtcccctactacttcgctactcgttccttcgttgggtcggcctccaattactaattacggttggttaaccttttaagttagtttacggacgccgtaggtaccgtacccgggaaccggccccgggaccggggaaagggtccgtgggtacggtaggtcgttacgggctaagtcgtcgtaccgaccgaaggtacgggtaacgaaaccccgtaggtaacccctaaccccccgtcccgtaccgacggtacgtacgacgttacccaaccttactttaccgaccggttacggaaccccgtaaccgtaaacgaacccttaaacgttcccgttacccgtaggtaacgttcgttacgtaactttccgtacggtccggacccgtccggtaccgtaacgacccgacgtaccttacttaaccgttaccgttggtaccgtcgaacggggtacgtaaccggggcctacggacgggttacccgggtacccgaaccgttaaccggtttaaccttcccggttttaacttaaccgttttaacggtttaagttaccgggtttacgtaaccgggggtcccggtcccggggttaaggggcccgggttaacccgggacccggttaacggtcccccggttacccgtccgtttcccgtaccccg

SEQ ID NO: 50980 - DNA, 866 bp, Homo sapiens
  misc_feature: GYAE6OF01A7BCW.24.62.F07.1.454.CMB.1.raw
  modified_base (141)..(141): a, c, t, g, unknown or other
  misc_feature (141)..(141): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtgcagctccagntgggtcctgtcccaggttcaacttcaggtagtccgggcccaggactggtgaacgtccttacgacacgtaccctgtccctcacttgctactgtcttctagggtcgccttccatactaagtggttacggtactttacgtattgggacgcgtaggactaccgggaacgcccggaccggggaaggcgtaggtacggtaggtattcgggacctagtacgtcctacgccgtaagtaggggtaaccaaccgtacggttaaccccaacccccgtccgttacgacggtaccggtacgtaaccgtaccgtaacgttacctttcgcccgtaacggtaacccccgtaacgtaaaacgaaaccttaacgtttccggtccctaagggttaacctacggtaactttaaccgttacgttcggtacccgtacccggtacgaccgtaaccggtaaccggtacccgacccgtttaacgtttacgttaaacgggtccgtttcggaacggtacgggtaacggtccggggtaccgttacggagggtttaccccggaccggttaacgtaacccgtttaacggtttcccggttttaccgttaacgtttacgttaacggtttttacggaaacccgggtttcggtaaacccgggtcccgggtttaaccgggggtaaccccggggtaacggggtacccccttaacgggggttacccccgtttaacccggtcccggtttcccctaacccgggg

SEQ ID NO: 50981 - DNA, 636 bp, Homo sapiens
  misc_feature: GYAE6OF01DRXRQ.24.62.F07.1.454.CMB.1.raw
  modified_base (608)..(636): a, c, t, g, unknown or other
  misc_feature (608)..(636): n is a, c, g, or t
tcagactactatgtcacgaccggtgctcgatttagtagtcgcataaagggaaagggactggagtggattggccatatctacgccaatgggagaaccaggtacaaccccctccctccagagtcgagtcaccatttcactggacccgtccaagaaccaattgtccctgagtctgaattctgtgaccgccgcagacacggccactttattacgtgtgcgaggaggaggccgcgaggtcgggcccgacaaacgttaaggttccgtttttacctaacttaattttaagtgggttatcggggaccgtccggttcgggggacccggacggggaccgaccgggtcctacccgtccttccgtccacgtcccctacccaaccgaaccgggcccctacgttcccggttccctttccccccgttcggcccctacccctccctaccgaacgtacgaccctacccgtccgggtacgggggacaccgacggcccgggcccggtcgggcctcggtcccgtcgggaccgtaacgggtacccttaccgttaccacgtaagttacggttagtccggttaggacggggtccgggtcggtacgggtacgaacggtcgacgtaagtacgnnnnnnnnnnnnnnnnnnnnnnnnnnnnn

SEQ ID NO: 50982 - DNA, 796 bp, Homo sapiens
  misc_feature: GYAE6OF01CCOPA.24.62.F07.1.454.CMB.1.raw
  modified_base (233)..(233): a, c, t, g, unknown or other
  misc_feature (233)..(233): n is a, c, g, or t
  modified_base (262)..(262): a, c, t, g, unknown or other
  misc_feature (262)..(262): n is a, c, g, or t
  modified_base (517)..(517): a, c, t, g, unknown or other
  misc_feature (517)..(517): n is a, c, g, or t
  modified_base (740)..(740): a, c, t, g, unknown or other
  misc_feature (740)..(740): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagcctccgagagtcgggtcctcgtcccaggttcaacttcgagggtaggtccgggacccaggtactgggtagaacgtccttcacgacgtaccctgtccctnacttgctactgtctcgtggtgctccatanagttcggtgtacttagtgttacggagtcgtaggaccggtaccgggaacccggcccggggtaacggggaacgggtacgtggggtaaggtcgggtagttcgggaccttaattacgttccgtaaccggaccgtaaggttacgggggaaccctaaaccgtaaccggtaccccctaaaccccccgttcccgtaccgaaggtaccgtacggacgtaccctaaccgttactttaccaccggttacccggtaaccccggtaanaaacggtaacccttaaggtttccgtcccgtaggtacttacgtaagttacctttaggtcggtacccggacccgtccgaagtaacgaccccggtagtacccctttaattacgtttacgtagggacggtacggaagggtacggcgggacaccggtagggtccggaccttaataaaccggtttgttccttaacgtactttagtacgtacggtacggtcgggacccgngggttacccggggaggtaccggacggtcccgtaacggccctcggtccctaacccgg

SEQ ID NO: 50983 - DNA, 733 bp, Homo sapiens
  misc_feature: GYAE6OF01E09HP.24.62.F07.1.454.CMB.1.raw
tcagactactatgtcacgaccggtgctcgattttagtagtcgcataaagggaaagggtcgtgtgaaggcttcaccgagtcctggacctcctgtgcaagaacatgaaacatctgtggttcttcctcctccgtggtggcagctcccagatgggtcctgtcccaggttcaacttcaggagtcgggcccaggactggtgaacgccttcacacgaccctcgtccctcacttgcactgtctcgtggtcgctccatcaagtagtgtacttactattgagctggacgtaccggaacgcccggcggggaaggactgggagtggagtggaccagtactctaccgacgaagtgggaacaaccgaggtaaccaaccccgtcctacagacgtcgactccaactactttacacgttcggacccgtacgaaaacaaaccttaattccgtaccctggtacgttactagttaactttccgaggttacgaccccggtccgaacgacgaacccgacccgtacctaaacctttacgtttaaccttgggtacgtacgaaggtacggacggtacgacgttaagggtaccggacccgtaacgtaaacgttaacggtttccgttttaacttaccgttttaaattcggttacggttcgttaacgggtacccggtcccgggttacgggggaacccggttaaccggggaacccggtacgggttaaccccgtacccggttcccgtaaccccggttaaccgg

SEQ ID NO: 50984 - DNA, 937 bp, Homo sapiens
  misc_feature: GYAE6OF01CNHGG.24.62.F07.1.454.CMB.1.raw
  modified_base (137)..(137): a, c, t, g, unknown or other
  misc_feature (137)..(137): n is a, c, g, or t
tcagactactatgtcacgaccggtgctcgatttagtagtcgcataaagggaaagggtctgtgaagccttcactagaccctgtccctcacttgcactgtctctggtgctccatcaatagtggtacttactagttggancgtggactaccggaacgccccggccgggaaagggctgggagtggtacttggacctattactcgtaccggacctaaaggtggggaacaaccgtacggtaaccctaaccccccgttcccgaccgaaggacggtccggaagttccccaacttactttaccgaccgtaccgggtaacccccgtaaccgaaaaacggtaacccctaagttttccggttacccccgtaaggtaccgttccgttaacggttaaacctttccttacggtaccggtaaccccggcccgaacgaaccggaacccgtaccgggtaccctaaccgtttaattacccgttggtaccggacggaggtaacggcgggtacgaccggtagggtccggcccgtaactaaaccgttaacggtttccgttttacctaactttaacgttaggttcgggttaaggtaccggtaacggtcccgggtaacggggtaccgggaccggggtaaaccctccgggtacctaccccgttccgtcccgtacacccgttccctaccccggaaccggtaaacccggccctaccggttcccgggttaccccccttccccgtacgggtaccccctacccccgtttaccccgacgtaaacccgacgtaccccggttaccgtcgggtacccggggacctacccggacccggggtcccgttcccgggtacggttccgtacccggtacgtcccggttaagggaacccgttacttaccccgtactaacgttcggttaacggtccgtaaggccgggtcgggaccgggtgtaccgggaggtacgaaccgg

SEQ ID NO: 50985 - DNA, 862 bp, Homo sapiens
  misc_feature: GYAE6OF01A7HQE.24.62.F07.1.454.CMB.1.raw
  modified_base (148)..(148): a, c, t, g, unknown or other
  misc_feature (148)..(148): n is a, c, g, or t
  modified_base (215)..(215): a, c, t, g, unknown or other
  misc_feature (215)..(215): n is a, c, g, or t
  modified_base (233)..(233): a, c, t, g, unknown or other
  misc_feature (233)..(233): n is a, c, g, or t
tcagactactatgtcacgaccggtgctcgatttagtagtcgcataaagggaaagggtctgtgaaggcttcaccagtcctggacctcctgtgacaaagaacatgaaacatctgtggttcttccctcctcctggtggcagcctcccaagngtgggtcctcgtaccctaggttcaacttcaggcgtccgggcccagggacctggtagaacgtccttanaccacgccccttgtcccnctacgttcgctactgtcctcgtaggtcgcctacctactacgtaagttacggttacggttaccttaagtagttcggaacgtcgtgggtaactacccgggaacgccccgggaccggggaaacggtaccgtggggaagtcggggtaagtttcgggaccctaagtttacctaccgtaacgacccgtaaaggtacgggtaacggaaaccgtaacggttaaccccgaacccccttccccgtacgtaacggtaaccggtaccggaaaccgttcctaaacccgttacgttttaccgaccggtaaccgggttacccccgtaaccccgaaaaacgggaaaccctttaaccggttacgtacccccgtaggttaacccgggttactaacgtacgtttaccggtaacggtccgtacccccggaccgcgaaccgaccgaacccgtacctaacgtttacctacgttccgtagtaccggaagaccggagccgtacggaagtccggaaccgacgtacttaacgttacgttaccgttaaccttaagttaccgtaggttaacgtcgggtaccggccgggttaccggggtaccgtaacccggggtaacccggacccggtttaccaccccgttacccgttccgaaccccg

SEQ ID NO: 50986 - DNA, 897 bp, Homo sapiens
  misc_feature: GYAE6OF01BOGIR.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctctggtggcagcctccagagtgggtcctgtcccaggttcaacttcgaggagtccgggcccaggtactggtgaacgtccttacacgacgacccttcgttcccctactacttgcctacgttgtctcgtgggtcgcctacacttactaagtagttacggttactttacgtagttggagtcgtaggtacgtaccgggaaccgccgggaccggggaaggtcgtaggaggtggtacgttcggacctatacgtccaccggaccgaaggtcgggaaccaacgtaccggtaaccccaaccccttccgtacgacgtacggtaacgtactacccgtacttacgtttccgacgtaccgggtaccccttaacgaaaccgtaaccgttaacgtttccgtacccgttaggtacgttaccgttaagtaccgtttccggtgtacccgggaccccgttaccgagtacccggttaaacccgccggttaaccctttaacgtttaccgttaaccggtcgttaaacggggaacccggtagggaaacggggtccgggacgtacggaaccgggggtttacccgggacccttaaacggttaaacgggttttaccgttttaccccgttttaattaacccggtttaaagtttacggggttaaccggggtaaaccgtttcccggggtaaaccccgggttacccggggggttaccggggaaaccccggggtttaaacccgggtaacccgtacccggggtttaaccccttcccccgggttttcccccgaaagttaccccccggg

SEQ ID NO: 50987 - DNA, 643 bp, Homo sapiens
  misc_feature: GYAE6OF01BOKWL.24.62.F07.1.454.CMB.1.raw
  modified_base (635)..(635): a, c, t, g, unknown or other
  misc_feature (635)..(635): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctctcctggtggcagctcccagatgggtcctgtcccaggtttcaacttcaggagtcgggcccaggactggtgaagccttcacacgaccctgtccctctacttgcactgtctctggtgctcatcaatagtggtacttactagttggagctggactccggaacgcccggcgggaggactgggagtggattggccatctctacgccaagtgggacaaccgaggtaccaccccgtcctccgagcgtcgacgtcacctattcacgtcggaccctaccgaaagtaacctaagttccgtacccgtggacgttctaggtaacttcgtcggtacgaccccgtcgacaacgggaccctaccgggtaccttaacgtttacgttacgtggttacgagacggaggcgggccgacgtagggtccgtaccgactaagttaccggttcgtttaccgtaattacgttagtaggttctacgggtaccctccgggtaggggacccgagggtcccctacgggtacccacccgttcncccgtacg

SEQ ID NO: 50988 - DNA, 929 bp, Homo sapiens
  misc_feature: GYAE6OF01A5TFP.24.62.F07.1.454.CMB.1.raw
  modified_base (168)..(168): a, c, t, g, unknown or other
  misc_feature (168)..(168): n is a, c, g, or t
tcagactactatgtcacgaccggtgctcgatttagtagtcgcataaagggaaagggtctgtgaaggcttcaccagtcctggacctcctgtgcaagaacatgaaacatctgtgttcttcctcctctggtgcagctccagatggtcctgtcccaggttcaacttcgaggngtaccgggcccaggaaccgtggtacgaagccttcacgacgacccttcgtccctcaccgttgcacgttgtcctcgttggtcgcctacctataccgtaagttaggtacgtttaccgtttaaacgttgttacgggtacgtacggttacggtaagttaccccggggaaggtacccccgggacgggggaaacggggtaccgttagggaacggttcggggttaacgttccgggaccgttaacgttaacttacccggtaacggacctaaacgggttcggggaaaccgaaaccgtaagaaaccgtaacccgtaacccccgtaccgtaccgtaacggtaaccgttacgggaacttacccgaacccgttagtttaacccgtaaccggtacgggtaacccccgtttaacgaaaaccggtaaacccgtttaacctttaccgggtaccccttagttaaaccgttccgtaagtttaaccgttaccgttagggtacccgtaaacccggtcccgaaccggtaacaccggtacccggttaccaacgtttttaacgtaccgttagtacggtaccgaaggtaacgggcggacgtaccggtaacgggacgtacccggtaactaacggttaacggtttaccggtttaacttaacccggtttacttaaaggtaccgggttttaaacggacgggttacccggtccccggggttaggggtacccccgggaaacggggttacccctaaaaccggggttttccccacgggttccccggttaaccccg

SEQ ID NO: 50989 - DNA, 903 bp, Homo sapiens
  misc_feature: GYAE6OF01DEZJW.24.62.F07.1.454.CMB.1.raw
  modified_base (105)..(105): a, c, t, g, unknown or other
  misc_feature (105)..(105): n is a, c, g, or t
  modified_base (128)..(128): a, c, t, g, unknown or other
  misc_feature (128)..(128): n is a, c, g, or t
  modified_base (131)..(131): a, c, t, g, unknown or other
  misc_feature (131)..(131): n is a, c, g, or t
  modified_base (139)..(139): a, c, t, g, unknown or other
  misc_feature (139)..(139): n is a, c, g, or t
  modified_base (566)..(566): a, c, t, g, unknown or other
  misc_feature (566)..(566): n is a, c, g, or t
tcagactactatgtcacgaccggtgctcgatttagtagtcgcataaagggaaagggtctgtgaaggcttcaccagtcctggacctcctgtgcaagacatgaaacntctgtggttcttcctcctctggngcngctccagntggtcctgtccaggttcaacttcgaggacgtccgggcccaggtactgggtgaacgtccttacacgacgtaccctgtccctacacttgcctactcgtccttacgtgggtcgtacctaccattaccaagttaggtacggttactttacgtagttacggagtcgtggaccgtaccgggaacgcccgggaacggggaggacgtggtacggtcgggtatttcgggacctaagttacctaccgtacggaaccgtagggtacggaacgtaaacccggtaacgggtaacccctacccccgtcccgttacgaacggtacgtacgtacgtaccgtaaccttactttaccgaaccgttccggaaccccgttaacgaaacgttaaacccgtaagtttccgtaccctagggttacgttaccgttaaggtacttttaccgngggtacccgacccggtacgacgtaaacggcccggtaccggtaacctttaacgtttacggttacgttcgggtacggtaacggaaccggtaaggccgggtaccgttacgggacgggttacccggacccggttaaaacttaaccggttttacgtttacccgggttttaaaccttaagttttaaacggttacgggttttaaggggtaacccgtttcggggggaaccccccgggttttccggggaacccgggggggtttaacccggaaccggggtttaaacccccggggtacccgtttaaccccggtttaaccccgggtccctttaaccccgtaccccgggg

SEQ ID NO: 50990 - DNA, 789 bp, Homo sapiens
  misc_feature: GYAE6OF01CS63U.24.62.F07.1.454.CMB.1.raw
  modified_base (207)..(207): a, c, t, g, unknown or other
  misc_feature (207)..(207): n is a, c, g, or t
  modified_base (702)..(702): a, c, t, g, unknown or other
  misc_feature (702)..(702): n is a, c, g, or t
  modified_base (716)..(716): a, c, t, g, unknown or other
  misc_feature (716)..(716): n is a, c, g, or t
  modified_base (723)..(723): a, c, t, g, unknown or other
  misc_feature (723)..(723): n is a, c, g, or t
  modified_base (725)..(725): a, c, t, g, unknown or other
  misc_feature (725)..(725): n is a, c, g, or t
  modified_base (731)..(732): a, c, t, g, unknown or other
  misc_feature (731)..(732): n is a, c, g, or t
  modified_base (738)..(738): a, c, t, g, unknown or other
  misc_feature (738)..(738): n is a, c, g, or t
  modified_base (740)..(740): a, c, t, g, unknown or other
  misc_feature (740)..(740): n is a, c, g, or t
tcagactactatgtcacgaccggtgctcgatttagtagtcgcataaagggaaagggactggagtggattggccatatctacgccaatgggagaaccaggtacaacccctccctccagagtcgagtcaccatttcactggacccgtccaagaaccaattgtccctgagtctgattctgtgaccgcgacagacacggcctattattacngtgcgagagaggcgcaggtcggccgactaaacgttaacgttccgttttacactttaattacgttaggtagtacgggaccggtccggtgggggacccggacggggacccgtaaccgggtccgtacccggttccgtccctcgaccgtccccgtaccccgaacccggtaaacccggggtacccctaaccggtttcccgggtccccgttttacccccccggtcgggtaccccctacccccgtttaccccgtacccgaaaacgggacccgtaccccggtaaccccgttcccggggtacggggggaccaaccggtaccgggccccgggtccccgggttcggggtccgtacccggttccccgggttaacgggtacccgtaaaaccggggtaccctttacccgtttaaccccgtaaccgttacgttaagggttaccgtaccggttacggggcggttaccgggggcggtacgggacccgtaacgggtacgcctaaggtcgaagntacgcatcgtacgngtacgcncncgcgtnntgcgtncncgtcgtactgagtctcgtcgcgccgcgacgtacgtagagcgcgcgtacg

SEQ ID NO: 50991 - DNA, 846 bp, Homo sapiens
  misc_feature: GYAE6OF01CJHC7.24.62.F07.1.454.CMB.1.raw
tcagactactatgtcacgaccggtgctcgatttagtagtcgcataaagggaaagggtctgtgaaggcttcaccagtcctggacctcctgtgacaagaacatgaaacatctgtggttcttcctcctcctggtggcagctcccagatgggtcctgtcccaggttcaacttcagggagtcgggcccaggtactgggtagaacgccttcacacgacccctcgtcccctacacgttcgctactgtccgttcgtgggtcggcctaccgattacgtaaagttaggttacggttacctttaacgtagttggacgtcgtagggacgtaccgggaaccggccccgggaacgggggaacgggtccgtaggggtagggttcgggaacggttcgggacctaagttactaccgttaaccgaccgtaaggtacgggaaccaaaccgtaacggtacccctaacccccgtcctaccgacggtacgtccgaacgtcctaaccgtacgtttccgaacgttccgggaacccctacgaaacgaaaaccgtacgtttccgtacccttggtaacgttccgtagtaaactttcgcggttacccggacccgccgtaacgacgtacccgaaccggtacccttaggtttaacgtacggttgcggacgtaagggacggtcggaccgtacggtaaccgggttccggacccggtaacgttaaaccggtttacggttaccggttttaaccttaaactttacgggtttagtaccgggtttacgttccggggaacccggtcccggggttacgggggaaccccgggtaacggggtccccggtaacgggtacccgtacccgtttcccgtaccgtaccccgg

SEQ ID NO: 50992 - DNA, 826 bp, Homo sapiens
  misc_feature: GYAE6OF01A550E.24.62.F07.1.454.CMB.1.raw
  modified_base (261)..(261): a, c, t, g, unknown or other
  misc_feature (261)..(261): n is a, c, g, or t
  modified_base (601)..(601): a, c, t, g, unknown or other
  misc_feature (601)..(601): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctcgtcccgtaggttccaacttcgaggacggtcggccgaggtactggtgaacgccttcacacgaccctcgtcctctacttcgctactgtctcgttggtcgtactccacttanaagttacgtcggttacttacgtaagttggacgtcgtacggtaccgttccgggtaaaccggccccgggtaccggggtaacggggtaccgttacgggtaggtacggtaggttcccgggaactaacgtacgttacggaaccgtaccgaacgttacggggaacgtaaccgtaaaccgggttaacccctaacccccgtacccgtaccgacggtacgtaacggtacgtaacccgacctttactaccgtacgtacccggtaccgtaccggaaactaccgtaacgttaccgtacgtacgtactctaacggttaactcgtacgtaccgccccgtacgtgaacccgtacnccgaccgttacttacgtactgcggaacgtcggattacggcgtacgtacggtccgaccgtaaaccgttagtacgggtttaccttacttaacggttacgtttcggtacgggttaccgtttcggggaaacccgttcggggtcccggggtaaacggtaacccccgggggttacttaccccgggttaaaccccggttcccttaaccccggggttcccctaaacccggggg

SEQ ID NO: 50993 - DNA, 504 bp, Homo sapiens
  misc_feature: GYAE6OF01A52ZJ.24.62.F07.1.454.CMB.1.raw
  modified_base (479)..(480): a, c, t, g, unknown or other
  misc_feature (479)..(480): n is a, c, g, or t
  modified_base (482)..(504): a, c, t, g, unknown or other
  misc_feature (482)..(504): n is a, c, g, or t
tcagactactatgtcacgaccggtgctcgatttagtagtcgcataaagggaaagggactggagtggattggccatatctacgccaatgggagaaccaggtacaacccctccctccagagtcgagtcaccatttcactggacccgtccaagaaccaattgtccctgagtctgaattctgtgaccgccgcagacacggccacttattactgtgcgagagaggcgcagtggccgcaactaagtcgtttctactattatggtatggacgccgtggggccgagggaccacggtcaccgtctcctcagcctccaccaacgggccccagtccggttccttcccccctcggccacccctccctaccaagacgcacccgtcgtcgggggccacgacgccggcccgtgggctcgcctggtcgaacggtacctacttccactagtagtacgtcgtgacggcgggcgtggacgtaacggcggcaagtaganncnnnnnnnnnnnnnnnnnnnnnnn

SEQ ID NO: 50994 - DNA, 835 bp, Homo sapiens
  misc_feature: GYAE6OF01AZWUZ.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagtccttcacgacgaccctgtccctcacttgcactgtctcgtggtcgctccatcaatagtgtacttactagttggagtcgtggaactccgggaacgccccggacggggaacgggacgtgggacggtggtacgttcggacctagtactcctaccggccgtaaagtcggggaactaacccgtaacgggtaacccctaaaccccccgttcccgtaccgaacggtacggtaccgtaacgttacccaaacccgtacttttacccgaaccgttccgggaacccccgttacccgaaaacgtaaaccccttaacggtttcccgtaccccgtaggtaaccgtttccgttacgttaaaccgtttccgtacggtaccgggtaaccccccggtccgaccgtaaacggtaccccgtacccggggtaacccctttaacgttttaacgttaacccggttgggtcgggtaacccggtaagggaacgggaccgggccgtacggtaccgggtcgggtacccgtaaacgtaaacggtttaacgtttcccggttttactaacgtttaacgttaggttacgggtacgtcggggacccggtccgggtacgggggacccggtacggggaaccccttcgggtacccacccggttccttacccgtccg

SEQ ID NO: 50995 - DNA, 763 bp, Homo sapiens
  misc_feature: GYAE6OF01ERV6X.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtccggggcccaggactgggtgaacgtcctttacacaggacccctggttcccctcgacttcgcctaccgttgtctcgtggtgctccatcaattagtgtacttatattggagctggactcggaagcccggacgggaaggctggagtggtattcggacctatataccgtacgaccaagtgggaacaaccgagggtaacccaacccccgttccgtaccaaggtacgtaccgaagtccaccgtatttccgaacgtccgggacccgtacaaaaggtaacccctaagtttccgtaccttggaacgttcgtacgtaaagtttccgtaggtaccggacccgtacccgacacgggtaacccgaccggtacccttaacgtttacgtaacgtgtaccggacggagtacgacgggtcccgacgtaacgggtacgcccgtaaagtaaccgtttacgggttacccggttttacaaaccttttaaggttaccgttaaggggttaacttcgggggaaacccggtcccggggttaaccgggggaccccggtaacggggtaaccccctaacggggttacccctcccgggtttcgtacccctaacccggg

SEQ ID NO: 50996 - DNA, 438 bp, Homo sapiens
  misc_feature: GYAE6OF02JCW9S.24.62.F07.1.454.CMB.1.raw
  modified_base (434)..(438): a, c, t, g, unknown or other
  misc_feature (434)..(438): n is a, c, g, or t
tcagactactatgtcacgaccggtgctcgatttagtagtcgcataaagggaagggactggagtggattggccatatctacgccaatgggagaaccaggtacaacccctccctccagagtcgagtcaccatttcactggacccgtccaagaaccaattgtccctgagtctgaattctgtgaccgccgcagacacggccacttattactgtgcgagagaggcgcagtggccgcaactaagtcgtttctactattatggtatggacgcctggggccgagggaccacggtcaccgtctcctcagcctccaccaagggcccatcggtcttccccctggcaccctcctccaagagcacctctggggcacagcggccctgggctgcctggtcaaggactacttccacatagtagtctgagcgggctggcaaggcgcatagnnnnn

SEQ ID NO: 50997 - DNA, 834 bp, Homo sapiens
  misc_feature: GYAE6OF02HN43J.24.62.F07.1.454.CMB.1.raw
tcagactactatgtcacgaccggtgctcgatttagtagtcgcataaagggtaaggggtacggtggagtgggattgggccatatctacgccgaatgggagaaccgaccggtacaacccctcctccacgagggtccgacgtcaccctattttccacgtcggtacccggtccgaaggaacccaattgtccctgacgtcttggaattctggtacgaccgtccgccagtaccaccggccacttattacctacggtggcgagagaggccgaccagttggaccgtcaaccgtaagtacggttttcgtaacctaatttagtcgggtaacttgggtaaacgtccgttaggggtcccgaaggggaaccaacgggtaccaaccgggtaccgtccccttacgacgtcccttaccaccctaaaggggccccaacttccgggtaccttaccccccgttgggaccttaccccgtccctaacccgtaacggggtaccgactacccgttacgttcgggggggacctaccggaacggccggggtccccgtaggggtcccttcggggaccccgttagggtaccttaaacggggaccctttaacccgtttccccaaacccgtaactttaaccggttaacgggtttacctttacgggtaacgggtacccggggggaaccgtttacgggggaaccgtaaaacggggttttccgggaccctaaacgttttaacgggtacttacggtacaactagaacttacaattggtttacggaccgaagggacacgactaataaagtaacaagtgtagactacgacgacactctcgtctactactacctccgtctactactgtac

SEQ ID NO: 50998 - DNA, 439 bp, Homo sapiens
  misc_feature: GYAE6OF02I6NWS.24.62.F07.1.454.CMB.1.raw
  modified_base (436)..(439): a, c, t, g, unknown or other
  misc_feature (436)..(439): n is a, c, g, or t
tcagactactatgtcacgaccggtgctcgatttagtagtcgcataaagggaaagggactggagtggattggccatatctacgccaatgggagaaccaggtacaacccctccctccagagtcgagtcaccatttcactggacccgtccaagaaccaattgtccctgagtctgaattctgtgaccgccgcagacacggccacttattactgtgcgagagaggcgcagtggccgcaactaagtcgtttcactattatggtatggacgcctggggccgagggaccacggtcaccgtctcctcagcctccaccaagggcccatcggtcttccccctggcaccctcctcccaagagcacctctggggcacagcggccctgggctgcctggtcaaggactacttccacatagtagtctgagcgggctgggcaaggcgcatagnnnn

SEQ ID NO: 50999 - DNA, 545 bp, Homo sapiens
  misc_feature: GYAE6OF02HBQ89.24.62.F07.1.454.CMB.1.raw
  modified_base (327)..(327): a, c, t, g, unknown or other
  misc_feature (327)..(327): n is a, c, g, or t
  modified_base (463)..(463): a, c, t, g, unknown or other
  misc_feature (463)..(463): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatagtggtacttactattggagctggatccggaagcccgccgggaagggactggagtggattggccatatctacgccaatggganaaccaggtacaacccctcctccagagtcgagtcaccatttcactggaccctcaagaaccaattgtccctgagtctgaattctgtgaccgcgcagacacggccacttattactgtgcgagagaggcgcgagtggccncaactaagtcgtttactactattatggtatgggaacgtccgtgggggccgagggacccacgggtcacccggttctccctacg

SEQ ID NO: 51000 - DNA, 439 bp, Homo sapiens
  misc_feature: GYAE6OF02GESFJ.24.62.F07.1.454.CMB.1.raw
  modified_base (436)..(439): a, c, t, g, unknown or other
  misc_feature (436)..(439): n is a, c, g, or t
tcagactactatgtcacgaccggtgctcgatttagtagtcgcataaagggaaagggactggagtggattggccatatctacgccaatgggagaaccaggtacaacccctccctccagagtcgagtcaccatttcactggacccgtccaagaaccaattgtccctgagtctgaattctgtgaccgccgcagacacggccacttattactgtgcgagagaggcgcagtggccgcaactaagtcgtttctactattatggtatggacgcctggggccgagggaccacggtcaccgtctcctcagcctccaccaagggcccatcggtcttccccctggcaccctcctccaagagcacctctgggggcacagcggccctgggctgcctggtcaaggactacttccacatagtagtctgagcgggctggcaaggcgcatagnnnn

SEQ ID NO: 51001 - DNA, 427 bp, Homo sapiens
  misc_feature: GYAE6OF02FKLXE.24.62.F07.1.454.CMB.1.raw
  modified_base (425)..(427): a, c, t, g, unknown or other
  misc_feature (425)..(427): n is a, c, g, or t
tcagactactatgtcacgaccggtgctcgattagtagtcgcataaagggaagggactggagtggattggccatatctacgccaatgggagaaccaggtacaacccctccctccagagtcgagtcaccattcactggacccgtccaagaaccaattgtccctgagtctgaattctgtgaccgccgcagacacggccacttattactgtgcgagagaggcgcagtggccgcaactagtcgtttcactattatgggtatgggacgcctggtccgaggaccacggtcaccgtctcctcagcctccaccaaggcccatcgtcttccgtggcacctcctccaagagcacctctggggcacagcggccctgggctgcctggtcaaggactacttccacatagtagtctgagcgggctggcaaggcgcatagnnn

SEQ ID NO: 51002 - DNA, 543 bp, Homo sapiens
  misc_feature: GYAE6OF02ICQI3.24.62.F07.1.454.CMB.1.raw
  modified_base (469)..(469): a, c, t, g, unknown or other
  misc_feature (469)..(469): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatagtggtacttactattggagctggatccggaagcccgccgggaagggactggagtggattggccatatctacgccaagtgggagaaccaggtaccaacccctccctccagagtcgagtcaccatttcactcggacccgtcaaagaccaattcgcctgatctgaattctgtcgaccgccgcagacacggccactttattactgtgcgagagaggcgcagtggccgnaaactaagtcgtttacactattagtggtatggacgccgtggggccgagggacccacggtccaccggtctcctcg

SEQ ID NO: 51003 - DNA, 554 bp, Homo sapiens
  misc_feature: GYAE6OF02I9S05.24.62.F07.1.454.CMB.1.raw
  modified_base (325)..(325): a, c, t, g, unknown or other
  misc_feature (325)..(325): n is a, c, g, or t
  modified_base (418)..(418): a, c, t, g, unknown or other
  misc_feature (418)..(418): n is a, c, g, or t
  modified_base (436)..(436): a, c, t, g, unknown or other
  misc_feature (436)..(436): n is a, c, g, or t
  modified_base (450)..(450): a, c, t, g, unknown or other
  misc_feature (450)..(450): n is a, c, g, or t
  modified_base (546)..(546): a, c, t, g, unknown or other
  misc_feature (546)..(546): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatagtggtacttactattggagctggatccggaagcccgcgggaaggactggagtggattggccatatctacgccaatggganaaccaggtacaacccgtcctccagacgtcgagtcaccattcactgacccgtcaagaaccaattgtccctgagtctgaattctgtcgaccgcgnagacacggccattatacngtgcgagagaggcncgagtggaccgactaaacgtagttccgttctaacgtattacgtggtaattggaccgtcgttcggggccgaagggacccacgggttcacccggttcncccctacg

SEQ ID NO: 51004 - DNA, 532 bp, Homo sapiens
  misc_feature: GYAE6OF02HPKXW.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatagtggtacttactattggagctggatccggaagcccgccgggaaggactggagtggattggccatatctacgccaatgggagaaccaggtacaacccctcctccagagtcgagtcacatttcactggacccgtcaagaaccaattgtccctgagtctgaattctgtgaccgccgcagacacggccactttatactgtgcgagagaggcgcagtggccgcaacgtagtcgtttctactattatggtatggacgccgtggggccgagggaccacggtcaccgtctcctcg

SEQ ID NO: 51005 - DNA, 437 bp, Homo sapiens
  misc_feature: GYAE6OF02HA5DJ.24.62.F07.1.454.CMB.1.raw
  modified_base (434)..(437): a, c, t, g, unknown or other
  misc_feature (434)..(437): n is a, c, g, or t
tcagactactatgtcacgaccggtgctcgatttagtagtcgcataaagggaaagggactggagtggattggccatatctacgccaatgggagaaccaggtacaacccctccctccagagtcgagtcaccatttcactggacccgtccaagaaccaattgtccctgagtctgaattctgtgaccgccgcagacacggccacttattactgtgcgagagaggcgcagtggccgcaactaagtcgtttctactattatggtatggacgcctggggccgagggaccacagtcaccgtctcctcagcctccaccaagggcccatcggtcttccccctggcaccctcctccaagagcacctctggggcacagcggcctgggctgcctggtcaaggactacttccacatagtagtctgagcgggctggcaaggcgcatagnnnn

SEQ ID NO: 51006 - DNA, 541 bp, Homo sapiens
  misc_feature: GYAE6OF02JE4KX.24.62.F07.1.454.CMB.1.raw
  modified_base (454)..(454): a, c, t, g, unknown or other
  misc_feature (454)..(454): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtggctccatcaatagtggtacttactattggagctggatccggaagcccgcgggaagggactggagtggattggccatatctacgccaatgggagaaccaggtacaacccctccctccagagtcgagtcaccatttcactggaccctcaagaaccaattgtccctgagtctgaattctgtgaccgcgcagacacggccacttattactgtgcgagagaggcncagtggccgcaactaagtcgtttcacttattatggtatggacgccgttggggccaggggacccacgggtcacccggttctccctacg

SEQ ID NO: 51007 - DNA, 444 bp, Homo sapiens
  misc_feature: GYAE6OF02JFE8H.24.62.F07.1.454.CMB.1.raw
  modified_base (436)..(444): a, c, t, g, unknown or other
  misc_feature (436)..(444): n is a, c, g, or t
tcagactactatgtcacgaccggtgctcgatttagtagtcgcataaagggaagggactggagtggattggccatatctacgccaatgggagaaccaggtacaacccctccctccagagtcgagtcaccatttcactggacccgtccaagaaccaattgtccctgagtctgaattctgtgaccgccgcagacacggccacttattactgtgcgagagaggcgcagtggccgcaactaagtcgtttcactattatggtatggacgcctggggccgagggaccacggtcaccgtctcctcagcctccaccaagggcccatcggtcttccccctggccaccctcctccaagacgcacctctgggggcacagcggccctgggctgcctggtcaaggactacttccacatagtagtctgagcgggctggcaaggcgcatagnnnnnnnnn

SEQ ID NO: 51008 - DNA, 550 bp, Homo sapiens
  misc_feature: GYAE6OF02GAIWJ.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatagtggtacttactattggagctggatccggaagcccgccgggaaggctggagtggattggccatatctacgccaatgggagaaccaggtaccaacccctccctccagacgtcgagtcaccatttcactcggaccgtaccaagaaccaattcgtccctgacgtctagaacttctgtgaccaccgcagacacgccacttattactgtgcgagagagcgcagtcggccgacaactagtcgtttactactattagtggtatggaacgtccgtggggccgacgggaccgacggtccaccgttctccctacg

SEQ ID NO: 51009 - DNA, 531 bp, Homo sapiens
  misc_feature: GYAE6OF02JGJCH.24.62.F07.1.454.CMB.1.raw
  modified_base (200)..(200): a, c, t, g, unknown or other
  misc_feature (200)..(200): n is a, c, g, or t
  modified_base (216)..(216): a, c, t, g, unknown or other
  misc_feature (216)..(216): n is a, c, g, or t
  modified_base (403)..(403): a, c, t, g, unknown or other
  misc_feature (403)..(403): n is a, c, g, or t
  modified_base (485)..(485): a, c, t, g, unknown or other
  misc_feature (485)..(485): n is a, c, g, or t
  modified_base (497)..(497): a, c, t, g, unknown or other
  misc_feature (497)..(497): n is a, c, g, or t
  modified_base (525)..(525): a, c, t, g, unknown or other
  misc_feature (525)..(525): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagcctttnacagaccctgtccctnacttgcactgtctctggtgctccatcaatgtggtacttacattggagctggatccggaagccgcggaaggctggagtggattggccatatctagccaattgggagaaccaggttacaacccctcctccagagttcgagtcaccatttcgactggaccgtcaagaccaattgccctgatctgaattcngtgaaccgcgcagacaggcctattattacgtgtgacgagagaggcgcagttggccgactaactaagtcgtttcactagttangggtatcggacncctggggaccagggcctaggtcacggtncctacg

SEQ ID NO: 51010 - DNA, 549 bp, Homo sapiens
  misc_feature: GYAE6OF02IATLU.24.62.F07.1.454.CMB.1.raw
  modified_base (407)..(407): a, c, t, g, unknown or other
  misc_feature (407)..(407): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcggcccaggactggtgaagccttcacagaccctgtccctcacttgcactgtctctggtgctccatcaatagtggtacttactattggagctggatccggaagcccgcgggaaggactggagtggatgggccatatctacgccaatgggagaaccaggtaccaacccctcctccagagtcgagtcacatttcactggaccctcaagaccaattgccctgagtctgaattctgtnaccgccgcagaccacggcccaactttacttacgtgtgcgagagacggcgcagtcggccgtacaactaagtccgtttactacttattagtggtatcggacggtccttggggcccgagggacccacggtcaccgtcctcctacg

SEQ ID NO: 51011 - DNA, 610 bp, Homo sapiens
  misc_feature: GYAE6OF02H2LYO.24.62.F07.1.454.CMB.1.raw
  modified_base (215)..(215): a, c, t, g, unknown or other
  misc_feature (215)..(215): n is a, c, g, or t
  modified_base (252)..(252): a, c, t, g, unknown or other
  misc_feature (252)..(252): n is a, c, g, or t
  modified_base (303)..(303): a, c, t, g, unknown or other
  misc_feature (303)..(303): n is a, c, g, or t
tcagactactatgtcacgaccggtgctcgatttagtagtcgcataaagggaaagggtactgtgaaggcttcaccagtcctggacctcctgtgcaagaacatgaaacatctgtggttcttcctcctcctggtggcagctcccagatgggtcctgtcccaggttcaacttcaggatcgggcccaggactggtgaagccttcacagaccctgtccctnacttgcactgtctctggtgctcatcaatgtgacttanattggagctggatccggaagcccgcgggaaggactggagtgattggcatanctacgcagtggagaccaggtaccaccctcctacagacgtacgagtcaacctatttcactaggacccgttcaaataccaattcgaccctgagtctgtaacttcgtgcgtacgccgtacacggacaccggtaccactttaacttctaggttcgacggtaagacgaacgggtccgcgaacggtcggccgtaactaacgtaacgttaccgtttacctaacgttactttagttacgggacttagggaacctcccggtaggggtacccgtaagggggacccacgggttacccgaccgttccgaccgttaccgg

SEQ ID NO: 51012 - DNA, 594 bp, Homo sapiens
  misc_feature: GYAE6OF02HKI7S.24.62.F07.1.454.CMB.1.raw
  modified_base (327)..(327): a, c, t, g, unknown or other
  misc_feature (327)..(327): n is a, c, g, or t
  modified_base (470)..(470): a, c, t, g, unknown or other
  misc_feature (470)..(470): n is a, c, g, or t
  modified_base (476)..(476): a, c, t, g, unknown or other
  misc_feature (476)..(476): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtggctccatcaatgtggtacttactattggagctggatccggaagcccgcgggaaggactggagtggattggccatatctacgccaagtgggaanaaccaggtaccaacccctccctaccagagtcgagtccacctatttcactcggacccgtccaaagaacctaattcgtccctaggacgttctgaatttcgtgtcgacccgcgcagaccacggcctaactttattactgtgcgagngaggcngacggtggcccgacaaacgttagtccgttttacacttagtttagtgggttaatcgggaccgtccggttcgggggacccgtacggggacccacgggttaccacccggttctcccgtacg

SEQ ID NO: 51013 - DNA, 442 bp, Homo sapiens
  misc_feature: GYAE6OF02IJNWB.24.62.F07.1.454.CMB.1.raw
  modified_base (438)..(442): a, c, t, g, unknown or other
  misc_feature (438)..(442): n is a, c, g, or t
tcagactactatgtcacgaccggtgctcgatttagtagtcgcataaagggaagggactggagtggattggccatatctacgccaatgggagaaccaggtacaacccctccctccagagtcgagtcaccatttcactggacccgtccaagaaccaattgtccctgagtctgaattctgtgaccgccgcagacacggccacttattactgtgcgagagaggcgcagtggccgcaactaagtcgttttctactattatggtatggacgcctggggccgagggaccacggtcaccgtctcctcagcctccaccaagggcccatcggtcttccccctgacaccctcctccaagagcacctctgggggcacgacgcggccctgggctgcctggtcaaggactacttccacatagtagtctgagcgggctggcaaggcgcatagnnnnn

SEQ ID NO: 51014 - DNA, 537 bp, Homo sapiens
  misc_feature: GYAE6OF02I8E8V.24.62.F07.1.454.CMB.1.raw
  modified_base (328)..(328): a, c, t, g, unknown or other
  misc_feature (328)..(328): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtggctccatcaatagtggtacttactattggagctggatccggaagcccgccgggaaggactggagtggattgggccatatctacgccaatggganaaccaggtacaacccctccctccagagtcgagtcaccatttcactggaccctcaagaaccaattcgtccctgacgtctgaattctgtgaccgccgcacgacacggccactttatactgtgacgagagaggcgcgagtggccgcaactagtcgtttcacttattatggtatggacgtccgtgggccgagggccacggtcaccgtctctcg

SEQ ID NO: 51015 - DNA, 544 bp, Homo sapiens
  misc_feature: GYAE6OF02IAAB0.24.62.F07.1.454.CMB.1.raw
  modified_base (328)..(328): a, c, t, g, unknown or other
  misc_feature (328)..(328): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtggctccatcaatagtggtacttactattggagctggatccggaagcccgccgggaagggactggagtggattggccatatctacgccaatggganaaccaggtacaacccctcctccagagtcgagtcaccatttcactgacccgtcaagaccattgccctgagtctgtaattctgtgaccgcgcagacacggccactttatactgtgcgaagagaggcgcaggtcggcccgacaacgtagtcgtttacacttattagtggtatggaccgccgtggggccgagggacccacgggtccaccgttcctcctcg

SEQ ID NO: 51016 - DNA, 442 bp, Homo sapiens
  misc_feature: GYAE6OF02IZB8N.24.62.F07.1.454.CMB.1.raw
  modified_base (417)..(417): a, c, t, g, unknown or other
  misc_feature (417)..(417): n is a, c, g, or t
  modified_base (429)..(429): a, c, t, g, unknown or other
  misc_feature (429)..(429): n is a, c, g, or t
  modified_base (434)..(442): a, c, t, g, unknown or other
  misc_feature (434)..(442): n is a, c, g, or t
tcagactactatgtcacgaccggtgctcgatttagtagtcgcataaagggaagggactggagtggattggccatatctacgcgaatgggagaaccaggtacaaccctccctccagagtcgagtcaccatttcactggacccgtccaagaaccaattgtccctgagtctgaattctgtgaccgccgcagacacggccacttattactgtgcgagagaggcgcagtggccgcaactaagtcgtttcactattatggtatgggacgcctggggccgagggaccacggtcaccgtctcctcagcctcaccaagggcccatcggtctccccctggcaccctcctccaagacgcacctctgggggcacagcggccctgggctgcctggtcaagggctacttccacatagtagtctgagcgggntgggcaaggcgnatagnnnnnnnnn

SEQ ID NO: 51017 - DNA, 560 bp, Homo sapiens
  misc_feature: GYAE6OF02G136T.24.62.F07.1.454.CMB.1.raw
  modified_base (419)..(419): a, c, t, g, unknown or other
  misc_feature (419)..(419): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatagtggtacttactattggagctggatccggaagcccgcgggaaggactggagtggattggcatatctacgccaatgggagaaccaggtaccaacccctccctaccagacgtcgagtcacctatttcactcggacccgtcaacgaaccaattcgtccccgtagtctagaactttcngtcgaccgcgcacgaccacgccacttattacgtgtcgacgagagaggcgcgaggtcggaccgacaacgttacgtcgtttacacttattagtggtatcggacgtcgtcgggccgaggaccacggtcaccgtctcctcgaccg

SEQ ID NO: 51018 - DNA, 460 bp, Homo sapiens
  misc_feature: GYAE6OF02HBL0N.24.62.F07.1.454.CMB.1.raw
  modified_base (353)..(353): a, c, t, g, unknown or other
  misc_feature (353)..(353): n is a, c, g, or t
  modified_base (408)..(408): a, c, t, g, unknown or other
  misc_feature (408)..(408): n is a, c, g, or t
  modified_base (443)..(460): a, c, t, g, unknown or other
  misc_feature (443)..(460): n is a, c, g, or t
tcagactactatgtcacgaccggtgctcgatttagtagtcgcataaagggaagggactggagtggattggccatatctacgccaatgggagaaccaggtacaacccctccctccagagtcgagtcaccatttcactggacccgtccaagaaccaattgtccctgagtctgaattctgtgaccgccgcagacacggccacttattactgtgcgagagaggcgcagtgggccgcaactaagtcgtttctactattatggtatggacgcctggggccgaggggaccacgggtcaccgtctcctcagcctccaccaagggcccatcggtcttccccctggccacccctcctccaagngcacctctgggggcacacgcggccctgggctgcctggtcaaggactacttccacntagtagtctgagcgggctggcaagggcgcagtagnnnnnnnnnnnnnnnnnn

SEQ ID NO: 51019 - DNA, 739 bp, Homo sapiens
  misc_feature: GYAE6OF02H0S7C.24.62.F07.1.454.CMB.1.raw
  modified_base (337)..(337): a, c, t, g, unknown or other
  misc_feature (337)..(337): n is a, c, g, or t
tcagactactatgtcacgaccggtgctcgatttagtagtcgcataaagggaaagggtcgttcgtgtaaggcttctaccaaggtcctcggacctcctgtgcaagaaacagtggaaacatcggtgtggtttcttccctcctccttggggtcggcagctcccacgatgggtcctgtccccaggttcaacttcaggtagtcgggcccaggtacgtggtgaagtccgttccacagtaccccttgtacccgtacgacttggctacgtgtcctactggttcggcgtaccgagtcgaaattaaagtggttaccttacgtattggagtcgtgggactccggtaacncccccggacgggtaacggacctgggaagtacggaacgttaccggaacctataacgttcgtaaccgccctaaagtacggggaactaaccgaaccgggtaccctaaccccgtaccctaccgacggaacgtacgacggtcctaacgtatttacacgttcggtacccgtaccaaaggtaaacctaatttccggtaccctagtaacgttcgtagtaactttcgtggtacgaccgccgtcagtaccacggcctacgttacgtactgtacgcgtaggacgacggtccgtactacgtcggcccaccgtaaacgtaacggttccgttactacgttaccttacgtacggtctccggtacgccggtacgggacccggacggacccaccggttaccgaccgtcctacccgtacg

SEQ ID NO: 51020 - DNA, 634 bp, Homo sapiens
  misc_feature: GYAE6OF02GXY3C.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatagtggtacttactattggagctggatccggaagcccgccgggaagggactggagtggattgggccatatctacgccaagtgggagaaccaggtaccaacccctccctaccagacgtcgagtcacctatttcactcggacccgtcaaacgaaccaattcgtccctagacgtctagtaatttcgtgtacgaccgccgcacgacacggacctaactttacttactgtcgcgagagaggcgacgaggtcggccgacgtaaacgttaacgttaccgttttacctaacttagtttaagttacgggttaacgttacggaccggtacccgttacggggggacccgacggggaacccgtaccgggttacccgtaacccgggttcctaccccgtacccgg

SEQ ID NO: 51021 - DNA, 638 bp, Homo sapiens
  misc_feature: GYAE6OF02ID6S8.24.62.F07.1.454.CMB.1.raw
  modified_base (431)..(431): a, c, t, g, unknown or other
  misc_feature (431)..(431): n is a, c, g, or t
  modified_base (485)..(485): a, c, t, g, unknown or other
  misc_feature (485)..(485): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtggctccatcaatagtggtacttactattggagctggatccggaagcccggccggggaagggactggaggtggattggccatatctacgccaagtgggagaaccaggtaccaacccctccctaccagacgtcgagtacaccatttccactcggacccgtacaaagaaccaattcgtaccctgacgttctagaactttcngtcgacccgcgtcagaccaccggcctaactttattactggtagccgagaacggnggaccgcgaggttcgggacccgactaaaccgtttaacggtccgttttaccgttaacttagtttaacgttaggtaagttcgggaaccgtccggtggggggacccgacggggtacccgtaccgggttcccgtaacccggttcctacccgtaccgg

SEQ ID NO: 51022 - DNA, 674 bp, Homo sapiens
  misc_feature: GYAE6OF02G9J5Z.24.62.F07.1.454.CMB.1.raw
  modified_base (263)..(263): a, c, t, g, unknown or other
  misc_feature (263)..(263): n is a, c, g, or t
  modified_base (323)..(323): a, c, t, g, unknown or other
  misc_feature (323)..(323): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatagtgtacttactattgganctggatccggaagcccgcgggaaggctggagtggattggccatatctacgccaagtgganaaccaggtaccaacccctcctaccagacgtcgagtcacctatttcacgtcggacccgtcaaacgaacctaattcgtaccctagacgtctagtaactttcgtgtcgacccgtcgacacgaccgacggcctaactttacttactgtcgacgagagaggtacgcgaaggtcggacccgactaaaccggtttaaacggttccggtttttacctaaccgttttaagttttaacgttacgggtttaacgttacggggtaacccggttcccggttacgggggggtaccccgaaaggggggtaccccctaaccgggggttacccctaacccccggtttccgttacccccgttaacccgg

SEQ ID NO: 51023 - DNA, 654 bp, Homo sapiens
  misc_feature: GYAE6OF02HTAE8.24.62.F07.1.454.CMB.1.raw
  modified_base (265)..(265): a, c, t, g, unknown or other
  misc_feature (265)..(265): n is a, c, g, or t
  modified_base (328)..(328): a, c, t, g, unknown or other
  misc_feature (328)..(328): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtggctccatcaatagtggtacttactattgganctggactccggaagcccgcgggaaggactggagtggattggccatatctacgccaagtggganaaccaggtaccaacccctcctacagacgtcgagtcacctatttcactggacccctcaagaaccctattcgccctgagtctgaactttcgtgtacgaccgcgtcagaccgacggcctaactttactacttggtcgacggacgaggtaacggccgacgtaggtggcccgacgtaaaccgttaacggttccgttttactaaccgttattttacgtaggggttaacgtaccgggtaacggtcccgggttaacggggggccccggtaacggggggtaccccgtaaccggggtttaccccaacccggggtttcccgttaccccgttacccgg

SEQ ID NO: 51024 - DNA, 656 bp, Homo sapiens
  misc_feature: GYAE6OF02GEAZJ.24.62.F07.1.454.CMB.1.raw
  modified_base (326)..(326): a, c, t, g, unknown or other
  misc_feature (326)..(326): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatagtggtacttactattggagctggatccggaagcccgcgggaaggctggagtggattgggccatatctacgccaagtggganaaccgaggtaccaacccctccctccagacgtcgagtccacctatttcactcggaccctcaaacgaaccaattcgtaccctgacgttctagtaactttcgtgtcgaccgccgacagaccaccggcctaactttattactgtcgcgagacgagggccgacgaggttcgggacccgtacgtaaaccgttaacggtttccgttttactaaccgtttagtttaacgtagggtttaacgtcgggtaacccggtcccggttacgggggggacccgtaaccggggggaccccttaaccggggttacccgtaaccccgggtttcccttcccgtacccgg

SEQ ID NO: 51025 - DNA, 604 bp, Homo sapiens
  misc_feature: GYAE6OF02ILI91.24.62.F07.1.454.CMB.1.raw
tcagactactatgtcacgaccggtgctcgatttagtagtcgcataaaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtcccctcacttgcactgtctctggtggctccatcaatagtggtacttactattggagctggatccggaacgcccgccgggaagggactggagtggattggccagtatctacgccaagtgggagaaccaggtaccaacccctcccctaccagagtcgagtcaccatttccacttcggacccgtccaaacgaacccaaatttcgtacccctgacgtctacgtaatttctgtcgaccgccgacagaccacggcctaactttacttactgtcgacggagaggaggcgacgaggtcggaccgacaaactagttccgttttcacttatttagtggttataggaccggtccggtacggggcccgagggtaccgaaccgggtccacccgttcgtccctaccg

SEQ ID NO: 51026 - DNA, 553 bp, Homo sapiens
  misc_feature: GYAE6OF02GF4K8.24.62.F07.1.454.CMB.1.raw
  modified_base (475)..(475): a, c, t, g, unknown or other
  misc_feature (475)..(475): n is a, c, g, or t
  modified_base (489)..(489): a, c, t, g, unknown or other
  misc_feature (489)..(489): n is a, c, g, or t
  modified_base (547)..(547): a, c, t, g, unknown or other
  misc_feature (547)..(547): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtggctccatcaatagtggtacttactattggagctggatccggaagccccgcggggaaggactggaggtggattggccatatctacgccaatgggagaaccaggtaccaacccctccctccagagtcgagtcaccatttcactggacccgtcaaacgaaccaattcgtccctgacgtctgaattctgtcgacccgccgacagacacggccacttattactgtgcgagagaggcgcagtggccncaaactagtcgttntacttattatggtatgggacgtccgtggggccgacgggaccacgggtcacccggttcnccgtcg

SEQ ID NO: 51027 - DNA, 634 bp, Homo sapiens
  misc_feature: GYAE6OF02HGX94.24.62.F07.1.454.CMB.1.raw
  modified_base (330)..(330): a, c, t, g, unknown or other
  misc_feature (330)..(330): n is a, c, g, or t
  modified_base (496)..(496): a, c, t, g, unknown or other
  misc_feature (496)..(496): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctcgtggtgctccatcaatgtgtacttactattggagctggactccggaagcccggacgggaaggacgtggagtggattggccatatctacgccaagtgggaanaaccgaggtaaccctaacccctcccctaccaagacgtaccgagtccacctatttccaacgtcggaccctaccaaacgaacctaagttccgtccctaggacgtctagtaacttctacgtcgacccgccgcacgaccacggctaactttacttacgtgtacgcgaagngacggccgtacgaggtcggaccgactaaacgttacgttcctttacgacttagtttacgttggttaacgtcggaccggtccgggtggggacccggtaaggggacccgtacggttacccacccggttcctacccgtacgg

SEQ ID NO: 51028 - DNA, 634 bp, Homo sapiens
  misc_feature: GYAE6OF02GZL4K.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatagtgtacttactattggagctggatccggaagcccgcgggaaggactggagtggattggccatatctacgccaatgggacgaaccaggtaccaacccctcctccagacgtcgagtccaccgtattcactcggacccgtccaaagaacccaattgtaccctgacgtctagaactttctgtcgaccgccgcaagaccacggcctacttattactgtgccgagtagacggcgcgagtcggacccgactaaacgtaaggttccgtttttaccaactttacgttaacttcggggtaactttacggggaaccgtcccggttacggggggaccccggtaaagggggttacccctaaccggggtttacccaacccgggtttcctaccccgtaacccgg

SEQ ID NO: 51029 - DNA, 708 bp, Homo sapiens
  misc_feature: GYAE6OF02ILAUA.24.62.F07.1.454.CMB.1.raw
  modified_base (611)..(611): a, c, t, g, unknown or other
  misc_feature (611)..(611): n is a, c, g, or t
tcagactactatgtcacgaccggtgctcgatttagtagtcgcataaagggaaagggtctgtgaaggcttcaccagtcctggacctcctgtgcaagaacatgaaacatctgtgttcttcctcctcctggtggcagctcccagatggtctgtcccaggttcaacttcaggagtcgggcccaggactggtgaagccttcgacagaccctgtccctcacgttcgcacttgtccttcgttggtcggcctaccataccaattaggttcggtacctttattacgttggagcgttaggacttaccggaacgccccggacggggaacgggacgtgggaaggtggtacgtttcgggacctagttactccgtacggaccctaagtcggggaacgaaaccgtacggaaccctaacccccgtcccgtaccaggtacgccggacgtaaccaccttaccgtttacacggtcccggtaaccccgtaccgaaaacggtaaccctaaacgtttcccggtaccctagtaaccgttccgttacgtaaacttttccgtacgttcgaccccggtccgtcgaacgaccgtaccggacctaacgtttacttaccgtgtcgcgtagagagccgtanagtcggccgtacgaacgttacgtccgtttataccgttattagtcggtaatggaccgcgtggggacctagggccacgggtcaccgttcgtaccgtccg

SEQ ID NO: 51030 - DNA, 439 bp, Homo sapiens
  misc_feature: GYAE6OF02F6BSM.24.62.F07.1.454.CMB.1.raw
  modified_base (434)..(439): a, c, t, g, unknown or other
  misc_feature (434)..(439): n is a, c, g, or t
tcagactactatgtcacgaccggtgctcgatttagtagtcgcataaagggaagggactggagtggattggccatatctacgccaatgggagaaccaggtacaacccctccctccagagtcgagtcaccatttcactggacccgtccaagaaccaattgtccctgagtctgaattctgtgaccgccgcagacacggccacttattactgtgcgagagaggcgcagtggccgcaactaagtcgtttctactattatggtatggacgcctggggccgagggaccacggtcaccgtctcctcagcctccaccaagggcccatcggtcttccccctggcaccctcctccaagagcacctctggggcatagcggccctgggctgcctggtcaaggactacttccacatagtagtctgagcgggctggcaaggcgcatagnnnnnn

SEQ ID NO: 51031 - DNA, 433 bp, Homo sapiens
  misc_feature: GYAE6OF02GCSMZ.24.62.F07.1.454.CMB.1.raw
  modified_base (433)..(433): a, c, t, g, unknown or other
  misc_feature (433)..(433): n is a, c, g, or t
tcagactactatgtcacgaccggtgctcgatttagtagtcgcataaagggaagggactggagtggattggccatatctacgccaatgggagaaccaggtacaacccctccctccagagtcgagtcaccatttcactggacccgtccaagaaccaattgtccctgagtctgaattctgtgaccgccgcagacacggccacttattactgtgcgagagaggcgcagtggccgcaactaagtcgtttctactattatggtatggacgcctggggccgagggaccacggtcaccgtctcctcagcctccaccaagggcccatcggtcttccccctggcaccctcctccaagagcacctctggggcacagcggccctgggctgcctggtcaaggactacttccacatagtagtctgagcgggctggcaggcgcatagn

SEQ ID NO: 51032 - DNA, 569 bp, Homo sapiens
  misc_feature: GYAE6OF02GKOD5.24.62.F07.1.454.CMB.1.raw
  modified_base (328)..(328): a, c, t, g, unknown or other
  misc_feature (328)..(328): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatagtggtacttactattggagctggatccggaagcccgccgggaaggactgggagtggattggccatatctacgccaagtggganaaccaggtaccaacccctcctccagacgtcgacgtcacctatttcactcggacccgtacaagaaccaattcgccctgagtctgtaatttctgtcgaccgtccgacagaccacggcctacgttacttactgtgcgagacgaggcgacgtaggtcggccgacaaacgttaacgtcgtttacagttattagtggttaatggaccgccgtggggaccgagggacccacggtcaccgttctcctcg

SEQ ID NO: 51033 - DNA, 711 bp, Homo sapiens
  misc_feature: GYAE6OF02GK31O.24.62.F07.1.454.CMB.1.raw
tcagactactatgtcacgaccggtgctcgatttagtagtcgcataaaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctcgtggtgctccatcaatgtgtacttactattgagctggatccggaagccgcgggaaggactgggagtggagttggccagtactcgtacgccaagtgggaacaaccgaggtaccaacccctcctaccagacgtacgacgtaccacctactttacactcggacccgtaccaaacgaacccgtaacttccgtaccccttaggacgttaccgttagtaaactttcgtacggttaccggacccgtccggactaacggacccgaaccgggtacccttaacgtttacgtttaaccgtcggttacgcggtaacggtacggacggccgaccgtaggtaccggacccgtacgaaaccgttacggttaccgtttacgtaaccgttagtttaacggtgggttaacttcgggtaaacccgtccggttaccgggggccggtaaacgggcccgttaacccgggtaccgtaacccggtttcccgtacccgttacccgg

SEQ ID NO: 51034 - DNA, 613 bp, Homo sapiens
  misc_feature: GYAE6OF02I5KGS.24.62.F07.1.454.CMB.1.raw
  modified_base (418)..(418): a, c, t, g, unknown or other
  misc_feature (418)..(418): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtggctccatcaatgtggtacttactattggagctggatccggaagcccgcgggaaggctggagtggattgggccatatctacgccaatgggagaaccaggtaccaacccctcctccagacgtacgagtcaccatttcactcggacccgtccaagaccaattcgtccctagacgtctagaacttcgngtaggtacccgccgacacgaccaccgggaccaactttacttaccgttggacgtccggtaagaaggacggtacgacgtacggtcgggccgactaaaccgtagttccgtttacctaacttatttaatgtttagtggaaccgtccggtaggggacccgaaggggtacccaccgggttcaacccggttctcccgtaccg

SEQ ID NO: 51035 - DNA, 562 bp, Homo sapiens
  misc_feature: GYAE6OF02H5MKI.24.62.F07.1.454.CMB.1.raw
  modified_base (465)..(465): a, c, t, g, unknown or other
  misc_feature (465)..(465): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatagtggtacttactattggagctggatccggaagcccgcgggaaggactggagtggattcggccatatctacgccaagtgggagaaccaggtaccaacccctcctccagagtcgagtcaccatttcactggaacctcaagaacaattcgccctagacgtctgaactttctgtcgaccgccgtagaacgacacggccactttatactgtgcgagagacggtcncagtcggccataacgtagttcgtttacacttagttagtcggtatcggacgtccggttcggggccgacgggaccaccggtcaccgttccgtcctaccg

SEQ ID NO: 51036 - DNA, 546 bp, Homo sapiens
  misc_feature: GYAE6OF02GZI5B.24.62.F07.1.454.CMB.1.raw
  modified_base (456)..(456): a, c, t, g, unknown or other
  misc_feature (456)..(456): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatagtgtacttactattggagctggatccggaagccccgccgggaagggactggacgtggattgggccatatctacgccaatgggagaaccaggtacaacccctcctccagagtcgagtcaccatttcactggaccctcaagaccattgccctgacgtctgaattctgtgaccgccgcagaccacggccacttattactgtgcgtagagaggcncagtcggccgacaaactagttcgtttactactattatggtatcggacgtccgtggggccgagggacccacgggtcaccgtctcccgtacg

SEQ ID NO: 51037 - DNA, 675 bp, Homo sapiens
  misc_feature: GYAE6OF02F1XPG.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttccgtcctcctggtggcagctcccagactgggtcctgtcccaggttcaacttcaggagtcggcccaggactggtgaagccttcacagaccctgtccctcacttgcactgtctcgtggtcgctccatcaatagtggtacttactattggagctggatccggaacgcccggcgggaaggctggagtggattggccatatcctacgccaagtgggaacaaccgaggtaccaacccctcctaccagacgtcgagtccaactactttaccacgtcggaacccgtaccaaacgtaaaccctaagttccgtaccccttagacgttcttacgtaactttccgtacgggttcgaacccgtccggactaacggaacccgaccggtaccttaactttactttaccgtgtcggacgacggaacggtacgggaccgtctaacgggggttcacccgactaaaccgttaagttccgtttactacttagttacgtacggttacgtcggtaccgtccgtagggggcccgaacggggtaccctaccgggtaccgacccggttccgtacccgtaccg

SEQ ID NO: 51038 - DNA, 668 bp, Homo sapiens
  misc_feature: GYAE6OF02HUJRJ.24.62.F07.1.454.CMB.1.raw
  modified_base (265)..(265): a, c, t, g, unknown or other
  misc_feature (265)..(265): n is a, c, g, or t
  modified_base (327)..(327): a, c, t, g, unknown or other
  misc_feature (327)..(327): n is a, c, g, or t
tcagactactatgtcacgaccggtgctcgatttagtagtcgcataaaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctcgtggtgctcatcaatagtgtacttatagttggagntgagtccggaacgcccggacgggaaggacgtgggagtggattggcatatcacgcagtggganaaccgaggtaccacccctcctcgacgacgcgacgtaccactattcacgttcggacccgtacaaacgaacctaagttccgtacctagtacgttctacgtaactttccgtaggtccgacccggtccgacacggtaacccgaccggtcccttaacttttacgttacgttggtacgacggaaggtacggacgggaccgtcgtaaggtccgggacccgtaacgaaaccgttaggttccgttttactaacgttatttacggtaggtaacggtacgggaccggtcccggtacgggggacccgacggggtaccccgtacgggtcccgtaaccggttccgtccccgtacg

SEQ ID NO: 51039 - DNA, 609 bp, Homo sapiens
  misc_feature: GYAE6OF02F634W.24.62.F07.1.454.CMB.1.raw
  modified_base (323)..(323): a, c, t, g, unknown or other
  misc_feature (323)..(323): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatgtgtacttactattggagctggatccggaagcccgcgggaaggctggagtggattggccatatctacgccaagtggganaaccaggtaccaacccctcctaccagacgtcgagtccactactttcactcggacccgtaccaaagaacctaattcgtccctagacgtctagaatttcgtgtacgacccgccgacacgaccacggcctaacttattactgtgacgtagagacggcgcgaggtcggaccgacaaacgtaaggttccgtttactaactttattagtaggttactagggacccgtccggttgggggacccggaacggggtacccgtaccgggtcctacccggttaccgtccccgtaaccg

SEQ ID NO: 51040 - DNA, 681 bp, Homo sapiens
  misc_feature: GYAE6OF02H11AI.24.62.F07.1.454.CMB.1.raw
tcagactactatgtcacgaccggtgctcgatttagtagtcgcataaaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatgtggtacttactattggagctggatccggaacgcccggaccgggaagggactgggagtggattggccatatctacgccaatgggacaaccacggtaccaacccctccctccagacgtcgagtcacctatttccactcggacccgtaccaaacgaacctaattcgtcccgtagtacgttctaggtaactttcgtggttacgacccgccgacgacgaaccgaccggcccttaacgtttacttaccgttgtcggacgaaggtaggacgggacgaccgtacggtcggacccggtaactaaacgttaacggttaccgttttaccgtaactttagtttacgttcgggttaagttccgggtaaccgttcccgggtacgggggtacccggaacggggtaccccgtaaccggggttacccaacccggttcctaccccgttaccgg

SEQ ID NO: 51041 - DNA, 671 bp, Homo sapiens
  misc_feature: GYAE6OF02HJN7I.24.62.F07.1.454.CMB.1.raw
  modified_base (660)..(660): a, c, t, g, unknown or other
  misc_feature (660)..(660): n is a, c, g, or t
tcagactactatgtcacgaccggtgctcgatttagtagtcgcataaaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatagtggtacttactattggagctggatccgggaagcccggaccgggaaggactggagtggattggccatatctacgccaagtgggaacaaccgacggtaccaaccccctccctaccgaagacgtcgagtccacctatttccactcggacccgtaccaaagaaccaattcgtaccctgacgtctagaactttcgtgtcgacccgcgacacgaccgaccggacctaacgtttactttaccgtgtcgaccggaagacggacggtacgacgtaggtcgggacccgtactaaacgttaaacggttccgttttactaacgttacgttttagttacgggttaataccgggaaccggttcccggtacgggggggtacccgtaacgggggaacccctaccggggttacccgaacccggtttcccncccctaaccgg

SEQ ID NO: 51042 - DNA, 603 bp, Homo sapiens
  misc_feature: GYAE6OF02FE9QW.24.62.F07.1.454.CMB.1.raw
  modified_base (264)..(264): a, c, t, g, unknown or other
  misc_feature (264)..(264): n is a, c, g, or t
  modified_base (331)..(331): a, c, t, g, unknown or other
  misc_feature (331)..(331): n is a, c, g, or t
  modified_base (501)..(501): a, c, t, g, unknown or other
  misc_feature (501)..(501): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatagtggtacttactattgganctggatccggaagcccggccgggaagggactgggagtggagttggccatatctacgccaagtggganaaccgaggtaccaacccctccctaccagagtcgagtccactatttcacgtcggaccctacaaagaacctaattcgtccctaggacgttctagtaacttctgtcgacccgccgcagaccacggtacctacttacttactgtcgacgagagaggcgcgaggtcggaccgtanaaacctaagttcgttttacacgttacttagtggttaactcggaacgtccggtaggggaccgacggggtaccctaacggggtccacccggttctacccgtacg

SEQ ID NO: 51043 - DNA, 443 bp, Homo sapiens
  misc_feature: GYAE6OF02IQID2.24.62.F07.1.454.CMB.1.raw
  modified_base (175)..(175): a, c, t, g, unknown or other
  misc_feature (175)..(175): n is a, c, g, or t
  modified_base (262)..(262): a, c, t, g, unknown or other
  misc_feature (262)..(262): n is a, c, g, or t
  modified_base (431)..(443): a, c, t, g, unknown or other
  misc_feature (431)..(443): n is a, c, g, or t
tcagactactatgtcacgaccggtgctcgatttagtagtcgcataaagggaagggactggagtggattggccatatctacgccaatgggagaaccaggtacaacccctccctccagagtcgagtcaccatttcactggacccgtcaagaaccaattgtccctgagtctgaattcngtgaccgcgcagacacggccacttattactgtgcgagagaggcgcagtggccgcaaactaagtcgtttcactattatggtatggacnctgggccgagggaccacggtcaccgtctcctcagcctcaccaaggcccatcggtcttccccctggccaccctcctccaagagcacctctgggggcacgagcgccctgggctgccgtggtcaaggactacttccacatagtagtctgagcgggctggcaaggcgcatagnnnnnnnnnnnnn

SEQ ID NO: 51044 - DNA, 638 bp, Homo sapiens
  misc_feature: GYAE6OF02ILFRT.24.62.F07.1.454.CMB.1.raw
  modified_base (354)..(354): a, c, t, g, unknown or other
  misc_feature (354)..(354): n is a, c, g, or t
  modified_base (423)..(423): a, c, t, g, unknown or other
  misc_feature (423)..(423): n is a, c, g, or t
tcagactactatgtcacgaccggtgctcgatttagtagtcgcataaaagggaaagggtctgtgaaggcttcatcagtcctggacctcctgtgcaagaacatgaaacatctgtggttcttcctcctcctggtggcagctcccagatgggtcctgtcccaggttcaacttcaggagtcgggcccaggactggtgagccttcacagaccctgtccctcacttgcactgtctctggtgctccatcaatagtggtacttactattggagctggattcggagccccgcggggaagggactggagtggattggccatatctacgccaagtgggagaaccaggtaccaacccctcctccagngtcgagtcacctatttcactcggaccctcaaacgaccaacttcgtccctagacgtcctaggaactttcnggtacgacccgccgtacacggacgaaccggtccctaacttacttactgtcgacgagacgacggcgacgacggtcggaccgtcaaacgttaaccgggttccgtttttaccacgttaagttttcgtaagggttacgtacgggaacccgttcccggtacggggggtcccggaacggggtaccccgtaaccggggtccctacccgggttcttaccccgg

SEQ ID NO: 51045 - DNA, 634 bp, Homo sapiens
  misc_feature: GYAE6OF02I426O.24.62.F07.1.454.CMB.1.raw
  modified_base (267)..(267): a, c, t, g, unknown or other
  misc_feature (267)..(267): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactgggtgaagcctttcacagacccctgtccctcacttgcactgtctctggtgctccatcaatagtgtacttactattggagntggatccggaagcccggacgggaaggactggagtggattggccagtatcgtacgcaagtggaacgaaccgacggtaccaacccctccgtaccagacgtcgacgtccaactactttaccacgtcggaacccgtacaacgaacctaacgttcgtcccgtagtacgtcgtagtactttccgtagtccgacccgtccgacaacgaccgaaccggtcctaacgtttactacgttgtacgaccgaagacggaggccgacgtaggtcgacccgattaaacgttacgttaccgtttacttaatacgtttagtggtaagtcggaaccggtccgcggggaccgtacgggacctacgggtaccaccgttctccctccg

SEQ ID NO: 51046 - DNA, 796 bp, Homo sapiens
  misc_feature: GYAE6OF02G7TMT.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctccagatgggtcctgtcccaggttcaacttcaggagtcgggccaggactggtgaagtccttcacagaccctgtcccctcacttgcactgtctcgtggtgctccatcaatgtggtacttactagtggagcgtggactccggaacgcccggaccgggaaggaccgtgggaggtgggtagttcgggccctaagtacgtacctaaccggaccgtaaagttcggggaacgtaaacccgtaacggttaacccaaacccccgttaccccctaccgaacggtaccgtaccggtaacgtaccaacctactttcgaaccgttacgggaaccccgtacgtaaacgaaaccctaacgttcgtaccccgttagtacgttaccgtacgtaactttcgtacgttacggtacccggtccgacgtaacggaacccgaccgggtacccttaaacgtttacgttaaccgttggtacgtacgtaacggacgggtaacggccgaaccgtaggtaccgggacccggtacctaaaaccggttacggtttaccgtttaccgttaacgttacgtttagttacggggttaagttaccgggaaccggtacccggttacgggggacccggtaacgggtaccgtaacccgggttcccgtaaacccggtttcccgtacccgttacccggg

SEQ ID NO: 51047 - DNA, 568 bp, Homo sapiens
  misc_feature: GYAE6OF02GF6IN.24.62.F07.1.454.CMB.1.raw
  modified_base (329)..(329): a, c, t, g, unknown or other
  misc_feature (329)..(329): n is a, c, g, or t
  modified_base (424)..(424): a, c, t, g, unknown or other
  misc_feature (424)..(424): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatagtggtacttactattggagctggatccggaagccccgccgggaagggactgggagtggattggccatatctacgccaatggganaaccaggtaccaacccctccctaccagacgtcgagtccaccatttcactggacccgtccaagaaccattgccctgatctgaattctgtgaccgcncagaccacggccactttattactgtgcgagagacggcgcgagtggccgctaaacgtaacgttcgtttactaacttagttataggtaatgggaaccgtccgtgggggccgaacgggccaaccggtccgacccggttctcccgtac

SEQ ID NO: 51048 - DNA, 704 bp, Homo sapiens
  misc_feature: GYAE6OF02HHGVQ.24.62.F07.1.454.CMB.1.raw
  modified_base (105)..(105): a, c, t, g, unknown or other
  misc_feature (105)..(105): n is a, c, g, or t
  modified_base (181)..(181): a, c, t, g, unknown or other
  misc_feature (181)..(181): n is a, c, g, or t
  modified_base (189)..(189): a, c, t, g, unknown or other
  misc_feature (189)..(189): n is a, c, g, or t
  modified_base (205)..(205): a, c, t, g, unknown or other
  misc_feature (205)..(205): n is a, c, g, or t
  modified_base (233)..(233): a, c, t, g, unknown or other
  misc_feature (233)..(233): n is a, c, g, or t
  modified_base (248)..(248): a, c, t, g, unknown or other
  misc_feature (248)..(248): n is a, c, g, or t
  modified_base (487)..(487): a, c, t, g, unknown or other
  misc_feature (487)..(487): n is a, c, g, or t
  modified_base (492)..(492): a, c, t, g, unknown or other
  misc_feature (492)..(492): n is a, c, g, or t
tcagactactatgtcacgaccggtgctcgatttagtagtcgcataaagggaagggtctgtgaaggcttcaccagtcctggacctcctgtgcaagaacatgaaacntctgtggttcttcctctctgtgcagctccagatggtcctgtccaggttcaacttcaggagtcggccaggtctggtnaagccttnacagaccctgtccctnacttgcatgctctggagctcatcaatgngtacttagattgganctaggataccggaatcccggacgggaaggctgggatcgggtattcgggacctaggtactcgtacgacctaagtcgggaactaaccgaacgggttaccaaaccccccgttccgaccgtaacggtagttcccggaagtccctaaccgtaacgttttccgaaccttggggacccccttaagaacggtaaccctaatttccgtacccgtggtaatccctagtaaacttccgaattccggaccnccganaacgaccgcgtacccatttacttacgcgtagcccggaattacgggaggccgtagagttcgggaccagttaaacctggtttccgtttacaaccgggtttttagaaccggttttcggtaaacggtaccggtaacgggtccccggttaggggaacccgtttaacggggtacccgaaaccggttcccggttaacccgttccggttcggtaaccccg

SEQ ID NO: 51049 - DNA, 674 bp, Homo sapiens
  misc_feature: GYAE6OF02F15W1.24.62.F07.1.454.CMB.1.raw
  modified_base (427)..(427): a, c, t, g, unknown or other
  misc_feature (427)..(427): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatgtggtacttactattggagctggatccggaagcccggcggggaaggctggaggtggattggccatatctacgccaagtgggagaaccaggtaccaacccctcctaccagacgtcgagtccacctatttcacgtcggacccgtaccaacgaacctaattcgtaccctgtactctagtaatttcngtcgacccgccgacacgaccgacggtccctaactttattacgtgtcgacgagacggagggccgcgacggttcggcccgtaacgtaaaccgttaaacggtttccgttttaccttaacgtttaacgtttaaggttgggtttaaacgtaccggggtaccgtccccgggttacggggggtaccccgggaacggggtaccccgtaacccggggttacccgtaccccgggtttacccgtccccgttaacccgg

SEQ ID NO: 51050 - DNA, 715 bp, Homo sapiens
  misc_feature: GYAE6OF02JCX8F.24.62.F07.1.454.CMB.1.raw
  modified_base (280)..(280): a, c, t, g, unknown or other
  misc_feature (280)..(280): n is a, c, g, or t
  modified_base (516)..(516): a, c, t, g, unknown or other
  misc_feature (516)..(516): n is a, c, g, or t
  modified_base (697)..(697): a, c, t, g, unknown or other
  misc_feature (697)..(697): n is a, c, g, or t
tcagactactatgtcacgaccggtgctcgatttagtagtcgcataaagggaaagggtacgtgtgaaggcttcaccagtcctggacctcctgtgcaagaacatagaaacatctgtggttcttcctcctcctggtgcagctccagatcgggtcctgtcccaggttcacttcaggagtcgggcccaggactggtgaacgtccttcgacacgaccctgtcccctcacttcgccactgtccttcgtcgggtcgctaccatccaataggtggtacttactatggancgtggactccggaacgcccggacggggaggtacgtggaggtgtacgttgggacctagtagtccgtacgaccctaagtagggacggtaaaccgacggtaacccacccctccccgtacaacggccgtagtacgtaccacccgttatttaccgaccgtacggtaaccctacaaacgaaacctaatttccggtacccgtgtacgtacgtacgtaacctttcgtacgtacgccgaccggtnaaccgtaccgaccggtccttaaacctttcgtactacgtcgacggacgagacgggcccgtacgaacgtcgggaacccagtaaacccgttaggtaccgttttcctaagtttagttaaggtggtaacggttcggtacccgtccgggtacgggtaccggaacggggtaaccctcggggtaacccnccggttccctaccgtccg

SEQ ID NO: 51051 - DNA, 692 bp, Homo sapiens
  misc_feature: GYAE6OF02HRQ9G.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggccaggactggtgaagccttcacagaccctgtccctcacttgcactgtctcgtgtgctcatcaatgtggtacttactattggagctggattccggaagccccggtacgggaagggacgtggacgtggattcgggcagttactgtacgaccaagttgggagaaaccgagggtaaccctaaccccgtccctaccgagacggtcgacgtccaacctagtttacaccgtacggaccccgtctaaacgaaaccctacgttacgtccctgtacgtctagtaaatttccgagttccggaccgtcccggtacaacgggacccaccggtacccgttaactttaaccgtttacgtggttaccgacggtaagacggtacgggccgtactacggggttcggacccgtacaaaccgttagttaccgttttacaagttattttacggtggttaacgttcgggacctccggttagggggacccggaacgggtacccgacgggttaccgacccgtttcgtcccgttacccg

SEQ ID NO: 51052 - DNA, 672 bp, Homo sapiens
  misc_feature: GYAE6OF02F2YA7.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtggctccatcaatagtggtacttactattggagctggatccggaagcccggaccgggaagggactgggagtggagttggcctatatctaccgcctaagtgggaacgaaccgaggtaccacccctccctaccagacgtcgagtcacctatttacactggacccgtacaacgaacctaattcggtaccctggtacgttctaggaactttcgtagtcgacccgccggcaacggaccaccgggcctaacttttacttacgtcgtacgcgaggaacggacggccgtacagggtcgggcccgtacgaaaccgttaggtttccgtttacttaaccgttatttaacgtgggtttaactcgggtaacccggtccggttacggggggacccgtaacgggggaccccgtacggggttaccccgtacccgggtttccctaccccgttaccgg

SEQ ID NO: 51053 - DNA, 663 bp, Homo sapiens
  misc_feature: GYAE6OF02FTWF1.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtggctccatcaatgtggtacttactattggagctggatccggaagcccgccgggaagggactggaggtggagttggccatatctacgccaagtgggagaaccgaggtaccaacccctccctccagagtcgagtccacctatttcactcggaccctaccaaacgaaccctaattcgtcccctgacgtctgtaacttctgtgacccgccgcaagaccaccggcctaactttacttactgtgacgaggacgacgggcgacgaggtcgggcccgtacaaaccgttaaacgtttccgtttacccgttaacgttatttaacgtagggtttaaacggtcgggtaacccgtccgggtttaggggggaccccgggtaacggggtaccccggtaaccggggttcccgtaaccccgggtttccgttacccccgttaacccgg

SEQ ID NO: 51054 - DNA, 630 bp, Homo sapiens
  misc_feature: GYAE6OF02HT8Z8.24.62.F07.1.454.CMB.1.raw
  modified_base (333)..(333): a, c, t, g, unknown or other
  misc_feature (333)..(333): n is a, c, g, or t
  modified_base (376)..(376): a, c, t, g, unknown or other
  misc_feature (376)..(376): n is a, c, g, or t
tcagactactatgtcacgaccggtgctcgatttagtagtcgcataaaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatagtggtaacttactattggagctggactccggaagcccggccgggaagggctggaggtggagttggccatatctacgccaagtggganaaccgaggtaccaacccctcctccagacgtcgacgtcaacctntttacacgttcggaccccgtacaacgtaaacctaagttcgtccctagtacgtctagtaacttcgtagtcgacccgtccgcgaacgacccgacgggccctaacgttttaataccgttgtcgacgaaggagacggcgcacggtcggccgtacaaacgttaggtcctttacgtacttaatttgtaggtagtacggaccggtccgtgggggcccgaacgggacccgtaccggttcggaacccgttcgtaccctaccgg

SEQ ID NO: 51055 - DNA, 693 bp, Homo sapiens
  misc_feature: GYAE6OF02IYK11.24.62.F07.1.454.CMB.1.raw
  modified_base (264)..(264): a, c, t, g, unknown or other
  misc_feature (264)..(264): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggccaggactggtgaagccttcacagaccctgtccctcacttgcactgtctcgtggtgctacatcaatgtgtacttactagttggagntggatccggaacgcccggaccggggaagggacctgggaggtgggtacgtttcgggccctaagttactccgttacgccaaagtcggggaacgaaaccgacggtaacccaacccccttcccgtaccacgtacgtcgacgtaccaccgttatttccacgttacggaccccgtaccgaaacgtaaccctaatttccgtacccgtagtacgttaccttaggttaactttcgtacggtacgtacccggtccgacgtaacgacccgtaccgggccttaaacgtttattaacctggttcgaccggaggacggtacgggcgacgtaggtcggcccacgtaaacttacggttcgtttactacttattgtaggttaagtcggaccggtcggttcggggaccgtacgggtacccgaggttcccgtaccgttcctccctacg

SEQ ID NO: 51056 - DNA, 774 bp, Homo sapiens
  misc_feature: GYAE6OF02JU7ZI.24.62.F07.1.454.CMB.1.raw
  modified_base (271)..(271): a, c, t, g, unknown or other
  misc_feature (271)..(271): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtccgggcccaggactggtgaagtccttcacacgaccctgtcccctcacttgcactgtctcgtggtcgctccatcaatagtgtacttactattggacgntaggacgtaccggaacgccccggaccgggaacgggtacgtgggagtcggtacgttacgggacctaattacgtacctaccggacctaaggtacggggaacgtaaaccgtacgggtaacccaacccccgttccccgtaccgaacgtacgtaccgaacggtaccaaccgtactttaccgacgtaccggtaacccgtaccaaacgtaaccctaacgttcccgttacccgtacgtaccgttactaacgttacgttccgttacgtacggtaacccgccgtaacgacgtaacccgaccggtacccttaacgtttactttaaccgtgtacgtaccggaaggtaacggccgggacacgggtaaggtccgggacccgaacgttaaacgttaacggtttccgttacttaacgtttacgttaagttacggtagttaccggaccggtaccggttaccggggaccggttaacggacccggttacggtacccggtacccgttacccgtaccgtaccgg

SEQ ID NO: 51057 - DNA, 824 bp, Homo sapiens
  misc_feature: GYAE6OF02HHXCX.24.62.F07.1.454.CMB.1.raw
  modified_base (216)..(216): a, c, t, g, unknown or other
  misc_feature (216)..(216): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacacgaccctgtccctnacttgcactgtctctggtgctccatacaagtgtggtacttactattggacgtctaggactaccggaacgcccggaccgggggaacgggtcgtagggagttaggtacgttcgggaccgattacgtccgtaaccggacctaaaggtcgggggaacgaaacccgtaacgggttaaccccaaaccccccttcccccgtaccgaacggtaaccggtaccggaacgttacccaacccttacttttaccgaaccctacgggtaacccccggttaccaaaaccggtaaaccccttaagtttaccggtccccgttaggaccgttacctaggtaaactttcgtacgttaccggaccccgccggtaccgaacggacccgaacccgggtacccttaaacgttttaactttaccgttaggtccggtaaccggaacggtaacgggacgggtccgaccggtacggggtccgggacccgaacgtaaaccggtttaaacggttccggtttttaacctaccgttaagttttacgttacgggttaacgttacggggtaaccggtccggttacgggggaccgtacggggaacccgtaccggtaccggtacccgttccgtaccctacgg

SEQ ID NO: 51058 - DNA, 623 bp, Homo sapiens
  misc_feature: GYAE6OF02GZAVX.24.62.F07.1.454.CMB.1.raw
  modified_base (216)..(216): a, c, t, g, unknown or other
  misc_feature (216)..(216): n is a, c, g, or t
  modified_base (262)..(262): a, c, t, g, unknown or other
  misc_feature (262)..(262): n is a, c, g, or t
  modified_base (331)..(331): a, c, t, g, unknown or other
  misc_feature (331)..(331): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtccgggcccaggactggtgaagccttcacagaccctgtccctnacttgcactgtctctggtgctccatcaatgtgtacttactatgganctggatccggaagcccggcgggaaggactggagtggattggccatactctacgccaagtgggacaaccnggtaccaacccctccaccagacgtcgagtccaactatttcactcggaccctaccaagtaacccaagttcgtccctgacgtctagtaatttcgtagtcgaccgtccgcaacggtaccgaccggccttaacgtttattacgtgtcgcgtagaggtacggctacgagtcggcccgtacaaaccgttagttccgtttctaactttagttacgttagggtaacttacgggacccgtaccggtcggggggtacccacggggtaccctacgggtccctaacccgttcgtacccctacgg

SEQ ID NO: 51059 - DNA, 568 bp, Homo sapiens
  misc_feature: GYAE6OF02HG3LE.24.62.F07.1.454.CMB.1.raw
  modified_base (221)..(221): a, c, t, g, unknown or other
  misc_feature (221)..(221): n is a, c, g, or t
  modified_base (524)..(524): a, c, t, g, unknown or other
  misc_feature (524)..(524): n is a, c, g, or t
  modified_base (530)..(531): a, c, t, g, unknown or other
  misc_feature (530)..(531): n is a, c, g, or t
  modified_base (534)..(535): a, c, t, g, unknown or other
  misc_feature (534)..(535): n is a, c, g, or t
  modified_base (538)..(539): a, c, t, g, unknown or other
  misc_feature (538)..(539): n is a, c, g, or t
  modified_base (541)..(568): a, c, t, g, unknown or other
  misc_feature (541)..(568): n is a, c, g, or t
tcagactactatgtcacgaccggtgctcgatttagtagtcgcataaagggaaagggactggagtggattggccatatctacgccaatgggagaaccaggtacaacccctcctcccagagtcgagtcaccatttcactggacccgtccaagaaccaattgtccctgagtctgaattctgtgaccgccgcagacacggccacttatactgtgcgagagaggcnagtggccgcaaactagtcgtttcactattatggtatggacgccgtgggccggagggaccgaggtccgaccgtctcctcacgccctccaccgaacggcccctatccggttccttcccccgtggtcccacccctccctccgaacgacgccaccgtcgtcgggggcctaccgacggcccggtcccgtcgggtcctcggtacccgttcgggaccgtaacggtacccttaccttcccgaactacgttaacggtacgtccgtggacggtaccggggcttcgggacgaaacgggcggtaccgaagtacgngtacgnngcnnacnngnnnnnnnnnnnnnnnnnnnnnnnnnnnn

SEQ ID NO: 51060 - DNA, 772 bp, Homo sapiens
  misc_feature: GYAE6OF02JIUGT.24.62.F07.1.454.CMB.1.raw
  modified_base (270)..(270): a, c, t, g, unknown or other
  misc_feature (270)..(270): n is a, c, g, or t
  modified_base (519)..(519): a, c, t, g, unknown or other
  misc_feature (519)..(519): n is a, c, g, or t
tcagactactatgtcacgaccggtgctcgatttagtagtcgcataaagggaaagggtcgtgtgaaggcttcaccagtcctggacctcctgtgcaagaacatgaaacatctgtgttcttcctcctcctggtgcagctcccagatggtcctgtcccaggttcaacttcaggagtccgggcccaggactggtgaacgtccttcacgagaccctgtcccctcacttgctactgtctcgtggtgctccatacaataggtgtacttactagtgganctggataccggaacgccccggacgggaaggacgtggaggtggattcggcctagtactccgtaacgccgaagtcgggaacaaccgacggtaaccaccccgtccacgacgtacgtcgacgtaccacctatttcgacgtacggaacccgtacaaaacgaacccttacttccgtcccgtagtacgttcctaggtaacctttacgtcgtacgtacccgcgtacaacggacccgaccggtaccttaaacgttttntaaccgtggtacgacggtaaacgggcgtaacgggccgtacgtacggggtacggacccccgttaaacgtaaaggttttaaacccggtttcccgtttttaaactcggtttaaactttttacgggacgggtttaaccgttacgggggtaccccggttaacccggggttccgggggggtaaccggtaaaccccggggttaacccgtaacccgggggtttcccctaaaccccggggtttcccttcccccggtaacggg

SEQ ID NO: 51061 - DNA, 732 bp, Homo sapiens
  misc_feature: GYAE6OF02GQ1L6.24.62.F07.1.454.CMB.1.raw
  modified_base (219)..(219): a, c, t, g, unknown or other
  misc_feature (219)..(219): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactgggtagaacgccttcacacgaccctgtccctnacttgcactgtctcgtggtgctccatcatacgtgtacttactagttcgagtctggagtaccggacgcccggacgggaacggacgtgggagtgggagttcggaccatactccgtacgaccaaggtacgggaacgaaccgtaacggtaacccaaccccccgtccctacccgaaggacgtacgaacgtcaaccgtatttccgacgtccggacccgtacaaacgtaacctaagttccgtccctagtacttcgtagtaatttcctaggtaccgacccgtccgacgaacgtacccggacccggtacttaacgtttacttactgggtacacggtagacggtaggccacgttacggggtccgacgtaccaaaaccggtttcgtttaccgtttaactaacgttttagttacgttacgggttacggacggttaccccgggtacggtacgggggtaccccgggaaggggttaaccccccgtagggggtttcccccaaaccggtttccccccgtaactacccggg

SEQ ID NO: 51062 - DNA, 663 bp, Homo sapiens
  misc_feature: GYAE6OF02HK5OH.24.62.F07.1.454.CMB.1.raw
  modified_base (533)..(533): a, c, t, g, unknown or other
  misc_feature (533)..(533): n is a, c, g, or t
  modified_base (551)..(551): a, c, t, g, unknown or other
  misc_feature (551)..(551): n is a, c, g, or t
  modified_base (642)..(642): a, c, t, g, unknown or other
  misc_feature (642)..(642): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagtccttcacacgacccctgtcccctacacttgctactgtctcgtggtgctcatacaattgtgtacttactattggagtctggactccggaacgtcccggacggggaaggtctgggacgtggattcggctaattactaccgtacgacctaaggtcggggaacgaacccgacggtaaccctaaccccctcctacgaacgtacgtccggtactaccaccttactttccgacgtccggtaaccctaccaaacgtaaaccctagttcccgtaccgtaggtacgtacttagtaactttcggtacgtacgacccgcgacacggtaacctaccggtaccttaactttntacgttgtcgacgtaagngtacgggcagacggtcggacctataaccgtaggtttcttacgacttattacggtgtacgtgaccggtcggtacggggtaccacgggtaccncgtacctaccgtctcccgtac

SEQ ID NO: 51063 - DNA, 605 bp, Homo sapiens
  misc_feature: GYAE6OF02GLC7D.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatagtggtacttactattggagctggatccggaagcccgccgggaagggactggagtggattggccatatctacgccaagtgggacgaaccaggtaccaacccctccctccagagtcgagtcacattcactggacccgtcaacgaacctaattcgtaccctgacgtctagtatttctgtaccgaccgccgtacgacgaaccaccggcctaacgttacttacgtcgtgccgaaggagacgggcacgacggtggacccgacgtaacgttaacgtcgtttaccacttattagtggtattcggaaccgtccggtacggggaccgtacggggacccgtacgggtcccaaccggttcctaccgtacccg

SEQ ID NO: 51064 - DNA, 761 bp, Homo sapiens
  misc_feature: GYAE6OF02IXL3I.24.62.F07.1.454.CMB.1.raw
  modified_base (261)..(261): a, c, t, g, unknown or other
  misc_feature (261)..(261): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaacgcccttcacacgaccctgtccctctacttgcactgtctcgtggtgctcatcaatgtagtacttactnttggngngtggactaccggaacgcccggaccgggaaggtcgtggagtggtagtcggaccagtactcctacgccgtaagtcgggaacaacccgtacggtaacccaacccccgttcccgtaccgacggtaacgcgtacgtaccaccctatttccgaacgtcggaccctacgaacgaaccctaagttccgtcccgtagtacgtactagttaacttcgtgtacgacccgacgacgtacgaaccgacccggtacttaacgttttacgttaccgtagtaccggtacggaacggacgggtaaccgggccggtaaccgtagggtaccgggtccccgaaacgttaaaaccggttaccggtttccgttttaaccttaacgtttacgtttaacgggttagggtaacggttaccggaccggtacccgggtttacgggggaaccccggttaaccgggggtaacccgttaccgggttaccccgaacccgggtttacccttccccggtaacccgg

SEQ ID NO: 51065 - DNA, 708 bp, Homo sapiens
  misc_feature: GYAE6OF02GM6HP.24.62.F07.1.454.CMB.1.raw
  modified_base (499)..(499): a, c, t, g, unknown or other
  misc_feature (499)..(499): n is a, c, g, or t
  modified_base (592)..(592): a, c, t, g, unknown or other
  misc_feature (592)..(592): n is a, c, g, or t
tcagactactatgtcacgaccggtgctcgatttagtagtcgcataaaagggaaagggtctgtgaaggcttcaccagtcctggacctcctgtgcaagaacatgaaacatctgtggttcttcctcctcctggtggcagcctcccagatgggtcctgtcccaggttcaacttcaggagtcggcccaggactggtagaacgtccttcacgacgaccctcgtcccctcacttgctactgtctctggtcgctccatcaagtgtcgtacttactagttggagctggacgtaccggaacggccccggacggggtaaacggctaggggacgtgggtacttgggaccctaagtacgtaccgtacgaccaaaggtaggggtaacgaaaccgtacggtaacccctaaccccccgtccctacccaaggaccgtaacgtacgtaccaacctactttaccgacgtaccggacccgtaacaaacgaacctaagttccgtacccgtagtaaccgtntaacgtaactttcgtgtaccacccggcacgaacgaaccgtaccggtaccttaacttacgttacgtgtacgacggtaagaccggaggcgtacgngggtccgacccgtaacgtaaccgttacgttcgttacctacgttacgtagttcggtaagtcggacgtccgttcggggtaaccgaggtacccgaggttaccacccgttacgccctacg

SEQ ID NO: 51066 - DNA, 587 bp, Homo sapiens
  misc_feature: GYAE6OF02HTRJR.24.62.F07.1.454.CMB.1.raw
  modified_base (224)..(224): a, c, t, g, unknown or other
  misc_feature (224)..(224): n is a, c, g, or t
  modified_base (257)..(257): a, c, t, g, unknown or other
  misc_feature (257)..(257): n is a, c, g, or t
  modified_base (268)..(268): a, c, t, g, unknown or other
  misc_feature (268)..(268): n is a, c, g, or t
  modified_base (554)..(554): a, c, t, g, unknown or other
  misc_feature (554)..(554): n is a, c, g, or t
  modified_base (558)..(558): a, c, t, g, unknown or other
  misc_feature (558)..(558): n is a, c, g, or t
  modified_base (560)..(587): a, c, t, g, unknown or other
  misc_feature (560)..(587): n is a, c, g, or t
tcagactactatgtcacgaccggtgctcgatttagtagtcgcataaagggaaagggactggagtggattggccatatctacgccaatgggagaaccaggtacaacccctccctccagagtcgagtcaccattttcactggacccgtccaagaaccaatttgtccctgagtctgaattctgtgaccgccgcagacacggccacttattactgtgcgagagaggcncagtggccgcaactagtcgtttctactatttanggtatgggacnccgtggggccgagggaccacggtcgaccgtctcctcacgcctccacccaacgggccccacgtcggtccctttccccccgtcgggcccacccctccctacccaacgacgaccacccttccggtcggggggcctacgacggcccgggacccgtcgggccttcggcccgttcgggtaccgtaaacgggtaccttaaccgttacccaaccgtaacgttaacggttaagttcgtttaggaccggccgggggtccgtcggggaaccgtaaggggcccgaccgaagttacggnacgngnnnnnnnnnnnnnnnnnnnnnnnnnnnn

SEQ ID NO: 51067 - DNA, 707 bp, Homo sapiens
  misc_feature: GYAE6OF02H989E.24.62.F07.1.454.CMB.1.raw
  modified_base (227)..(227): a, c, t, g, unknown or other
  misc_feature (227)..(227): n is a, c, g, or t
  modified_base (421)..(421): a, c, t, g, unknown or other
  misc_feature (421)..(421): n is a, c, g, or t
  modified_base (467)..(467): a, c, t, g, unknown or other
  misc_feature (467)..(467): n is a, c, g, or t
  modified_base (500)..(500): a, c, t, g, unknown or other
  misc_feature (500)..(500): n is a, c, g, or t
  modified_base (529)..(529): a, c, t, g, unknown or other
  misc_feature (529)..(529): n is a, c, g, or t
  modified_base (628)..(628): a, c, t, g, unknown or other
  misc_feature (628)..(628): n is a, c, g, or t
tcagactactatgtcacgaccggtgctcgatttagtagtcgcataaagggaaggtctgtgaaggcttcaccagtcctggacctcctgtgcaagaacatgaaacatctgtggttcttcctcctcctggtggcagcctccagagtcgggtcctcgtacccaggtttcaacttcgaggacgtcgggacccaggtctggtgaacgtccttcgacacgtacccctgtccctnacgttgctactcgtcttcgtggtcgtacctccatacctaagttacggttgttaaccttatagttggaagtcttagggactccggggaacgccccgggacggggaaggtcctgggtaaggtggtattcggacctagtacttacgacgaccttaggacgggaactaccacggtaaccctaacccccgtccaacggnggtacaccgtacgtcctacctatttccgacgtccgggaacccctanaaaacgtacctacgttcgtacccaggttacctntacgttacttcgtacgtccgccgccgtanaccgacgtccgttacacgtttactaccgttgacgggacacggtaacgccgtacgtacgtacggtgaacccgtagttaactaacggtcctttataacgtntttacggtgttacggactccgggtcggtacgggaccggtaacgccgttacccgggtaccacggtttcccaccggtaccg

SEQ ID NO: 51068 - DNA, 732 bp, Homo sapiens
  misc_feature: GYAE6OF02GSVFD.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaacgccttcacacgaccctgtccctcacttgcactgtctctggtgctccatcaatgtgtacttatagttggagcgtggactaccggaacgcccggacggggaaggcgtggagtggagttcggccattatccgtaacgcctaaggtacgggacgtaaccgacggtaacccaaccccctccctacgagtacgtacgacgtaccacgtacttcgacgtcggtaccctaccgaaacgaacctagttccgtcccgtagtacgtactacggtaactttcgtacgtacgacccgccgtacgacgaacccgacccggttacctaacgtttacgtttacgtcggtaggaccgtaagggacggtacgggaccgtacggtaacgggtccggacccgttaacgtaaaccggtttaaaccggttccgttttaaattaacccggtttattaacggttacgggttaaacgtcccgggtacgtcccgggttaccggggaccggtaacgggtaccccgttaccggtccccggtaacccggttcctaccccggtacccg

SEQ ID NO: 51069 - DNA, 875 bp, Homo sapiens
  misc_feature: GYAE6OF02JHZX5.24.62.F07.1.454.CMB.1.raw
tcagactactatgtcacgaccggtgctcgatttagtagtcgcataaagggaaagggtctcgtgaaggcttcaccagtcctggacctcctgtgcaagaacatgaaacatctgtggttcttcctcctcctggtggcagcctcccagatgggtcctgtccccaggttcaacttcaggagtcgggcccaggactggtgaagccttcacagaccctgtccctcacttgcactgtctctggtgctccatcaatgtggtacttactatttggagctgggactccgggtaaacgcccggaccgggtaacgggacctggaggttgggaactttcgggaccctaagttactacctaaccggtccctaaaggttcgggggaaacgaaacccgtaacgggttaaaccctaaacccccgtaccccgttaccgaacggtaacggttaccggaacggttaccctaaccgtaaccgttttacccgtaacgtttaccggggaaccccgttaaccgaaaaaccgtaaacccctaaagtttaccggttaccccgtaaggtaacgtaccgtttacgtaaactttcccggtagtaccggtaacccgccgtacgtaaacgacccggaccggtaccctaacgttttaccgttaacgtcgggtactaaccgggacgtaaacgggtacggacccgtacggaaccggttaccgggtacccgaaccgtaaaaccgtttaacggtttaccggttttaaccctaaccgttaagtttaaccgggtacgggtttaaagtaaaccccggggtacggttaacccgggttaccggggggtttaacccaacgggggttaccccttaaccggggttaccctaaccccgggtttacgtacccccgttaacgg

SEQ ID NO: 51070 - DNA, 660 bp, Homo sapiens
  misc_feature: GYAE6OF02JEDST.24.62.F07.1.454.CMB.1.raw
  modified_base (277)..(277): a, c, t, g, unknown or other
  misc_feature (277)..(277): n is a, c, g, or t
  modified_base (310)..(310): a, c, t, g, unknown or other
  misc_feature (310)..(310): n is a, c, g, or t
  modified_base (328)..(328): a, c, t, g, unknown or other
  misc_feature (328)..(328): n is a, c, g, or t
  modified_base (350)..(350): a, c, t, g, unknown or other
  misc_feature (350)..(350): n is a, c, g, or t
  modified_base (363)..(363): a, c, t, g, unknown or other
  misc_feature (363)..(363): n is a, c, g, or t
  modified_base (449)..(449): a, c, t, g, unknown or other
  misc_feature (449)..(449): n is a, c, g, or t
  modified_base (494)..(494): a, c, t, g, unknown or other
  misc_feature (494)..(494): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacacgaccctgtccctcacttgccactgtctctggtgctccatcaatgtgtacttactattgagctggatccggaacncccggacgggaggactggagtggattggccatntctacgcagtggacaacnggtaccaacccctcctacgagntccgagtccaacnctttcacttcggaccctcgaaagaacccaagttcgaccgtgagttcctagtaactttcgtggtcgacccggtccgactacggaccncccggtaaccttacgtttaacttaccgtgtcgaccgtaggaacgnggcctcgaggtccggaccgtactaaacgtttacggttccgttttaccaacgtttacgttagttacgggtagtttaccggtaaccggtcccggttacggggggacccgtaacggggtacccgtaaccgggttccctaacccccgggttactttaccccggtacccgg

SEQ ID NO: 51071 - DNA, 451 bp, Homo sapiens
  misc_feature: GYAE6OF02FIYMW.24.62.F07.1.454.CMB.1.raw
  modified_base (435)..(435): a, c, t, g, unknown or other
  misc_feature (435)..(435): n is a, c, g, or t
  modified_base (442)..(451): a, c, t, g, unknown or other
  misc_feature (442)..(451): n is a, c, g, or t
tcagactactatgtcacgaccggtgctcgatttagtagtcgcataaagggaaagggactggagtggattggccatatctacgccaatgggagaaccaggtacaacccctccctccagagtcgagtcaccatttcactggacccgtccaagaaccaattgtccctgagtctgaattctgtgaccgccgcagacacggccacttattactgtgcgagagaggcgcagtggccgcaactaagtcgtttctactattatggtatggacgcctggggccgagggaccacggtcaccgtctcctcagcctccaccaacgggcccatccggtccttccccctggccaccctcctccaagcgcacctcgtggggcacgagccgccgtgggctgctggtcaaggctactccactatagtacgtctgagcgggctgggcagggcncgatagnnnnnnnnnn

SEQ ID NO: 51072 - DNA, 693 bp, Homo sapiens
  misc_feature: GYAE6OF02G0RQS.24.62.F07.1.454.CMB.1.raw
  modified_base (573)..(573): a, c, t, g, unknown or other
  misc_feature (573)..(573): n is a, c, g, or t
  modified_base (623)..(623): a, c, t, g, unknown or other
  misc_feature (623)..(623): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcgaggtacgtccgggcccaggaccgtggtagaacgtccttccacacgtacccttcgtccctctacgttgccacttgtcctcgtggtcgtcacctatacaagtcgttgtaacttacttaattcggagtcgtaggactaccggaacgccccggtacggggaaggaccgtagggacgtggtacgttggacctagttactccgtaacgccaagtgggaactaaccgaggaccctaaccccgtcctcgaacgacgtacgtactcaccgtactttaccgacttaaccgggacccctaacaacgaacctacgttcgtccctaggtacttcgtaacgtttaacgttcgtaggtccaccggtccgacgtacgaaccctaccggacctaactttaaccgttacgttgtccgaacgnggtaagacggtccgacgtacggtcgccgtaacaacgtagttacccgttanacttagtacgtagggttcgtaacacggtccgtcggacggtacggacgaccgtacgaccgttcacccgtcg

SEQ ID NO: 51073 - DNA, 806 bp, Homo sapiens
  misc_feature: GYAE6OF02HCWFO.24.62.F07.1.454.CMB.1.raw
  modified_base (104)..(104): a, c, t, g, unknown or other
  misc_feature (104)..(104): n is a, c, g, or t
tcagactactatgtcacgaccggtgctcgatttagtagtcgcataaagggaagggtctgtgaaggcttcacagtcctggacctcctgtgcaagaacatgaaacntctgtggttcttcctcctctggtggcagctcccagatcgggtcctgtcccaggttcaacttcgaggaggtccgggcccaggtactggtacgaacgtcccttcaacgacgtacccttcgtcccctactacgttcgacctacttgtacgttccggtgggtccgacctaccgagttacaaagtttggtaccggttaaccctttaacgtaggttacgggaacgtacggttacggaaccgttaccggggaaacgtccccgggaaccgggggtaacggacgtaaggggtcggtagggtattccgggacctaagttaccgtaccgtaccgtaccgaaggttacggtaaccgaaaccgtacgtaaccccgtaccccctacgtacctaaggtaccgtaccggaactcctactactttccgacgtccggtaacctaccgaaacgtaacctacggtttaccgcccgtgtaacgttacgtcgttaaacttcgtaggtccgaccggtccgaccgtaggaccgaaccggtcttaaacgtttaccttcgtaggtagtccgtaacggacggtacgggacctcgggacgttaccgggaccttaccgaaacggtttaacggttcttaccgttattagtacggtttaggacgttaccgggaccggtggccggggtaccgtacggggtacccacgggtacccctcggttaccgtcccgtacg

SEQ ID NO: 51074 - DNA, 681 bp, Homo sapiens
  misc_feature: GYAE6OF02G8WHH.24.62.F07.1.454.CMB.1.raw
  modified_base (229)..(229): a, c, t, g, unknown or other
  misc_feature (229)..(229): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtccgggcccaggactggtagaagcctttcacacgaccctgtccctcacttgcactntctctggtgctccatcaattgtgtacttactattggagtctggactccggaacgccccggacgggaacgggcgtggagtggagttcggacctatactcctaccggaccaaggtcgggaacgaaaccgtacggtacccaacccctccctaccgagacgtccgacgtccaactactttaccacgttacggaacccctacgaaaaccgaaccttaacgtttccgtcccttagacgtccgttagtaactttctacgtacgacccgaccgacgaacgaccacggtaccaactttacttacgtacgtcgacggtacgaggacgtacggactacggttcgaccgtaccaacgttaacgttcgtttaccgtaacttacgtttagtaggttacgtacggtaaccgtccggtacgggacccgtacggaccgtaccggttccgacccgttcctacccgtaccg

SEQ ID NO: 51075 - DNA, 595 bp, Homo sapiens
  misc_feature: GYAE6OF02FXJZ4.24.62.F07.1.454.CMB.1.raw
  modified_base (476)..(476): a, c, t, g, unknown or other
  misc_feature (476)..(476): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatagtggtacttactattggagctggatccggaagcccgcgggaaggctggacgtggatggccatatctacgccaagtgggagaaccgaggtaccaaccccctccctccagtagtcgagtccacctactttcactcggaccctcgaaagaaccaaatttcggtaccctgacgttcctgtaacttcgtgtcggacccgccgcacgaccacggccacttattactgtgcgaggagnggcgcaggtcggcccgctaacgtaggttccgtttactacttattagtcggttaagtcggtacggccgttcgggggacccgtagggacccgacggtccgtacccgtccttcccgtaccgg

SEQ ID NO: 51076 - DNA, 567 bp, Homo sapiens
  misc_feature: GYAE6OF02JXS9L.24.62.F07.1.454.CMB.1.raw
  modified_base (178)..(178): a, c, t, g, unknown or other
  misc_feature (178)..(178): n is a, c, g, or t
  modified_base (223)..(223): a, c, t, g, unknown or other
  misc_feature (223)..(223): n is a, c, g, or t
  modified_base (236)..(236): a, c, t, g, unknown or other
  misc_feature (236)..(236): n is a, c, g, or t
  modified_base (260)..(260): a, c, t, g, unknown or other
  misc_feature (260)..(260): n is a, c, g, or t
  modified_base (540)..(540): a, c, t, g, unknown or other
  misc_feature (540)..(540): n is a, c, g, or t
  modified_base (542)..(567): a, c, t, g, unknown or other
  misc_feature (542)..(567): n is a, c, g, or t
tcagactactatgtcacgaccggtgctcgatttagtagtcgcataaagggaagggactggagtggattggccatatctacgccaatgggagaaccaggtacaacccctccctccagagtcgagtcaccatttcactggacccgtccaaggaacccaattgtccctgagtctgaattcngtgaccgccgcagacacggccacttattactggtcgagagaggcncaggtggacccgnaaactagtccgtttcaactattanggtatggacgccgtggggtccgacgggaccgacggtccaccggtctcctcacgcctccaccaacgggccccatccggtaccttccccccgtacgggcctaaccccgtccttacccgaacgccgaccacccgttccggtcgggggaccaccgacggcccgggtccccgtggggcccgttcggtacctcgggtacgaaacgggtaccttacccgttaccacctaacgtaaggtactccgtaaggcggtcgggtactcgggacaacgggcgcgtaatacggangnnnnnnnnnnnnnnnnnnnnnnnnnn

SEQ ID NO: 51077 - DNA, 810 bp, Homo sapiens
  misc_feature: GYAE6OF02GDEOF.24.62.F07.1.454.CMB.1.raw
  modified_base (266)..(266): a, c, t, g, unknown or other
  misc_feature (266)..(266): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtccgggcccaggactggtgaagccttcaacacgacccctgtcccctcacttgcactgtctctggtgcctccatcaatgtgtacttactatggngcgtggactacggaacgcccgcggggaaggtctggaggtggattggcctaagttactcctacgacctaagtgggaacaaccacggttaaccaaccccccttcctaccaggtacgtccgtaacgttccaaccttactttaccgaacgttccggggaaaccccgttaccaaaacggaacccttaaacgttttccgtaccccgttaggtaacgtttccttacgtaaacttttcgtaggttaccgaccccggtcccggtacgaacgggaacccgtaacccgggtcccttaaaacgttttacgtttaacccgtggggttacccgaacgggtaaacgggacgggaacgggtccggaacgtaaggggtccggggtaccccgtaacgtaaaaccgttacgggttttacccgttttacctaacgtttaagttttacggtaacggggtttagtacggggtaccccggttccgggtaagggggggtacccccgtaacggggtaccccgtaaccggggtttaccccaacccggttttcccgtaccccgttaaccgg

SEQ ID NO: 51078 - DNA, 715 bp, Homo sapiens
  misc_feature: GYAE6OF02JMQV0.24.62.F07.1.454.CMB.1.raw
  modified_base (221)..(221): a, c, t, g, unknown or other
  misc_feature (221)..(221): n is a, c, g, or t
  modified_base (248)..(248): a, c, t, g, unknown or other
  misc_feature (248)..(248): n is a, c, g, or t
  modified_base (285)..(285): a, c, t, g, unknown or other
  misc_feature (285)..(285): n is a, c, g, or t
  modified_base (632)..(632): a, c, t, g, unknown or other
  misc_feature (632)..(632): n is a, c, g, or t
  modified_base (680)..(680): a, c, t, g, unknown or other
  misc_feature (680)..(680): n is a, c, g, or t
  modified_base (690)..(690): a, c, t, g, unknown or other
  misc_feature (690)..(690): n is a, c, g, or t
  modified_base (714)..(714): a, c, t, g, unknown or other
  misc_feature (714)..(714): n is a, c, g, or t
tcagactactatgtcacgaccggtgctcgatttagtagtcgcataaagggaagggactggagtggattggccatatctacgccaatgggagaaccaggtacaacccctcctcccagacgtcgagtcaccatttccactggacccgtccaagaaccaattcgtccctgagtctgaattctgtgacccgccgtcagaccacggccctaactttagtacctgtnccggagacgaggccgcaggtggcccgnaaccgtaagtcgttacactattagtggtatcgggacnccgtggggccgtagggaccgacggtccgaccggtcctccgttcacggtcctccacccgaacgggccccagtccggtaccttccccccgtcggccgtaccccgtcccgttcccgtaaacgacgtcccacccgtacgtccggggggtaccaccgacgggccggtccccgttcgggtccgtccggacccgttcgggtacccgaacgggtaacccgtacccgtttcccgaaccgtaccgtttaaccggtaacgtttcccgtttacggtaacggtccccggggtaacggtttacggggaacccgtaaacggggtcccggaaacccgaagtttacccgggagtcccgtagtcncggacgttgcgtcgcggccgcgcgcgcgcgctacgcgcgcgacgacgngcgtacgcgngtcgtacgcgtcgacgcgctgtgng

SEQ ID NO: 51079 - DNA, 732 bp, Homo sapiens
  misc_feature: GYAE6OF02I5O85.24.62.F07.1.454.CMB.1.raw
  modified_base (131)..(131): a, c, t, g, unknown or other
  misc_feature (131)..(131): n is a, c, g, or t
  modified_base (194)..(194): a, c, t, g, unknown or other
  misc_feature (194)..(194): n is a, c, g, or t
tcagactactatgtcacgaccggtgctcgatttagtagtcgcataaaagggaaagggtctgtgaaggcttcaccagtcctggacctcctgtgcaagaacatgaaacatctgtgttcttcctcctctggtgnagctccagatggtcctgtcccaggttcaacttcaggagtcgggcccagactggtgacgccttnacagaccctgtcctcacttcgacacgtcgtctcgtggtaggctccagtacaagtagtaggtactttaacgtatttaggagtcgtaggctaccggaaacgcccggaccggggaacgggtaactgggagtacggtagtttacggcctaataactacgttaccgaccaagtgggaactaaccggaacggtaacccaaccccgtccctacgaacgtcgtacgagtccacaactttacactcggaccctaccgaaactaaacgtaagttcgttccccgaagtacgtacgttacgtaacttcgtacgttacgacccgtccgaagacgtaaccgaccgacccttattacgtttaaacgtcgttagaacgtagaacgggacgacggtacgtaggtaccgacccggtaactaaaccgtaaacggtttccgtttaacgtttaaccaagttttaagtacggtaggtaaccggtaccggtaccggtaccggggtaccggtaaacgggacccgtaaaccggttcccaaccgggttacctccccgtaaccgg

SEQ ID NO: 51080 - DNA, 844 bp, Homo sapiens
  misc_feature: GYAE6OF02GBMDL.24.62.F07.1.454.CMB.1.raw
  modified_base (241)..(241): a, c, t, g, unknown or other
  misc_feature (241)..(241): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggctggtgaagccttcacagaccctgtccctcacgttgcactgtctctggtagctaccntcaagttagtcggtaacttacttagttaggagtctaggactaccgggaacgtcccggacggggaaacggtcgtagggacgtcggagttacggcctatactcgtaccgccgaagtcgggaacgaccgaacggtacccaacccccgtccctacgacggtacgtcgaacgtaccaccgttactttacacgtaccggacccgttaccgaaacgaaccttacgttacgtacccgtagtacgttccttaaggtaactttccgttagtacccggacccggccgtacgtaaccgtaaccgaaccccgtaaaccgtttaaacctttaacccgtttaacgtcgggttaacggtacggtaacgggtaaaggacccggacgggtaccgtaaccgggtttaccgggacccgttaaacccgttaaaaccggtttaacgggtttaacccgtttttaacccgttaactttaggtttttaaccggtaacggggttttaaacggttcccgggggtaacccggttaccgggggttaccccggggtacgggggtaaacccggggtaaccccggtttacccgggttacccgggtaaccccggtttccggtacccccgtacccgg

SEQ ID NO: 51081 - DNA, 556 bp, Homo sapiens
  misc_feature: GYAE6OF02GZBB6.24.62.F07.1.454.CMB.1.raw
  modified_base (304)..(304): a, c, t, g, unknown or other
  misc_feature (304)..(304): n is a, c, g, or t
  modified_base (509)..(509): a, c, t, g, unknown or other
  misc_feature (509)..(509): n is a, c, g, or t
  modified_base (512)..(512): a, c, t, g, unknown or other
  misc_feature (512)..(512): n is a, c, g, or t
  modified_base (514)..(514): a, c, t, g, unknown or other
  misc_feature (514)..(514): n is a, c, g, or t
  modified_base (520)..(520): a, c, t, g, unknown or other
  misc_feature (520)..(520): n is a, c, g, or t
  modified_base (522)..(523): a, c, t, g, unknown or other
  misc_feature (522)..(523): n is a, c, g, or t
  modified_base (525)..(526): a, c, t, g, unknown or other
  misc_feature (525)..(526): n is a, c, g, or t
  modified_base (530)..(531): a, c, t, g, unknown or other
  misc_feature (530)..(531): n is a, c, g, or t
  modified_base (533)..(533): a, c, t, g, unknown or other
  misc_feature (533)..(533): n is a, c, g, or t
  modified_base (535)..(536): a, c, t, g, unknown or other
  misc_feature (535)..(536): n is a, c, g, or t
  modified_base (538)..(556): a, c, t, g, unknown or other
  misc_feature (538)..(556): n is a, c, g, or t
tcagactactatgtcacgaccggtgctcgatttagtagtcgcataaaagggaaagggactggagtggattggccatatctacgccaatgggagaaccaggtacaacccctccctccagagtcgagtcaccatttcactggacccgtccaagaaccaattgtccctgagtctgaattctgtgaccgccgcagaccacggccacttattactgtgcgagagaggcgcagtgccgcaactaagtcgttctactattatggtatggacgtccgtggggccgagggaccacggtctacccgtctcctcncgcctccaaccgaacgggcccagtccgtcccttcccccgtcggcccacccctccctccgaaagacgccacccgtcggtacggggccacgacggtcccggccgtcgggcctcgtccgtcggtcaaacggtccttacttcccatacgttacggttacgtcgtacgggcggtccgggtcgtacgggacgacggcgtacgtaactggancgncngtcgancnngnngacnncnanngnnnnnnnnnnnnnnnnnnn

SEQ ID NO: 51082 - DNA, 692 bp, Homo sapiens
  misc_feature: GYAE6OF02GPM92.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctcgtggtcgctccatcaattagtggtacttactattggagctggataccggaacgtccccggaccgggaagggactgggagtggtagttcggccatagtcctacgccaagtgggacgaaccgaaggtaacctaacccctccccgtaccagtacgtacgactaccacctactttcaacgtaccggtacccgtaccaaacgaaaccctaagttccgtacccttagtacgtcctacggtaattcgtacgtacggacccgtccgacgtaccgaccgaccgaccctaacttactttacgtctcggacgtagacggtcgggccgtacggtacggtcggcccgtaagtaaaccgttaacgttaccgttacctaacgtttattacgttagggtagtccgggtaccggtccggttcggggacccggtagggacccggtaccggttaccgtacccggttaccctcccgttaccgg

SEQ ID NO: 51083 - DNA, 857 bp, Homo sapiens
  misc_feature: GYAE6OF02I0G0T.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtgttcttcctctcctggtggcagctcccagagtgggtcctgtcccaggttcacttcaggagttccggcccaggactggtgaagtccttcacacgtaccctgttccctcacttgcactcgtctctggtgctccatcaattgtcggtacttacgtagttaggtagtccgtagggacttacccggaaacgcccccgggtaccggggtaaacgggtacgtgggtaaggtacgggtaccgtttacgggggccctaaagttaacgtcccgttaaaccggtccctaaaaggttaccgggtaaacgtaaaaccccgtaaccggggttaaacccctaaaccccccggttttacccgtaaccccggtagggtaaacccggttcggaacccgggttaacccgaacccccgttacgttttttaccgaaaccccgttaacggggtaacccccgtttaaccgaaaaccggttaaaaccctaaaacgttttccggttaacccctttaggtacgtttaccgtacgtaaactttcgtcggttacgtaacccgccgtacgtacgtaacccgaccggtcctaaagtttacctaccgttgtaccgacggaaggttaacggcgggtacctcgagggtaccgcggtaccgtaaattacgtaccgtttcgtaactatttaacgtcggtaaagttacggccgtacgttacgggggtaccgaaccgggtaccgttaacccgggtccaacccgggttttccacccgttaccgg

SEQ ID NO: 51084 - DNA, 815 bp, Homo sapiens
  misc_feature: GYAE6OF02IEVU0.24.62.F07.1.454.CMB.1.raw
  modified_base (175)..(175): a, c, t, g, unknown or other
  misc_feature (175)..(175): n is a, c, g, or t
  modified_base (204)..(204): a, c, t, g, unknown or other
  misc_feature (204)..(204): n is a, c, g, or t
tcagactactatgtcacgaccggtgctcgatttagtagtcgcataaagggaaagggtctgtgaaggcttcaccagtcctggacctctgtgcaagaacatgaaacatctgtggttcttcctcctcctggtggcagctacccagatcgggtcctgtcccaggttacaacttcgaggnggtccggccaggctggtagagtccttcanacgtaccctgtccctctacttacacgttcgtcttcgtgggtcgcttaccagtactaagtaggttcgtaacttacttagttggagtacgttaggactaccgggaaccgccgggaacgggaacgggacgttacgggaggttacgtaggttacggcctaaagtcgttaccgaccgtaaccgaggtacggggaactaaaccgaaccggtaacccctacccccgtacctacgaacgtacgtaccggactaccaccgttagttacccacggtacccggtacccgtaaccaacgtaaaccgtacgtttaccggtacttacggtactacggtttaactacgtttacgtacggtacgaacccgtacgtacgtaacgaacccggtaccggtacccttaacgtttaacttaacgcggtacgtaaccgggagaacgggacgtacggtacgtaacgggttccggaccgtaaccgttaaacggttacgtttacgtttaactacgtttaacgtttagtacggttaggtaaccgggttccggtacgggtaaccggggaccggaacccgggacccggtttaaccgggttaacccgtacccggttacccgttacccgccggtaacccgg

SEQ ID NO: 51085 - DNA, 748 bp, Homo sapiens
  misc_feature: GYAE6OF02IV9Q4.24.62.F07.1.454.CMB.1.raw
tcagactactatgtcacgaccggtgctcgatttagtagtcgcataaagggaagggtctgtgaaggcttcaccagtcctggacctcctgtgcaagaacatgaaacatctgtggttcttcctcctcctggtggcagctcccagatgggtcctggtcccaggttcaacttcaggagtcggggcccagggactggtagaagtccttcacacgacccttcggtccctcgtaccttgctacttgtcttccgtggttcgcctaccatccaagttagtggtacttacttattcggtatcgtggagttccggaacgccccggccgggaacgggacgttagggacggtggtaacgtttcgggtccgtaacgttacgttaccgttacggaccctaaggttaggggaaccgtaaaccggtaacggtaacccgtaaccccgttacccctacccgtacggtaccggtcgtaacggtacctaacctactttaccgtacgtaccggtacccgtaacctaacgaaacctaacgtttacgttacccctaggtaccgtcgttacgtaactttccgttacgtcgtaacccggccgtacgtaaccgacgaccggccctaacgtttacttaaccgttgccggtacgacgacggtacgcggtcgacggtcggccgacctaacgtacgttccgtttatacgttacttagttggtgtggacgtccggtacgggccgggtacggaccgtccggctaccgtaccgtcctacccgg

SEQ ID NO: 51086 - DNA, 778 bp, Homo sapiens
  misc_feature: GYAE6OF02HFZE7.24.62.F07.1.454.CMB.1.raw
  modified_base (106)..(106): a, c, t, g, unknown or other
  misc_feature (106)..(106): n is a, c, g, or t
  modified_base (223)..(223): a, c, t, g, unknown or other
  misc_feature (223)..(223): n is a, c, g, or t
tcagactactatgtcacgaccggtgctcgatttagtagtcgcataaagggaaagggtctgtgaaggcttcaccagtcctggacctcctgtgcaagaacatgaaacntctgtggttcttcctcctacctggtggcagctccagatgggtcctgtcccaggtttcaacttcaggtacgtcgggcccaggactggtgaacgccttcacgacgacccgtgtcccctnacgttgaccacttgtctcgtggtagccttaccattcaataggtcgtactttacgtattggagtccgtaggactccggaacgtccccggacggggtaagggaccgtggtaacggtggtaacgttcggacctatacgttccgtaccgaccgtaaggtcgggaacgtaaccacggtaaccccaaccccttccgtaaccgaggttaccgcggtaacgtccaaccgtactttacgacccgtacgggtaacccctagaaaccgtaacctagttccggtaccctggtaccttacgtaacgtactttccgtacggtccgacccgtaccgcgtaacgacccgaccggtaccttacgttaatccggttagccggaacgtaggacgaccgggtacgccgttaggccggtacccgtaacgttaaaccggttcgttttaccgttaactaccgtttagtttaacgtcgggttaaacttaccggggtaccgggtaccggttacccgggggtacgggtaaccgggacccgtaccgggttacccgtaacccgggttcccttaacggtcccgg

SEQ ID NO: 51087 - DNA, 948 bp, Homo sapiens
  misc_feature: GYAE6OF02JOSCW.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtccgggcccaggtactggtgaagtccgttacactacgcccgtgtccctactacttgcctacgttcgtactccgttgggtcggcctccgactctaagttacgtcggttaacttactagttggacgacgttcggacttacccgggaacgtccccgggtaccggggaaacgggtaccgtttagggacgggttcgggtaacgtttccggggaacccttaggttacgtttaccggtaacccggtaccgttaaaggttacgggggtaaacgttaaaccggtaacggggtttaaaccccgtaaaacccccggtttcccccgttaaccggaaacgggtttaacggggtttaacccgaacggttacccggtaaaccccctttaagggttttaacccaaacgggttttaccgggtacccccgtttaaacccgaacgttaaaacccgtaacgtttcccggtaaacccgtttaggtaccgtaccgttaaaggtaaaccttttccggttacgtccggtaaaccccggtacgaacccgttacggaaaccttacccgggaccctttaaagttaccgtttactaccgggttatacccggggaatacgggtaacggttccgtaccggtacgttacgggacccgtacgttaaaacggtaccgttttaccgtacgtttaaaccgtttcgttaaggtcggggtaaccgttaaccgggaccgttacgggttaaccggggtaactacccggggtaacgtaccggttacccggacggtttacccttcccgggtaaccg

SEQ ID NO: 51088 - DNA, 875 bp, Homo sapiens
  misc_feature: GYAE6OF02H9DSL.24.62.F07.1.454.CMB.1.raw
  modified_base (167)..(167): a, c, t, g, unknown or other
  misc_feature (167)..(167): n is a, c, g, or t
  modified_base (711)..(711): a, c, t, g, unknown or other
  misc_feature (711)..(711): n is a, c, g, or t
tcagactactatgtcacgaccggtgctcgatttagtagtcgcataaagggaaagggtctgtgaaggcttcaccagtcctggacctcctgtgcaagaacatgaaacatctgtggttcttcctcctctggtggcagctccagatgggtcctgtcccaggttcaacttcnggagtcgggcccaggactggtagacgccttcgacacgaccccttcgtcccctataccgttggacctacttggttccttcggttcgggtcggtccttcctaacgttccaaaagttacggttcgggttaaccttttaacgtaagtttgggtaacggtccgttagggtacgttacccgggaacggcccccggggacgggggaaacggggtacgttaggggaggttacgggtagttacggggtacctaagttaccgtaccgtaacggtacctaacggtacggggaaacgtaacccggttaaacgggtaaacccccgtaaaccccccgtcccgtaccggtaaggtacgtaccggaacgttaccaacccgttacgttacctaccgtacgggtaacccgtcgaaaaaccgtaacccttaacggtttaccgtcccgtttaacgggtacgttcgttacgttaaacgttttccgtaggtacccggaacccgtccgtacgtaaccgaccgtaccgtacccgtaactttaccgttagtacggtcgacgggtaacgngggtaacggaccgaccggtaagggtcccgaccgtaaacgtaacgttacgttacgttttacctaacgttacgttagttacggtagttaccgggacgttccggggtacggggtaacccggtacgggaacccgtacgggttaccctacccggtcccgtcctaaccgg

SEQ ID NO: 51089 - DNA, 820 bp, Homo sapiens
  misc_feature: GYAE6OF02IRXXV.24.62.F07.1.454.CMB.1.raw
  modified_base (110)..(110): a, c, t, g, unknown or other
  misc_feature (110)..(110): n is a, c, g, or t
  modified_base (203)..(203): a, c, t, g, unknown or other
  misc_feature (203)..(203): n is a, c, g, or t
tcagactactatgtcacgaccggtgctcgatttagtagtcgcataaaagggaaagggtctgtgaaggcttcacccagtcctggacctcctgtgcaagaacatgaaacatntgtggttcttcctcctcctggtggcagctcccagatgggtcctgtccaggttcaacttcaggagtccggccctaggactggtgaagccttcanacgaccctgtccctcacttgcctactgtcctgtggtgctaccatacaataggtagtaccttaactagttggagtcgtggaactacccgggaacgccccgggtaccggggaacgggacgtgggacggtgggtagttcgggacctaagttacgtacctaaccggtacctaaaggttcgggaaacggtaacccgaagggttaacccaaacccccgtccctacccgaaggagtccgtaacggtacctaaccgttaacgtttaccgaacggttaccggtacccctaaaccgaaaccgtaaaacccgtaagtttacccggtaccccgttagtaacggtaccgttacgtaaacgttacttacggtacgacccggtccgacaacgtaacccgacccggtaccttaaccgttaacttacggtcttaacggtaccggaggacggtcggacgtaccgaggggtccgtaccgaccgtaaacgtaaccggtttaccgtttactaaccgtttatttaacggttacgggttacgttacgggttaccggtacccgggtacgggggtaccgggtaaccgggtaccccggttaaccgggtaccccgtaacccggtttacccgcccgttaacccgg

SEQ ID NO: 51090 - DNA, 760 bp, Homo sapiens
  misc_feature: GYAE6OF02HIFGY.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgctactgtcctctggtgctccatcaatagtgtacttactagttgagctggatccggaagcccggacgggaggactggagtggagttggcctatactcgtacgaccaagtgggaacgaaccgtaggtaacccaacccccgttccctacgaggacggtacgacgtaccacctatttacacgtacggacccgtaccaaaacgaaccctaagttacgtcccgtagtacgttctaacggttaactttccgttaggtcccggaacccggtacccgacgaacgaacccgacgggtaccctaaacctttttaacgttaaccgttcggttacgggacccgaaaggacgggagggtacccgtaccgaaggtttccggggaccccacgtaaaaacggtttaaccggtttccggttttaacccttaacctttaaggtttacggttacgggtaaacttcggggaacccggttacccgggttacgggggggaacccgtaacgggggtaacccctcgggggttaccctaaccccgggttcctacccccggtaacgg

SEQ ID NO: 51091 - DNA, 560 bp, Homo sapiens
  misc_feature: GYAE6OF02GZS5R.24.62.F07.1.454.CMB.1.raw
  modified_base (223)..(223): a, c, t, g, unknown or other
  misc_feature (223)..(223): n is a, c, g, or t
  modified_base (266)..(266): a, c, t, g, unknown or other
  misc_feature (266)..(266): n is a, c, g, or t
  modified_base (469)..(469): a, c, t, g, unknown or other
  misc_feature (469)..(469): n is a, c, g, or t
  modified_base (527)..(560): a, c, t, g, unknown or other
  misc_feature (527)..(560): n is a, c, g, or t
tcagactactatgtcacgaccggtgctcgatttagtagtcgcataaagggaaagggactggagtggattggccatatctacgccaatgggagaaccaggtacaacccctccctccagagtcgagtcaccatttcactggacccgtccaagaaccaattgtccctgagtctgaattctgtgaccgccgcagacacggccattattactgtgcgagagaggccgnagtggccgcaaactaagtcgtttctactattatggtatggacnccgtggggccgtagggaccgacggtcaccgtctcctcacgcctaccaccgaacgggccccagtccggtcctttccccctgggccacccctcctacccaagtacgactaccctcgtcgggggcctacgacggccggtcccgtgggctggcccgtcggtcgaaacgggtacttaccgttacccaactctaacggttagtttccgngtaacgggtccggggtactacggggaccaagggggcctaaccgtaagtacggaggctnnnnnnnnnnnnnnnnnnnnnnnnnnnnnnnnnn

SEQ ID NO: 51092 - DNA, 808 bp, Homo sapiens
  misc_feature: GYAE6OF02HF4F7.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcgaggagtcgggcccaggacctggtgaagccttcacacgaccctgtccctacacttgctactgtctctggtcgactccatcaatagtgtacttactattggagtctggactcccggaaacgccccgggtaccggggaagggacctgggacgtggacgttgggccctatacttcgtaccgccctaaagtggggaacaaccgtagggtaaccctaaaccccccgttccctaccgaacgtacggtccggacgttaccaccgtactttcaaccgttccggaccccggtacaaaacggaaccctaaactttcggtcccctagtacggtaccttagttaacgtttccgtcgttaccggaccccgtccggtaccacggtaaccgacccgggtcccttaacgtttaaccgttttaacctcgggttaccgaggtaacgggtcggtaacgggcccgtacgaaggggtttcccgggacccggtaacccgttaaacgttaaacggttttccgttttaaccgttaactttacgttttaaggtttacggtcggttaacggggtaacccgttcccgggtacgggggggacccggttaacgggggaccccgttaccggggtccccttaacccgggttcccgttccccgttaacccgg

SEQ ID NO: 51093 - DNA, 626 bp, Homo sapiens
  misc_feature: GYAE6OF02GNJ4S.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaagtgtgtacttactattggagctggactccggaagcccggaccgggaagggacctgggagtggattggccatatctacgcccaagtgggagaaccgaggtaccaacccctccaccagacgtcgagtcactattcacgtcggaccctaccaagaacctaacttcgtaccctgtacgtctagtaacttctgtcgaccgtccgcacgaccaccggccttacttacttcgttacgtgacgagtacgacgggacgcgagtcggcccgataaacccgttaagttccgtttactaacgtttattacgttaggttaacgtacggtaccggtccggtacggggccgtaacggggacccgtaccggttaccgtacccggttccgtcccgtaccg

SEQ ID NO: 51094 - DNA, 752 bp, Homo sapiens
  misc_feature: GYAE6OF02HMRTY.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtgttcttcctcctcctggtgcagctcccagatgggtcctgtcccaggttcaacttcaggagtcgggcccaggctggtgagccttcacagaccctgtccctcacttgcactgtctcgtggtggctcatcaatagtggtacttactattggagctggatccggaagccccggacgggaagggactgggagtggtagttcggacatagtcctaccggccaagtgggaacgaaccgacggtaacccaaccccctccctaccgacgtacgtacgacgtaccaacctactttcaacgttcggaacccgtaccgaaaacgtaaaccctaagtttccgtaccctttaggtacgttcctaacggttaatttccgttaggtaccgtaccccggccgtacgtacgaccgaacccggtccttaaccgttttaactacgtttacggcgtacggaaggacggacggtaccgcgtagggtccgggtaccaaacctaaccggtttaaagttccgtttttaacgtaacgtttaacgttttagttacgggttaacgttccgggtaaaccggtcccgggtttacggggggaccccgtaacgggggtacccccgttaaccgggttccccggtaaccccggttacccgttccccgtaacccgg

SEQ ID NO: 51095 - DNA, 718 bp, Homo sapiens
  misc_feature: GYAE6OF02G3NWE.24.62.F07.1.454.CMB.1.raw
  modified_base (263)..(263): a, c, t, g, unknown or other
  misc_feature (263)..(263): n is a, c, g, or t
tcagactactatgtcacgaccggtgctcgatttagtagtcgcataaagggaaagggtctgtgaagtcttcaccagtcctggacctcctgtgcaagaacatgaaacatctgtggttcttctcctcctggtggcagctcccagatgggtcctgtacccaggttcaacttcaggagtcgggccaggactggtgaagccttacacacgaccctgtccctcacttgcacttgtctctggtgctcatcaatcgtgtacttacaagttgngctggactcggaacgtcccggaccgggaagggtacgtggtaaggtggtacgttcggcctaagtacttcctaacggccaagttcgggaacaaaccgaaggtaacccaaacccccgtccctaacgacgtaacggtcgaacgtccaccgttattaccgtaacgtcggtaacccgtaccaaaacggtaaacctaaacgttcgttacctacggtacgtacgtaggtaactccttggaccgtacgtccgaggaacaaccggaccgtcctaaccttagtttaacgttcgcgtacgaggtaacgcggaccgacgtaacggtcggcccgtaacgtaaccgttaagttccgtttaccgtaacctttagttagtccggttaagtaccgggtactcccggggttacgggacccgggtaacgggacccggtaacggttacccggtacccgttccgttcccgtaaccgg

SEQ ID NO: 51096 - DNA, 681 bp, Homo sapiens
  misc_feature: GYAE6OF02HCDTQ.24.62.F07.1.454.CMB.1.raw
  modified_base (152)..(152): a, c, t, g, unknown or other
  misc_feature (152)..(152): n is a, c, g, or t
  modified_base (534)..(534): a, c, t, g, unknown or other
  misc_feature (534)..(534): n is a, c, g, or t
tcagactactatgtcacgaccggtgctcgatttagtagtcgcataaaagggaaagggtctgtgaaggcttcaccagtcctggacctcctgtgcaagaacatgaaacatctgtggttcttcctcctcctggtggcagctcccagatcggtccngtccaggttcaacttcgaggagtccggccaggactggtgaagtccttacacacgaccctcgtcctcacttcgacacttgtctcgtggtcgcctacgactactaacgttagtacgttaactacgttatggacgtcgtggtacgaccggacgtaccggaccggaaggtacgtaggaggtaggtaactcggtaccaagttacgacgtaccgaacctaagggtcgaaacgaacgaccggtaaccaccccgtccgtacaaggtcgaacgacgtctactcttacgaccgcggacccaacgaaacgtacctaagttccgaccgtagtacgtactagtaactcgtagacgccgtagacgaacgacaccggacttaacgttacgttaacgngtaccgagtacggactaagggaccgcgacgtgaaccgactaaacgttacggttaacctacgtaacgttagtacgttacggtaagccgaacggttccggtaagggaccgacgggtaaccgtaccgaccgtaaccgtccttacgaccgg

SEQ ID NO: 51097 - DNA, 836 bp, Homo sapiens
  misc_feature: GYAE6OF02J0SK8.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaacatctgtggttcttcctcctcctggtggcagcctacccaggatcgggtcctgtcccgtaaggtttccaaacctttcgagggtacgttcccgggaccctaggtacctgggtacgaacgtcctttacgaacgtacggaccccgtttgtccccgtactacccgtttggaccctaacgttggttccctaggttcggggtccggtaccttacccgaagttccgtaaaaggtttacggttacggttacctttaaacgttaggtttcgggaacgtcgttacggaacgtaacccgggtaacgaccccggggtaaccgggggaacgggtacgtacgggtacgttaggacgtttcgggacccctaagttacctaccggtaacgacgtaacggttacggggaaactaccggaaccggtaacctaacccctccgttacgacggtaacgtcgtacgcctacgttattaccgacgtaccgaccggtaccaagaaccgttgtaccgtcgtgtaacgtcttacggtaacttcctacggtacgtacccgtacgaacctacggaccgtacgtaaccgttacgtttataaccgttggtacgaccgtaaggacggtacggtaaccgacggtacggtaccggaccgttacgtaacgtaacgttcgttacgaacttactaggttaccgtggacggtaccctccgggtacggaccggtaacggcaaccggtacctacccggttcctaccggtaacg

SEQ ID NO: 51098 - DNA, 672 bp, Homo sapiens
  misc_feature: GYAE6OF02FY9V3.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctctggtggcagctcccagatgggtcctgtccctaggttcaacttcgaggagtcgggcccaggactggtgaagccttcacagaccctgtccctcacttgcactgtctctggtggctccatcaatgtggtacttactattggagctggagtccggaacgcccggaccgggaagggacgtggtaggtggattcggccgatagtctaacgaccaagtagggtacgaaaccaggtaacccaacccctccctaccgaggacgtcgacgtaccacctactttcgacgtcggacccgtacaaacgaacctaagttcgtacctgtacgtactacgtatttcgttcgtacgtaccgccgacgacgaccgaccggtacctacttacttactgtcgacgtagacggacggacggctaggtccggaccgaccgtaaacgttacggttaccgttttacgtaacgtttagttagttacggttgttacggtacccgtaccgggttacggggacccgggtacgggtaccggtaccggttacccgacccgttcgttacccgtaccgg

SEQ ID NO: 51099 - DNA, 870 bp, Homo sapiens
  misc_feature: GYAE6OF02I5STM.24.62.F07.1.454.CMB.1.raw
tcagactactatgtcacgaccggtgctcgatttagtagtcgcataaagggaaagggtctgtgaaggcttcaccagtcctggacctcctgtgcaagaacatgaaacatctgtggttcttcctcctcctggtggcagctcccagatgggtcctgtcccaggttcaacttcaggagtcgggcccaggactggtgaagccttcacacgaccctgtccctcacttgcactgtctctggtgctccatcaatagtgtacttactattggagcgtggactccggaacgcccggaccggggaagggacgtgggaggtggtagttcgggacctagttacgttaccgtaaccggtaccgtaaaggttcggggaaacgtaaacccggtaacgggtaacccctaaacccccccgttacccccgtacccgtaacggtaccggttaccggtaacgtaccctaacccttaacgttttaccaaccgttaccggggtaacccccgttaacccgaaaaccgtaaaaccccgttaaacgtttacccggttaccccgttaggtaccgtttaccgttaaggttaaaccttttccggtacggttacggaaccccggtccggtaccgaaccggaccgacccgggtacccttaacgttttactttacgttcggacgtacggtaacggacgggtacgggtaccgacgtacgggtccgggtacccgaaccgtaaaccgtttacggttttccgttttaaccgttaaacgtttagtttaaccggttagggtttaaccggttacggggaacccggttcccgggtaccgggggtacccgggtaaccggggtaacccggttacccggggtaccctaccccgggttcctaccccgtaacccgg

SEQ ID NO: 51100 - DNA, 579 bp, Homo sapiens
  misc_feature: GYAE6OF02GQ5GO.24.62.F07.1.454.CMB.1.raw
  modified_base (508)..(508): a, c, t, g, unknown or other
  misc_feature (508)..(508): n is a, c, g, or t
  modified_base (514)..(514): a, c, t, g, unknown or other
  misc_feature (514)..(514): n is a, c, g, or t
  modified_base (526)..(526): a, c, t, g, unknown or other
  misc_feature (526)..(526): n is a, c, g, or t
  modified_base (529)..(529): a, c, t, g, unknown or other
  misc_feature (529)..(529): n is a, c, g, or t
  modified_base (531)..(531): a, c, t, g, unknown or other
  misc_feature (531)..(531): n is a, c, g, or t
  modified_base (533)..(533): a, c, t, g, unknown or other
  misc_feature (533)..(533): n is a, c, g, or t
  modified_base (540)..(540): a, c, t, g, unknown or other
  misc_feature (540)..(540): n is a, c, g, or t
  modified_base (546)..(546): a, c, t, g, unknown or other
  misc_feature (546)..(546): n is a, c, g, or t
  modified_base (548)..(548): a, c, t, g, unknown or other
  misc_feature (548)..(548): n is a, c, g, or t
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
  modified_base (554)..(555): a, c, t, g, unknown or other
  misc_feature (554)..(555): n is a, c, g, or t
  modified_base (559)..(559): a, c, t, g, unknown or other
  misc_feature (559)..(559): n is a, c, g, or t
  modified_base (563)..(563): a, c, t, g, unknown or other
  misc_feature (563)..(563): n is a, c, g, or t
  modified_base (568)..(568): a, c, t, g, unknown or other
  misc_feature (568)..(568): n is a, c, g, or t
  modified_base (571)..(571): a, c, t, g, unknown or other
  misc_feature (571)..(571): n is a, c, g, or t
  modified_base (574)..(574): a, c, t, g, unknown or other
  misc_feature (574)..(574): n is a, c, g, or t
  modified_base (577)..(577): a, c, t, g, unknown or other
  misc_feature (577)..(577): n is a, c, g, or t
tcagactactatgtcacgaccggtgctcgatttagtagtcgcataaagggaagggactggagtggattggccatatctacgccaatgggagaaccaggtacaacccctccctccagagtcgagtcaccatttcactggacccgtccaagaaccaattgtccctgagtctgaattctgtgaccgccgcagacacggccacttattactgtgcgagagaggcgcagtggccgcaactaagtcgtttctactattagtggtatggacgccgtggggccgagggaccacggtcaccggtctcctcacgcctccacccgaacgggcccagtccggtccttccccccgtgggtccacccctccctcccaacggacgccacccgtcgtcgggggacacgacgcggcccgtggggctcgccgtggtacgaacggtacctacccttccacgaattacggttacgtctcgggaggccggggcgtagggacgaaacgggtccgtacaacggttacggtnacgtancgtagcactgcngtncngngtgtcgngcgagngngncncnnctgngcgngcacngcncgngtntg

SEQ ID NO: 51101 - DNA, 363 bp, Homo sapiens
  misc_feature: GYAE6OF01BUGHQ.8.71.G05.1.454.CMB.1.raw
  modified_base (358)..(363): a, c, t, g, unknown or other
  misc_feature (358)..(363): n is a, c, g, or t
tcagctcgcgtgtccacgaccggtgctcgatttagtgtcgtcgcaagagagagggggtgaggtgaaagatgagctggaggaccgcaataggggtaggtcccctgtggaaaaagggtcagaggggatagaagttattcagcaggcacacaacagaggcagttccagttttcactctcacaatcagcagtctcgaacctgaagattttgcaacttactactgtcaacagacttacaatataccgaggacgttcggtcaagggaccaaggtggagatcaaacgaactgtggctgcaccatctgtcttcatcttcccgccatctgagacacgcgagctgagcgggctggcaaggcgcatagnnnnnn

SEQ ID NO: 51102 - DNA, 363 bp, Homo sapiens; identical to SEQ ID NO: 51101
  misc_feature: GYAE6OF01BZ4D4.8.71.G05.1.454.CMB.1.raw
  modified_base (358)..(363): a, c, t, g, unknown or other
  misc_feature (358)..(363): n is a, c, g, or t

SEQ ID NO: 51103 - DNA, 504 bp, Homo sapiens
  misc_feature: GYAE6OF01DP0ON.8.71.G05.1.454.CMB.1.raw
  modified_base (499)..(499): a, c, t, g, unknown or other
  misc_feature (499)..(499): n is a, c, g, or t
tcagctcgcgtgtccacgaccggtgctcgatttagtgtcgtcgcaagagagagggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcagtcagtccattaacaactatttaaattggtatcaacaaaaaccagggaaagccctaaatacctggtctatactgcatccactttgcaaagtgggtcccatcaaggttcagtgcagtggatttgggacagttttcactctcacaatcagcagtctcgaacctgaagattttgctaacttactactgtcaacagacttacaatatacgagacgttcggtacaaggaccaaggtggagaatcaaacgactgtggctgcacatctgtcttcatctcccgcntctag

SEQ ID NO: 51104 - DNA, 604 bp, Homo sapiens
  misc_feature: GYAE6OF01DH9ZB.8.71.G05.1.454.CMB.1.raw
  modified_base (224)..(224): a, c, t, g, unknown or other
  misc_feature (224)..(224): n is a, c, g, or t
tcagctcgcgtgtccacgaccggtgctcgatttagtgtcgtcgcaagagagaggggggagtcagtctcagtcaggacacagcatggacatgagggtcccccgctcagctcctggggctcctgctcctctggctccgaggtgccagttgtgacatccagttgacccagtcctccctcctctctgtctgcttctgtgggagacagcgtcaccatcacttgccgggngagtcagtccattaacaactatttaaattgtatacaaacaaaaacaggaacaccctaaatacctgtactatactgcatcctactttgactaaagtcggggtacccatcgtaaggttcaggtggcagtggtagtttgggacttagttttacactctacactaatcagctagttcctacgtaacctagaagtattttcgactaacttactaacttgtacaactacgtacttaacaatactaacgaggtacgttacggtacgaacgggtaccgtaagggtagagtaactacgaaaacgtacgtaggacggtacgtacgacctaaccacttccgttacgttacctttacgtacttacccgttaccccgtacctactcgtaacgg

SEQ ID NO: 51105 - DNA, 367 bp, Homo sapiens
  misc_feature: GYAE6OF01C1RAR.8.71.G05.1.454.CMB.1.raw
  modified_base (358)..(367): a, c, t, g, unknown or other
  misc_feature (358)..(367): n is a, c, g, or t
tcagctcgcgtgtccacgaccggtgctcgatttagtgtcgtcgcaagagagaggggggtgaggtgaaagatgagctggaggaccgcaataggggtaggtcccctgtggaaaaagggtcagaggggatagaagttattcagcaggcacacaacagaggcagttccagttttcactctcacaatcagcagtctcgaacctgaagattttgcaacttactactgtcaacagacttacaatataccgaggacgttcggtcaagggaccaaggtggagatcaaacgaactgtggctgcacatctgtcttcatcttcccgcatctgagacacgcgagctgagcgggctggcaaggcgcatacgnnnnnnnnnn

SEQ ID NO: 51106 - DNA, 364 bp, Homo sapiens
  misc_feature: GYAE6OF01DY0E8.8.71.G05.1.454.CMB.1.raw
  modified_base (359)..(364): a, c, t, g, unknown or other
  misc_feature (359)..(364): n is a, c, g, or t
tcagctcgcgtgtccacgaccggtgctcgatttagtgtcgtcgcaagagagaggggggtgaggtgaaagatgagctggaggaccgcaataggggtaggtcccctgtggaaaagggtcagaggggatagaagttattcagcaggcacacaacagaggcagttccagttttcactctcacaatcagcagtctcgaacctgaagattttgcaacttactactgtcaacagacttacaatataccgaggacgttcggtcaagggaccaaggtggagatcaaaacgaactgtggctgcaccatctgtcttcatcttcccgccatctgagacacgcgagctgagcgggctggcaaggcgcatagnnnnnn

SEQ ID NO: 51107 - DNA, 516 bp, Homo sapiens
  misc_feature: GYAE6OF01BNOJ8.8.71.G05.1.454.CMB.1.raw
  modified_base (510)..(510): a, c, t, g, unknown or other
  misc_feature (510)..(510): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccaggaaagccctaaatacctggtctatactgcatccactttgcaaagtgggtcccatcaaggttcagtgcagtggattgggactagttttcactctcacaatcagcagtctcgaacctgaagtattttgactaacttactactgtacaacagtacttacaatataccgaggtacgttcggacaacgggacaaggtggaagatacaaacgtactgtggctgcacatctgtctctatctacccgcntctacg

SEQ ID NO: 51108 - DNA, 521 bp, Homo sapiens
  misc_feature: GYAE6OF01ARPJ5.8.71.G05.1.454.CMB.1.raw
  modified_base (268)..(268): a, c, t, g, unknown or other
  misc_feature (268)..(268): n is a, c, g, or t
  modified_base (512)..(512): a, c, t, g, unknown or other
  misc_feature (512)..(512): n is a, c, g, or t
tcagctcgcgtgtccacgaccggtgctcgatttagtgtcgtcgcaagagagagggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacactattaatggtatcaacaaaacagggaaanccctaaatacctggtctatactgcatccactttgcaaagtgggtcccatcaaggttcagtggcagtggtatttgggactagtttcactctcacatcagcagtctcgaacctgaagtatttgactaacttactactgtacaactagacttacaattataccgagtacgttcggtacaagggacctaaggtgaacgatacgaaacgactgtagctgccactatctgttccttacacttcctacccnctatctacg

SEQ ID NO: 51109 - DNA, 591 bp, Homo sapiens
  misc_feature: GYAE6OF01EOYHH.8.71.G05.1.454.CMB.1.raw
tcagctcgcgtgtccacgaccggtgctcgatttagtgtcgtcgcaagagagaggggggagtcagtctcagtcaggacacagcatggacatgagggtccccgctcagctcctggggctcctgctcctctggggggctccgaggtgccagttgtgacatccagttgacccagtcctccctcctctctgtctgcttctggtgggagacagcgtcaccatcacttggccgggcgagtcagtccaattaacaacttaatttaaattggtaatacaaacaaaaaccgagggaaacacccctaaatacctggtactatactgcatcctactttgacaaaggtcgggtccatcaagttcagtgcagtgattgggactagttttcactctacacaatcagcagtctacgaacctagaagtatttgactaacttactactagtacaactagtaacttaacaatacgtaaccgaggtacgttcggtacgaagggaccgtaagggtggaagtaactacgaaacgtaactggtacggtctacggacctaacctacttcgttacgttacttacctacttcccttaccccggcctacgtcgtacgg

SEQ ID NO: 51110 - DNA, 368 bp, Homo sapiens
  misc_feature: GYAE6OF01DGLEC.8.71.G05.1.454.CMB.1.raw
  modified_base (324)..(324): a, c, t, g, unknown or other
  misc_feature (324)..(324): n is a, c, g, or t
  modified_base (360)..(368): a, c, t, g, unknown or other
  misc_feature (360)..(368): n is a, c, g, or t
tcagctcgcgtgtccacgaccggtgctcgatttagtgtcgtcgcaagagagaggggggtgaggtgaaagatgagctggaggaccgcaataggggtaggtcccctgtggaaaaagggtcagaggggatagaagttattcagcaggcacacaacagaggcagttccagttttcactctcacaatcagcagtctcgaacctgaagattttgcaacttactactgtcaacagacttacaatataccgaggacgttcggtcaagggaccaaggtggagatacaaacgaactgtggctgcacatctgtctcatccttcccgccatctganacacgcgagctgagcgggctggacaaggcgcatagnnnnnnnnn

SEQ ID NO: 51111 - DNA, 368 bp, Homo sapiens
  misc_feature: GYAE6OF01ENLFU.8.71.G05.1.454.CMB.1.raw
  modified_base (353)..(353): a, c, t, g, unknown or other
  misc_feature (353)..(353): n is a, c, g, or t
  modified_base (359)..(368): a, c, t, g, unknown or other
  misc_feature (359)..(368): n is a, c, g, or t
tcagctcgcgtgtccacgaccggtgctcgatttagtgtcgtcgcaagagagaggggggtgaggtgaaagatgagctggaggaccgcaataggggtaggtcccctgtggaaaaagggtcagaggggatagaagttattcagcaggcacacaacagaggcagttccagttttcactctcacaatcagcagtctcgaacctgaagattttgcaacttactactgtcaacagacttacaatataccgaggacgttcggtcaagggaccaaggtggagatcaaacgaactgtggctgcaccatctgtcttcatcttcccgcatctgagacacgcgagctagagcgggctggcaaggcncatagnnnnnnnnnn

SEQ ID NO: 51112 - DNA, 375 bp, Homo sapiens
  misc_feature: GYAE6OF01DG4MR.8.71.G05.1.454.CMB.1.raw
  modified_base (364)..(375): a, c, t, g, unknown or other
  misc_feature (364)..(375): n is a, c, g, or t
tcagctcgcgtgtccacgaccggtgctcgatttagtgtcgtcgcaagagagaggggggtgaggtgaaagatgagctggaggaccgcaataggggtaggtcccctgtggaaaaagggtcagaggggatagaagttattcagcaggcacacaacagaggcagttccagttttcactctcacaatcagcagtctcgaacctgaagattttgcaacttactactgtcaacagacttacaatataccgaggacgttcgtacaagggaccaaggtggagatcaaacgactgtggctgcaccatctgtctcatcttcccgctatcctgacgacacgcgagctaggacgcgggctggcgaaggcgcaatagnnnnnnnnnnnn

SEQ ID NO: 51113 - DNA, 513 bp, Homo sapiens
  misc_feature: GYAE6OF01BIRXH.8.71.G05.1.454.CMB.1.raw
  modified_base (504)..(504): a, c, t, g, unknown or other
  misc_feature (504)..(504): n is a, c, g, or t
  modified_base (507)..(507): a, c, t, g, unknown or other
  misc_feature (507)..(507): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgctaacttactactgtcaacagacttacaatataccgagacgttcggtcaagggaccaaggtgagatacaaacgaactgtggctgcacatctgtcttcatcttcccnctntctacg

SEQ ID NO: 51114 - DNA, 533 bp, Homo sapiens
  misc_feature: GYAE6OF01EMV3L.8.71.G05.1.454.CMB.1.raw
  modified_base (514)..(514): a, c, t, g, unknown or other
  misc_feature (514)..(514): n is a, c, g, or t
  modified_base (523)..(523): a, c, t, g, unknown or other
  misc_feature (523)..(523): n is a, c, g, or t
tcagctcgcgtgtccacgaccggtgctcgatttagtgtcgtcgcaagagagaggggggagtcagtctcagtcaggacacagcatggacatgagggtcccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatacaaacaaaaaccagggaaacgacccctaaatacctggtactatactgcatccactttgacaaaggtcgggtcccatcaaggttcagtggcagtggtatttgggactagttttcacttctcacatcagcagtctacgaacctgaagtattttgactaacttactactgtacaactagtacttacaatataccgaggtacgttcgacgaaggaccaaggtggagatacgaaacgatgtgacgtgcacatctgtcttcnttctacccnctatcgtacg

SEQ ID NO: 51115 - DNA, 528 bp, Homo sapiens
  misc_feature: GYAE6OF01DCL7X.8.71.G05.1.454.CMB.1.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (491)..(491): a, c, t, g, unknown or other
  misc_feature (491)..(491): n is a, c, g, or t
  modified_base (502)..(502): a, c, t, g, unknown or other
  misc_feature (502)..(502): n is a, c, g, or t
  modified_base (521)..(521): a, c, t, g, unknown or other
  misc_feature (521)..(521): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtcctccctcctctctgtctgcttctgtggganacagcgtcaccatcacttgccgggnagtcagtccattaacaactatttaaattggtatcaaacaaaaaccagggaaacgcccctaaaatacctggtctatactgcatccactttgacaaagtcggggtcccatcaaggttcagtggcagtggatttggggactagttttcactctcacaatcagcagtctacgaacctgaagtattttgctaacttactactgtacaacagtacttacaattataccgaggtacgttcgtacaagggaccaaggtgagatcaaacgactgtgntgcaccatctntcttcacttcttcccgctntctacgg

SEQ ID NO: 51116 - DNA, 513 bp, Homo sapiens
  misc_feature: GYAE6OF01B07W3.8.71.G05.1.454.CMB.1.raw
  modified_base (273)..(273): a, c, t, g, unknown or other
  misc_feature (273)..(273): n is a, c, g, or t
  modified_base (505)..(505): a, c, t, g, unknown or other
  misc_feature (505)..(505): n is a, c, g, or t
  modified_base (507)..(507): a, c, t, g, unknown or other
  misc_feature (507)..(507): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactattaaatggtatcaacaaaaaccagggaaancccctaaatacctggtctatactgcatccactttgacaaagtgggtcccatcaaggttcagtggcagtggattgggactagttttcactctcacaatcagcagtctcgaacctgaagtattttgactaacttacgtactgtacaacagacttacaatatacgaggacgttcggtacaagggaccaaggtgagatacaaagactgtgcgtgcacatctgtcttcacttcttcncnccatcg

SEQ ID NO: 51117 - DNA, 618 bp, Homo sapiens
  misc_feature: GYAE6OF01DWWPH.8.71.G05.1.454.CMB.1.raw
  modified_base (385)..(385): a, c, t, g, unknown or other
  misc_feature (385)..(385): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctctctggctccgaggtgccagttgtgacatccagttgacccagtctccctctctctgtctgcttctgtgggagacagcgtcaccatcacttgccgggcgagtcagtccaattaacaacttatttaaattggtatacaaacaaaaaccagggaaacgaccctaaatacctaggtactatactgctatcctactttgactaaaggtcggggtacccatacgaaggttcagtggctagtggtagttgggactagttttcactctanacatcagcagtctacgaacctgaagtattttagactaaacttaactaactcgtacaactacgtaacttaacaattaactaaccggaagggtacgttacgggtacgaaacgggtaccgaagggttaggaacgtaacgtacgtaaaacggtaaccgtaggtagggtacttacgacctaaccgtattccgttagttcctttacgtaacttccgttaccttacggccctagtaccgg

SEQ ID NO: 51118 - DNA, 596 bp, Homo sapiens
  misc_feature: GYAE6OF01DLK9H.8.71.G05.1.454.CMB.1.raw
  modified_base (197)..(197): a, c, t, g, unknown or other
  misc_feature (197)..(197): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctctctctgtctgcttctggtggganacagcgtcaccatcacttgccgggcagtcagtccaattaacaactatttaaatggtatacaaacaaaaccagggaaacgaccctaaatacctaggtactatactgcaatccactttgactaaaggtcgggtacccatacaaggttcagtggctaggtggtatttgggactagttttcactctcaacaatcagcagtctacgaacctagaagtattttcgactaaacgtttactaacttcgtactaacaagtacttaacaatataaccggaggtacggttacggacgaacgggacctaagggtggaagataccgaaaacgtaacgttgtacggactcgaccgtaacagttccgtacgttaccttaccgtacttacccgttacccaccttatccgtaacgg

SEQ ID NO: 51119 - DNA, 377 bp, Homo sapiens
  misc_feature: GYAE6OF01DPVHE.8.71.G05.1.454.CMB.1.raw
  modified_base (357)..(357): a, c, t, g, unknown or other
  misc_feature (357)..(357): n is a, c, g, or t
  modified_base (363)..(377): a, c, t, g, unknown or other
  misc_feature (363)..(377): n is a, c, g, or t
tcagctcgcgtgtccacgaccggtgctcgatttagtgtcgtcgcaagagagaggggggtgaggtgaaagatgagctggaggaccgcaataggggtaggtcccctgtggaaaaagggtcagaggggatagaagttattcagcaggcacacaacagaggcagttccagttttcactctcacaatcagcagtctcgaacctgaagattttgcaacttactactgtcaacagacttacaatataccgaggacgttcggtcaagggaccaaggtgagatacaaacgaactgtggactcgcaccatctgtcttcatcttcccgcatctgacgacacgcgagcctgacgcggctggcaagggcncatagnnnnnnnnnnnnnnn

SEQ ID NO: 51120 - DNA, 512 bp, Homo sapiens
  misc_feature: GYAE6OF01ALU84.8.71.G05.1.454.CMB.1.raw
  modified_base (507)..(507): a, c, t, g, unknown or other
  misc_feature (507)..(507): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcagtcagtccattaacaactatttaaatggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagtattttgctaacttactactgtcaacagacttacaatatacgaggtacgttcggtacaagggaccaaggtggagatcaaacgactgtggctgcaccatctgtcttcatctacccgcntctag

SEQ ID NO: 51121 - DNA, 600 bp, Homo sapiens
  misc_feature: GYAE6OF01BCHA7.8.71.G05.1.454.CMB.1.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
tcagctcgcgtgtccacgaccggtgctcgatttagtgtcgtcgcaagagagaggggggagtcagtctcagtcaggacacagcatggacatgagggtccccgctcagctcccggggctcctgctcctctggctccgaggtgccagttgtgacatccagttgacccagtctccctcctctctgtctgcttctgtggganacagcgtcaccatcacttgccgggnagtcagtccaattaacaacttatttaaattggtaatacaaacaaaacagggaaacaccctaaatacctaggtactatactgctactcctactttgactaaaggtcgggtaccatactaaggttcaggttggacgtaggtggtagtttaggggactagttttcactctacaacatcagacagtctacgaacctagaagttatttgactaacttactactcgacaacagtacttaactaatacgtacgaggtacgtacggaacgtaacgggaccaagggtgaataactaccgaaacgtacgtggtacgacgttcgaaccgacctatcgttacgttccttaccgtacttcccgttaccccgactagttccgaagtaaccgg

SEQ ID NO: 51122 - DNA, 836 bp, Homo sapiens
  misc_feature: GYAE6OF01BT16P.8.71.G05.1.454.CMB.1.raw
tcagctcgcgtgtccacgaccggtgctcgatttagtgtcgtcgcaagagagagggggggagtcagtctcagtcaggacacagcatggacatgagggtccccgctcagctcctggggctcctgctcctctggctccggaggtgccagttgtgacatccagttgacccagtcctccctcctctctgtctgcttcgtggtgggacgacagccgtccaccatcctacttcggccgggcgagtcagtaccaattaacaacttaatttaaattgtaatacaaaacaaaaaccgagggaaacaccctaaataccgtggtactatactgcatcctactttgacgtaaaggtcgggtaccctaatacgtaacggttctaggtcggacgtaggtaggtagtttacggggaacttacggttttccaacgttctaccaaacgtaacgtaccgaacgtacgtaacggttacccttaaccggtaaacccttaaggtaaacggtttaacgtttttaacggaaaccctttaaaaccgttttaccgttaaacccgttacggttaaacccgtaaaaccgtaaccgttaaacccttttaaaacgtaaaacgtttaaaccggtaaacccgggtaaaccggggtttaacccgggtttaacccgggttaaacccgggtaaaacgggggtaaccccggtaaagggggtttaacgggaaaacggttaaccgttaaaacccggtaaaaaaccgggttaacgttacggggtaaccggtaccgttacgaacccgtaaccgtaaccgttcgttaccgtttaccttacgtaccttaccccgttaccccggactacgtccgtaacg

SEQ ID NO: 51123 - DNA, 866 bp, Homo sapiens
  misc_feature: GYAE6OF01CQJIR.8.71.G05.1.454.CMB.1.raw
  modified_base (198)..(198): a, c, t, g, unknown or other
  misc_feature (198)..(198): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtcctccctcctctctgtctgcttctgtggganacagcgtcaccatcacttgccgggcagtcagtccaattaacaactatttaaattggtatcaaacaaaaccgagggaaacgcccctaaaatacctaggtactataactgactactacctactttcgactaaaacggtcggggtaccccagttaccgtaaagggtttccaaggttgggacctaaggttgggtaacgttttgggggaaccttaggtttttaccacctttctacctaaacctaaattaccgaaggtacctaacggttcccgtaaccgtaaacccgttaggtaaacgttaacgttttttacgggaacccttaaaaccgttttaaccgttaaaccgtttcggttaaacccgtaaaaccgttaacgggtttaaaaccctttaaaccgtaaaacgtttaaaccgtttaaccccgggtaaacggggtttaaaccccgggttttaaccgggtaacccggtaaaaacgggggtaaaccccgtaaagggggtttaacgggaaacggtaaaccgtttaaccgaaaaacccgggtaaacgttaggggtaccggtaccgttacgggtaacccctaacccggtaacttttcccggttacggttaacccctttttaccgaaaccgttttcccctttaaccccccggtaacctaacgttttcccgggtaaaccggg

SEQ ID NO: 51124 - DNA, 456 bp, Homo sapiens
  misc_feature: GYAE6OF01BQ2QT.8.71.G05.1.454.CMB.1.raw
  modified_base (428)..(456): a, c, t, g, unknown or other
  misc_feature (428)..(456): n is a, c, g, or t
tcagctcgcgtgtccacgaccggtgctcgatttagtgtcgtcgcaagagagaggggggtgaggtgaaagatgagctggaggaccgcaataggggtaggtcccctgtggaaaaagggtcagaggggatagaagttattcagcaggcacacaacagaggcagttccagttttcactctcacaatcagcagtcctcgaacctgaagtattttgactaacttactactgtacaacagtacttacaatataccgaggtacgttcggtacgaagggaccaaggtaggagtaactacgaaaacgtaacctggtcggactacggaccaaccacttcttgtccgtttacctacttccttccccgcctacttccgtagacgaccaccgcgacgtctaggacggtccgggacgtcggacgaaacggcgacaagtggacnnnnnnnnnnnnnnnnnnnnnnnnnnnnn

SEQ ID NO: 51125 - DNA, 391 bp, Homo sapiens
  misc_feature: GYAE6OF01C3OJS.8.71.G05.1.454.CMB.1.raw
  modified_base (362)..(362): a, c, t, g, unknown or other
  misc_feature (362)..(362): n is a, c, g, or t
  modified_base (369)..(391): a, c, t, g, unknown or other
  misc_feature (369)..(391): n is a, c, g, or t
tcagctcgcgtgtccacgaccggtgctcgatttagtgtcgtcgcaagagagaggggggtgaggtgaaagatgagctggaggaccgcaataggggtaggtccccctgtggaaaaagggtcagagggggatagaagttattcagcaggcacacaacagaggcagttccagttttcactctcacatcagcagtctcgaacctgaagattttgcaacttactactgtcaactagacttacaatataccgaggacgttcggtcaagggaccaaggtggagatacaaacgaatgtggctgcacatctgtcttcatcttccggcatccgtgagaccacggtcgaagctaggagcgggctggacagggcncatacgnnnnnnnnnnnnnnnnnnnnnnn

SEQ ID NO: 51126 - DNA, 678 bp, Homo sapiens
  misc_feature: GYAE6OF01DRA4B.8.71.G05.1.454.CMB.1.raw
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatcccagttcgacccagtcctccctcctctctgtctgtcttctggtggagacagcgtccacctatcacgttggcccgggcgagtcacgtacctaattaaacctaattaagtttaaagttggtaactacaaaacaaaaaccgaagggaaacacccctaaataccgtggtacttatactagactactcctacttagactaaagtcgggtaccctatacgtaaggtcaggtaggctaggtggagtttacgggacttagtttcgacttcgtacaacgtaatcgagactacgtacgtaccgtaaccgtagtaacgttatttacggacttaaacttacttacgtacgtaactaacggtaacttaacccgttaataaacgttaaccgtacggtaaacgggtttcgtaaccggtaacggaaccgggtaaccgtaagggtacgaagtacgtaacgaacggtaactggagtccgtagaccgtacgtacttccgtacgttacttaccgtcttaccgtacccccgtatcgtacctacgg

SEQ ID NO: 51127 - DNA, 551 bp, Homo sapiens
  misc_feature: GYAE6OF01ARA79.8.71.G05.1.454.CMB.1.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (268)..(268): a, c, t, g, unknown or other
  misc_feature (268)..(268): n is a, c, g, or t
  modified_base (544)..(544): a, c, t, g, unknown or other
  misc_feature (544)..(544): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccgggnagtcagtccattaacaactattaatgtatcaaacaaaacagggaanaccctaaatacctggtactatactgcataccactttgacaaagtcgggtcccatcaaggttcagtggcagtggtagtttcgggactagttttcactctacacaatcagcagtctacgaactgaagtatttcgactaacgttactactctacaacagtacttaacaataactacgacggtacgttcggtacgaacgggaccaagggtggagtataccgaaacgtatcgtaggctcgactaccgattcctcgttctacgtacttccgtaccccgcctntcgtacg

SEQ ID NO: 51128 - DNA, 567 bp, Homo sapiens
  misc_feature: GYAE6OF01BX8B4.8.71.G05.1.454.CMB.1.raw
  modified_base (191)..(191): a, c, t, g, unknown or other
  misc_feature (191)..(191): n is a, c, g, or t
  modified_base (198)..(198): a, c, t, g, unknown or other
  misc_feature (198)..(198): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtcctccctcctctctgtctgcttcngtggganacagcgtcaccatcacttgccgggcagtcagtccattaacaactattaaatgtatcaacaaaaccaggaaacgaccctaaatacctggtactatactgcatccactttgacaagtgggtcccatcaaggtcagtgcagtgtattgggactagtttcactctacacaatcagcagtctacgaacctgaagtattttcgactaacttactactgtacaactagacttaacaatacgtaaccgaggtaacgttcggtaccgaagggtacccgaagggtacggaagatacgaaacgtaacgtggtacggctacgccaactacgtccttacgttcttaccgtacttcccttaccccggcctagttccgtaacgg

SEQ ID NO: 51129 - DNA, 614 bp, Homo sapiens
  misc_feature: GYAE6OF01BFD2Q.8.71.G05.1.454.CMB.1.raw
  modified_base (199)..(199): a, c, t, g, unknown or other
  misc_feature (199)..(199): n is a, c, g, or t
  modified_base (484)..(484): a, c, t, g, unknown or other
  misc_feature (484)..(484): n is a, c, g, or t
  modified_base (540)..(540): a, c, t, g, unknown or other
  misc_feature (540)..(540): n is a, c, g, or t
  modified_base (566)..(566): a, c, t, g, unknown or other
  misc_feature (566)..(566): n is a, c, g, or t
  modified_base (604)..(604): a, c, t, g, unknown or other
  misc_feature (604)..(604): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtcctccctcctctctgtctgcttctggtggganacagcgtcaccatcattcggccgggcgagtcagtccaattaacaacttattaaattggtatacaaaacaaaacgaggaaacaccctaaatacctggtactatactgactactcctactttgactaaaggtcggtacccatacgtaaggtcaggtgactaggtgtagttggactgtttacactctacgaacacttcgagtcctacgttacgtaccgaaccgttaggtaaacgttactttagacccttaaacgttacttaactacgtacaaacgtactacctttaanaacttaacgtaccggaggtttaccggtacgtaacgaacgggacctaagggtagaanacgtaacgaaacgtacgtggcgtacnggaccacttgtccttagtcttacctacttcctacccgntgtcgaacgg

SEQ ID NO: 51130 - DNA, 681 bp, Homo sapiens
  misc_feature: GYAE6OF01CZSA9.8.71.G05.1.454.CMB.1.raw
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtcctccctcctctctgtctgcttctggtgggagacagcgtcaccatccacttgccgggcgagtcagtccattaacaacttaatttaatggtatacaaaacaaaacgagggaaacaccctaaatacctggtactatactgacactcctactttagactaaagggtcggggtaccctagtacgtaaggttccgaggtggactaggttagggtaagttttcggggaacttaggttttccacttctaccaactaatcagactagtccgtacgtaacctggtaaagttattttcgactaaacctttactaaccgttgtaccaaactacgtaaccttaacaattaacgtaaccgtacgggtaccgtttaccggaacggtaaacggggtacccgtaagggtacggaagtaacgttaccgaaaaacggtacgttagggtacgtaccgtacggtacccaacttacgttcgttacgttacccttacgtactttacccccgttaccccgacctagttccgtaacgg

SEQ ID NO: 51131 - DNA, 665 bp, Homo sapiens
  misc_feature: GYAE6OF01BQVOO.8.71.G05.1.454.CMB.1.raw
  modified_base (142)..(142): a, c, t, g, unknown or other
  misc_feature (142)..(142): n is a, c, g, or t
  modified_base (643)..(643): a, c, t, g, unknown or other
  misc_feature (643)..(643): n is a, c, g, or t
tcagctcgcgtgtccacgaccggtgctcgatttagtgtcgtcgcaagagagaggggggagtcagtctcagtcaggacacagcatggacatgagggtcccccgctcagctccgtggggctcctgctcctctggctccgaggtnccagttgtgacatcctagttcgacccagtcctccctcctctctgtctgtcttcgtggtcgggagacagccgtcaccatctacggttcggccggggcacgtcaggtccctaattaaactaacttaagtttaaagttggtaactaacaaaaccgtaaaaacggacgggtaaacctacccctaaagtaccgtcggtactaactacgtcgactactcctacgtttcgacgtaacggtcgggtacccataccggtagtcgagtggacgtaggtgtacgtttagggacttacgttttcacttcgaccaactactacgtagacgttacgtacctacgtaacctagtaacttcttaggaaccttaacgttactacgtacgtaacacctaagttactaacgtaacgtctaacggtcgtacgtcggaacggaacggtacgaggttacgaagtactaccgaaacgttacgtcgacgtctacgacctacgtactcgttagttcccagtacccnccttaacccgctgtccctaagg

SEQ ID NO: 51132 - DNA, 411 bp, Homo sapiens
  misc_feature: GYAE6OF01AJAE6.8.71.G05.1.454.CMB.1.raw
  modified_base (314)..(314): a, c, t, g, unknown or other
  misc_feature (314)..(314): n is a, c, g, or t
  modified_base (381)..(382): a, c, t, g, unknown or other
  misc_feature (381)..(382): n is a, c, g, or t
  modified_base (384)..(411): a, c, t, g, unknown or other
  misc_feature (384)..(411): n is a, c, g, or t
tcagctcgcgtgtccacgaccggtgctcgatttagtgtcgtcgcaagagagaggggggtgaggtgaaagatgagctggaggaccgcaataggggtaggtccccctgtggaaaaagggtcaggaggggatagaagttattcagcaggcacacaacagaggcagttccagttttcactctcacaatcagcagtctcgaacctgaagtattttgactaacttactactgtacaacagacttaacaatataccgaggtacgttcggtacgaagggaccaggtggagatacaaacgactgtgctgcacatctcgtctcnctctcccgctatcgtagacacacgcgagctggacggcgggctacggaccgaaggccgacgtagtagnngnnnnnnnnnnnnnnnnnnnnnnnnnnnn

SEQ ID NO: 51133 - DNA, 665 bp, Homo sapiens
  misc_feature: GYAE6OF01A6789.8.71.G05.1.454.CMB.1.raw
  modified_base (199)..(199): a, c, t, g, unknown or other
  misc_feature (199)..(199): n is a, c, g, or t
  modified_base (215)..(215): a, c, t, g, unknown or other
  misc_feature (215)..(215): n is a, c, g, or t
tcagctcgcgtgtccacgaccggtgctcgatttagtgtcgtcgcaagagagaggggggagtcagtctcagtcaggacacagcatggacatgagggtccccgctcagctcccggggctcctgctcctctggctccgaggtgccagttgtgacatccagttcgacccagtcctccctctctctgtctgcttctggtggganacagccgtcaaaaccntccacgttcggaccgggcagtcagtccaattaacaacttatttaattgtatacaaacaaaacgaggaactaccctaaatacctggtactatacgtgctagtccctagtttcgactaaaggtcgggtaccctagtacgtaaggttcaggtcggtcaaggtcggtagtttacgggaacttagtttccacttctacgaactactcgaagtctacgtacttacgaaccttaggaagtttactttacgaacttaaccgttaacgtacttacgtacctaatacgttaactaactaactacgtaacggtaacggtaccgttacgtagaacgggaccgtaagggtacgtaagtacgtaaccaaacggtacgtcggtacggtcacggtacctaacctgttacctcgttaccttacgtaccctttcccgtcctaaccgttactccggtcgtaaacccggg

SEQ ID NO: 51134 - DNA, 808 bp, Homo sapiens
  misc_feature: GYAE6OF01BXKK0.8.71.G05.1.454.CMB.1.raw
  modified_base (789)..(789): a, c, t, g, unknown or other
  misc_feature (789)..(789): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctctctggctccgaggtgccagttgtgacatccgagttcgacccagtcctccctcctctctgtctgcttcgtgtggagacagcgtcacctatcacgttcggccgggacgacgtcacgtaccaattaacaacttaatttaaagttggtaactaaccaaaaaccaaaaaaccggtaacgggaaaacctaaccccttaaaatacccgtacggttaccttaactaccgtacgacctacttacccttaacgtttcggaaccgtaaagggtccgggtaccctaagtacgtaaacggttcgaaggtcggtacgaggttcggtaagttttacggggaaccttacgtttttaccgaaccgtttacctaacgtaaactaacgtacgaacgtaccgtaacggttcctaacccggtaaaccgttaggtaaaacgtttacgttttaacgaacccttaaaacctttaacctaacgtttaaccgtaacctaaaacgtaacgttaaaccttaaccaaagtttaaccgtaaccggtaacgggttaaccggttcggtaaccgtaaacgggtaaccgtaaaggggttacgtaagtaacgtaaccggaaaacgttacggttggtacggtactacggacccgtaactacgttcgttaccgtcctttaccaacgtttccccgtaaccccncttacgtacccgtaacggg

SEQ ID NO: 51135 - DNA, 759 bp, Homo sapiens
  misc_feature: GYAE6OF01B0Q7M.8.71.G05.1.454.CMB.1.raw
  modified_base (211)..(211): a, c, t, g, unknown or other
  misc_feature (211)..(211): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtcctccctcctctctgtctgcttctggtgggagacagcgtcaccntcacttggccggcgagtcagtccattaacaatatttaaatgtactacaaacaaaaccgagggaacaccctaaatacctggtactatactgactactacctactttgacgtaaacggttcgggtacccctaagtacgtaaacggttccaagggttcggacgtaggttagggtacgttttcggggaacttacgtttttccactttccgtactaacgtaaactcgtaacgtaccgtacggttcctaccggtaaaccgttaggtaaacgtttaacgtttttacggtaacccttaaacgtttaaccgttacgttaacggttaaccctaaacgttacggtaaacttttaaacgaaacttaccggttaaccggaacgggttaccgggttaccgggtaacggtaacggggaacccgtaagggttacgggaagtaaccgtaacggtaaaccgtacggttacggtacggtacctagacccgtaaccctggttcccttacgtttaccgttaccttaaccgttccccttttaccccggacccttaatcccggttaaccgg

SEQ ID NO: 51136 - DNA, 855 bp, Homo sapiens
  misc_feature: GYAE6OF01EXM4H.8.71.G05.1.454.CMB.1.raw
tcagctcgcgtgtccacgaccggtgctcgatttagtgtcgtcgcaagagagaggggggagtcagtctcagtcaggacacagcatggacatgagggtccccgctcagctcctggggctcctgcctctctggctccgaggtgccagttgtgacatccagttcgaccctagtcctcccttcctctctgtctcgtcttcgtggtgggagacagtccgtacaccgtatcgacgttggccgggcgtacgtcacgtacctaattaaactaactttaatttaaagttacggttaacaacaaaaccgaaaaaccgaacgggtaaaaccgtaccccttaaaagtacccgtaggttacctacgtaccgtagacctaaccgttcctacgtttacggacgtaacgggttccggtaccctaggttacgtaacgttcgtagtacggtacgtcggtaaggttacgggttacgggaactttacggtttctaaccgttactacctaaacgtacgttaccggaagtaccgttacggttaaccgtacccgtaaacggtagttaaacgttcgtttaaccgtacttaaaccgttttaaccgtacttaaacggacctaaaacggttaactaaaccgtttaaaccgttaaacggttccgaaacccgggttcggggtaaaccctttaccgggggtaaaccggtaaaacccggggtaaccttaacggggggtaagggtaccaaccgtttaaacgtaaaccggtaagggtttcggtaaaccgtaccgtacccgtaaccggtaaccttactttccgggtaccttttaacccacggttaccccgtttcccgtttaaccccgacccttcgtaaccgttaaccggg

SEQ ID NO: 51137 - DNA, 867 bp, Homo sapiens
  misc_feature: GYAE6OF01EPBE9.8.71.G05.1.454.CMB.1.raw
tcagctcgcgtgtccacgaccggtgctcgatttagtgtcgtcgcaagagagaggggggagtcagtctcagtcaggacacagcatggacatgagggtccccgctcagctcctggggctcctgctctctggctccgaggtgccagttgtgacatccagttcgacccagtcctccctcctctcttgtctgtcttcgtggtgggagacagccgtaccacctatcgacgttcggccgggacgacgtcagtcctaattaaactaacgtttaatttaaaagttcggtaaactaaccaaaaaccgtaaaaaaccggaacgggtaaaaccctaaccccgttaaaacttacccgttagggttaaccttaagttaccgtacggaccttaaccgttccccgtttaacgttttacggaaaccgtaaaacggggttcccggggttaaccccctaaagtttaccggtaaacggttttaccgtacggtttcggtacgtaacgggttaggggttaacggttttacggggtaacctttacggtttttacacccgtttactaacctaaccgaacgttcgaacgtcgtaacggttccgtaaccgttaacccgtagtaacggttctttttaacggacccttaaagttaccttacgtacgttaaccaaacgttacttaaaccttaactaaacgttacgtaaaccggtacgggttaaccggtttaccggtaaccggtaaacgggtaccgtaaggggtacgaagtaacgtaaccggtaaacgtagtacggttaccgagtaccgtaccgtaccgtttacgtaccgtttaccgttaccttacccgttaccgtttaccccctttaccccgggtacttagttccccggttaaacg

SEQ ID NO: 51138 - DNA, 809 bp, Homo sapiens
  misc_feature: GYAE6OF01EALD5.8.71.G05.1.454.CMB.1.raw
  modified_base (201)..(201): a, c, t, g, unknown or other
  misc_feature (201)..(201): n is a, c, g, or t
  modified_base (791)..(791): a, c, t, g, unknown or other
  misc_feature (791)..(791): n is a, c, g, or t
tcagctcgcgtgtccacgaccggtgctcgatttagtgtcgtcgcaagagagaggggggagtcagtctcagtcaggacacagcatggacatgagggtccccgctcagctcctgggctcctgctctctggctccgaggtcgcagttgtgacatccagttacgaccctagtcctccctcctctctgtctgcttcgtggtggganacgaggtccgtacaccctatccgtacgttccgggcccgggtacgtacgtcacgtacctaagttaaacctaacgtttaatttaaacgttacggtaactaacccaaaaaccgtaaaaaaccggaacgggtaaaaccgtaaccccttaaaagtacccggttacggtaaccttaacttaaccgtacggtacctaaccttccgtaacgttttacgaacggtaaacgggttcggggtaacccctaagttaacgtaaggttaccgtaggtcggtacgtaggttacgggtagttacggggtaccttacgttttacgaaccttcgtactaactactacgtagtaccgtacgttaccgtaaccgtaaccgttagtaaacgtttctttaacgaaacccttacgtttaactaacgtacgtaacctaactaacggttaactaacgtaactacggtaaccgtaggttaccggtaagtaaccggaaaccggtacgtaagggtaccggtaagtaaccgttacgaaaccgttaggtcgtacgggtacttacggaccctaacggtcgttcttacccgttaacttccgttacgtaccccttaccgggtnttaccgtacggtaaccgg

SEQ ID NO: 51139 - DNA, 807 bp, Homo sapiens
  misc_feature: GYAE6OF01A12VQ.8.71.G05.1.454.CMB.1.raw
  modified_base (751)..(751): a, c, t, g, unknown or other
  misc_feature (751)..(751): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatcccagttcgacccagtcctccctcctctctgtctgtcttcgtggtgggagacacgcgtcaccgtactctacgttcggccgggtacgacgtctagtacctaattaaaccgaatttaagtttaaacgtttgggtaacttaaccgaaaacctaaaaaaccggtaacgggaaacctaccccgttaaaagtacccgtagggtaccttaataacgtcggtactacctaccctacgtttacgaacgttaaacgggtcggggttaccctacgtacggtaacggttcgacggtggacgtaggtaggtagtttaggggtacttacggttttaccacgttacctacgaactaacgtacgacggtactacggttacccgtaccggtaaaccgttaggtaaacggtttacgttttacgggaacccctttaaaccgtttaaccgttaacgttaccggtaaccctaacgttaacgtaaccttaacgtaaacgttaacggtaacccgggtaagggttacccggtttacggaacgggtaaaccgggtaccgtaaggggtacggaacgtacgtaacgtaaacgtaccgtaggtcggaccgtacgtacctaaccgtnttccgtagtttacctaccgtaccgttaccccgttacccgtacctacggttcgaacg

SEQ ID NO: 51140 - DNA, 956 bp, Homo sapiens
  misc_feature: GYAE6OF01BELOZ.8.71.G05.1.454.CMB.1.raw
  modified_base (221)..(221): a, c, t, g, unknown or other
  misc_feature (221)..(221): n is a, c, g, or t
tcagctcgcgtgtccacgaccggtgctcgatttagtgtcgtcgcaagagagagggggggagtcagtctcagtcaggacacagcatggacatgagggtccccgctcagctcctggggctcctgcctcctctggcctccgaggtgcctagttgtagactactccgtagttcgaacccagttccttccctcctctccttgtctgtctttgtggtagggacacgngtaccgtccacctataccgtacgttcgggccgggtaccgtacggttctaacggttacctaaaacgtttaaaaccgaaacttttaaagtttttaaaacgtttaaggttaaaccttaaacctaaaaaaccgtaaaaaaacccgggtaaacggggtaaaaacccggttaacccccctttaaaaacggtttaacccccggttaacggggtttaaccttaaaccgtttaccgttacggtacctaacgttacccctttaacgtttacggtaaaccggtaaacgggtttaccggggtacccttaacggttaaccgttaaacggggttacctacgggtacggcgttaacggttgggttaacggtttacgggtaacgtttaccgggttttactaccgttaccgtaccctaaaacggttaacctaccgtaacgtaccggttacgttacccgtaaaccggttaaccggttaaggtttaaacgtttgttttaaccgtaaacccgtttaaacgtttaacttaaccggttacggtaaacctaaacgttaacgtttaaccgttaaactaacgtttacgttaacccgggaagggttaccgtacggttaacgggaacggtaaccgggtaggttagggtaactaacgtaacgtaaacggacttacgggacggttacctggtaaccgaccttaagttccgttacggtaacctttaccggtaacctttccgtacccctactttagaccgtaacgg

SEQ ID NO: 51141 - DNA, 514 bp, Homo sapiens
  misc_feature: GYAE6OF02J2B75.8.71.G05.1.454.CMB.1.raw
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcagtcagtccattaacaactattaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagatttgctaacttactactgtcaacagacttacaatataccgaggtacgttcggtacaagggaccaaggtagagatacaaacgaactgtgctgcaccatctgtcttcatccttccgctatctacg

SEQ ID NO: 51142 - DNA, 508 bp, Homo sapiens
  misc_feature: GYAE6OF02I9X68.8.71.G05.1.454.CMB.1.raw
tcagctcgcgtgtccacgaccggtgctcgatttagtgtcgtcgcaagagagagggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtgggtcccatcaaggttcagtggcagtggatttgggacagttttcactctcacaatcagcagtctcgaacctgaagattttgctaacttactactgtcagcagtcttacagtaggccgggcacctttggccaggggacgaagctggagatcgaacgactgtggctgcaccatctgtcttcatcttcccgctacg

SEQ ID NO: 51143 - DNA, 515 bp, Homo sapiens
  misc_feature: GYAE6OF02FXBRI.8.71.G05.1.454.CMB.1.raw
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcagtcagtccattaacactattaaattgtatcaacaaaaccaggaaagcccctaaatacctggtctatactgcatccactttgcaaagtgggtccatcaaggttcagtggcagtggatttgggactagtttcactctcacaatcagcagtctcgaacctgaagtattttgactaaacttactactgtacaacagacttaacaatataccgaggacttcggacaagggaccaaggtgagaatacaaacgactgtagctagcaccatctgtcttcacttccttcccgctatctacg

SEQ ID NO: 51144 - DNA, 513 bp, Homo sapiens
  misc_feature: GYAE6OF02H828T.8.71.G05.1.454.CMB.1.raw
  modified_base (197)..(197): a, c, t, g, unknown or other
  misc_feature (197)..(197): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccgggcagtcagtccattaacaactatttaaattggtatcaacaaaaaccaggaaagcccctaaatacctggtctatactgcatccactttgcaaagtgggtccatcaaggttcagtgcagtgatttgggacagttttcactctcacaatcagcagtctcgaacctgaagattttgcaacttactactgtacaacagacttacaatataccgaggacgttcgacaaggaccaaggtggagtatacaaacgaactgtggctagcaaccatctgtcttcatccttcccgctactctacg

SEQ ID NO: 51145 - DNA, 372 bp, Homo sapiens
  misc_feature: GYAE6OF02F50V4.8.71.G05.1.454.CMB.1.raw
  modified_base (350)..(350): a, c, t, g, unknown or other
  misc_feature (350)..(350): n is a, c, g, or t
  modified_base (356)..(372): a, c, t, g, unknown or other
  misc_feature (356)..(372): n is a, c, g, or t
tcagctcgcgtgtccacgaccggtgctcgatttagtgtcgtcgcaagagagaggggggtgaggtgaaagatgagctggaggaccgcaataggggtaggtcccctgtggaaaaagggtcagaggggatagaagttattcagcaggcacacaacagaggcagttccagttttcactctcacaatcagcagtctcgaacctgaagattttgcaacttactactgtcaacagacttacaatataccgaggacgttcggtcaagggaccaaggtggagatcaaacgaactgtggctgcaccatcttctcatcttcccgcatctgagacacgcgagctgagcgggctggcaaggcncatagnnnnnnnnnnnnnnnnn

SEQ ID NO: 51146 - DNA, 367 bp, Homo sapiens
  misc_feature: GYAE6OF02JBX47.8.71.G05.1.454.CMB.1.raw
  modified_base (359)..(367): a, c, t, g, unknown or other
  misc_feature (359)..(367): n is a, c, g, or t
tcagctcgcgtgtccacgaccggtgctcgatttagtgtcgtcgcaagagagaggggggtgaggtgaaagatgagctggaggaccgcaataggggtaggtcccctgtggaaaaagggtcagaggggatagaagttattcagcaggcacacaacagaggcagttccagttttcactctcacaatcagcagtctcgaacctgaagattttgcaacttactactgtcaacagacttacaatataccgaggacgttcggtcaagggaccaaggtggagatcaaacgaactgtggctgcaccatctgtcttcatcttcccgccatctgagacacgcgagctgagcgggctggcaaggcgcatagnnnnnnnnn

SEQ ID NO: 51147 - DNA, 533 bp, Homo sapiens
  misc_feature: GYAE6OF02GP2DH.8.71.G05.1.454.CMB.1.raw
  modified_base (436)..(436): a, c, t, g, unknown or other
  misc_feature (436)..(436): n is a, c, g, or t
  modified_base (523)..(523): a, c, t, g, unknown or other
  misc_feature (523)..(523): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgactaactttactactgtacaaacagtacttaacattaanaccgtaggacgttcggtacaagggaccaagggtggaagtatacaaacgaactgtaggctgcaccatctcgtcttctatccgttcccnctactctacg

SEQ ID NO: 51148 - DNA, 599 bp, Homo sapiens
  misc_feature: GYAE6OF02H9AZ6.8.71.G05.1.454.CMB.1.raw
  modified_base (380)..(380): a, c, t, g, unknown or other
  misc_feature (380)..(380): n is a, c, g, or t
  modified_base (443)..(443): a, c, t, g, unknown or other
  misc_feature (443)..(443): n is a, c, g, or t
tcagctcgcgtgtccacgaccggtgctcgatttagtgtcgtcgcaagagagagggggagtcagtctcagtcaggacacagcatggacatgagggtccccgctcagctcctggggctcctgctcctctggctccgaggtgccagttgtgacatccagttgaccccagtcctccctcctctctgtctgcttctggtgggagacagcgtcaccatcacttggccgggcgagtcagtccattaacaacttatttaaattggtatacaaacaaaaaccagggaaagacccctaaatacctggtactatactgctatccactttgacaaagtcgggtccatcaaggttcagtggcagtggtatttgggactagttttcactctcanaatcagcagtctacgaacctgaagtattttgactaacttactactgtacaacgagtacttaanaacttaataccggaggtacgtttacggtacgaaggaacctaagggtggaagactaacgaaaaccgtaacttggtacggacttaggccctaacccgtatcccgtttaggttcctttaccgaacttcccgtttacccccggaccttacgttctaacgg

SEQ ID NO: 51149 - DNA, 520 bp, Homo sapiens
  misc_feature: GYAE6OF02JJAEN.8.71.G05.1.454.CMB.1.raw
  modified_base (482)..(482): a, c, t, g, unknown or other
  misc_feature (482)..(482): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcagtcagtccattaacaactattaaatggtatcaacaaaaccaggaaagcccctaaatacctggtctatactgacatccactttgcaaagtgggtccatcaaggttcagtggcagtggatttgggactagttttcactctcacaatcagcagtctcgaacctgaagtattttgactaacttactactgtacaactagtacttacaatataccgaggtacgttcggtacaacgggaccaaggtagagtatacaaacgatagngtctgcacatctagtcttcattcctaccgctatctacg

SEQ ID NO: 51150 - DNA, 551 bp, Homo sapiens
  misc_feature: GYAE6OF02GTA58.8.71.G05.1.454.CMB.1.raw
  modified_base (257)..(257): a, c, t, g, unknown or other
  misc_feature (257)..(257): n is a, c, g, or t
  modified_base (416)..(416): a, c, t, g, unknown or other
  misc_feature (416)..(416): n is a, c, g, or t
tcagctcgcgtgtccacgaccggtgctcgatttagtgtcgtcgcaagagagaggggggaggtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcagtcagtccattaacaactattaaatgtatcaanaaaaaccagggaaagccctaaatacctggtactatactgcatccactttgacaaagtggggtccatcaaggttcagtggcagtggatttgggactagttttcactctcacaatcagcagtctcgaactgaagattttgactaacttactactagtcaanagacttacaatactacgagtacgttcggtacgaacgggacaagggtggaagtatacgaaacgaacgtagtagggctacggacaaccgacttacgtacgttctttccaattccttaccccggcctacgtcttacgg

SEQ ID NO: 51151 - DNA, 525 bp, Homo sapiens
  misc_feature: GYAE6OF02IH7P4.8.71.G05.1.454.CMB.1.raw
  modified_base (502)..(502): a, c, t, g, unknown or other
  misc_feature (502)..(502): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccaggaaagcccctaaatacctggtctatactgcatccactttgcaaagtggggtcccatcaaggttcagtggcagtggattttgggactagttttcactctcacaatcagcagtctcgaacctgaagattttgactaaacttactactgtacaacagacttacaattactaccgaggtacgttcggtacaagggaccaaggtaggagtatacaaagaactgtagctgcaccatctntcttcatcttcccgctactctag

SEQ ID NO: 51152 - DNA, 368 bp, Homo sapiens
  misc_feature: GYAE6OF02I3WZG.8.71.G05.1.454.CMB.1.raw
  modified_base (290)..(290): a, c, t, g, unknown or other
  misc_feature (290)..(290): n is a, c, g, or t
  modified_base (293)..(293): a, c, t, g, unknown or other
  misc_feature (293)..(293): n is a, c, g, or t
  modified_base (338)..(338): a, c, t, g, unknown or other
  misc_feature (338)..(338): n is a, c, g, or t
  modified_base (358)..(368): a, c, t, g, unknown or other
  misc_feature (358)..(368): n is a, c, g, or t
tcagctcgcgtgtccacgaccggtgctcgatttagtgtcgtcgcaagagagagggggtgaggtgaaagatgagctggaggaccgcaatagggtaggtcccctgtggaaaaagggtcagaggggatagaagttattcagcaggcacacaacagaggcagttccagttttcactctcacaatcagcagtctcgaacctgaagattttgcaacttactactgtcaacagactttacaatataccgaggacttcggtcaaaggggccaagtggagaatcaaacgaactgtaggntgnaccaatctgcttcatcttcccgccatctgagacacgcgagctgancgggctggcaagcgcatagnnnnnnnnnnn

SEQ ID NO: 51153 - DNA, 518 bp, Homo sapiens
  misc_feature: GYAE6OF02IK9S5.8.71.G05.1.454.CMB.1.raw
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggattttgggactagttttcactctcacaatcagcagtctcgaacctgaagattttgctaacttactactgtcaacagacttacaatataccgaggacgttcggactaagggaccaaggtggagatcgaaaacgatgtagctgcaccatctgtctcactccttccgctatctacg

SEQ ID NO: 51154 - DNA, 552 bp, Homo sapiens
  misc_feature: GYAE6OF02HIDVZ.8.71.G05.1.454.CMB.1.raw
  modified_base (102)..(102): a, c, t, g, unknown or other
  misc_feature (102)..(102): n is a, c, g, or t
  modified_base (196)..(196): a, c, t, g, unknown or other
  misc_feature (196)..(196): n is a, c, g, or t
tcagctcgcgtgtccacgaccggtgctcgatttagtgtcgtcgcaagagagaggggggagtcagtctcagtcaggacacagcatggacatgagggtccccgntcagctcctggggctcctgctcctctggctccgaggtgccagttgtgacatccagttgacccagtctccctctctctgtctgcttctgtggganacagcgtcaccatcacttgccgggcagtcagtccattaacaactatttaaattggtatcaacaaaaaccagggaaaacgcccctaaaatacctggtctataactgcatccactttgacaaagtggggtcccatcaaggttcagtggcagtggatttgggacaggttttcactctcacaatcagcagtctcgaacctgaaagtatttttgactaaactttactaacttcgtacaaacgtataccttaacaatactaccgaggtacgttcggtacgaagggaccgaaggtggaagaattacaaacgtaactagtcgctggcaccgatctgttcttcgattccttcccgcctatcctag

SEQ ID NO: 51155 - DNA, 521 bp, Homo sapiens
  misc_feature: GYAE6OF02G7XQ8.8.71.G05.1.454.CMB.1.raw
  modified_base (222)..(222): a, c, t, g, unknown or other
  misc_feature (222)..(222): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggnagtcagtccattaacaactattaaattggtatcaacaaaaaccagggaaagcccctaaatacctggtctatactgcatccactttgcaaagtgggtccatcaaggttcagtggcagtgatttgggactagttttcactctcacaatcagcagtctacgaacctgaagtattttgactaacttactactgtacaactagacttacaatataccgagtacgttcggtacaacgggaccaagggtggagagtacaaacgactgtggctgcacatctgtcttcgactcttcccgctatctacg

SEQ ID NO: 51156 - DNA, 688 bp, Homo sapiens
  misc_feature: GYAE6OF02H2S91.8.71.G05.1.454.CMB.1.raw
  modified_base (205)..(205): a, c, t, g, unknown or other
  misc_feature (205)..(205): n is a, c, g, or t
tcagctcgcgtgtccacgaccggtgctcgatttagtgtcgtcgcaagagagagggggggagtcagtctcagtcaggacacagcatggacatgagggtccccgctcagctccgtggggctcctgcctcctctggctccggaggtgccagttgtgacatccagttcgacccagtcctccctcctctctgtctgtcttctggtggganacagcgtcaccatctacttcggccgggacgagtcacgtcctaattaacaacttaatttaaattggtatacaaacaaaaacgaaggaacgaccctaaatacctggtactatactgactactacctactttgacgtaaaggtcggggtaccccaatacgtaaggttcaggtggacgaggtaggtagtttagggacttagttttacactctacaacgatacagcacgtctacgaactagaagttatttcgacttaacttactacgtacgtaacaacgtacgtaacttaactaacttaacgaaccggtaaggttacggtttaccggaacggaaacgggtaaccgtaaaggggtacggaacgtacgtaaacggtaaaaaccgtaggttaggtacggtaccgttacggaaccctaaccgtattacccgttagttaccctttacgtaccgtttccccgtttacccccggacttacgttacccgtaacggg

SEQ ID NO: 51157 - DNA, 527 bp, Homo sapiens
  misc_feature: GYAE6OF02GNQ4P.8.71.G05.1.454.CMB.1.raw
  modified_base (423)..(423): a, c, t, g, unknown or other
  misc_feature (423)..(423): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggactagttttcactctcacaatcagcagtctacgaacctgaagtatttgactaacttactactgtacaacanacttacaatactaccgaggacgttcgtacgaagggacaaggtgagaatacgaaacgactgtacgctagcaccatctgtcttcacttcctacccgctactctacg

SEQ ID NO: 51158 - DNA, 569 bp, Homo sapiens
  misc_feature: GYAE6OF02I1O3L.8.71.G05.1.454.CMB.1.raw
tcagctcgcgtgtccacgaccggtgctcgatttagtgtcgtcgcaagagagagggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcagtcagtccattaacactatttaaatggtatcaacaaaaaccaggaaagcccctaaatacctggtctatactgcatccactttgcaaagtggggtcccatcaaggttcagtggcagtggatttgggactagttttcacgttctacacaatcagcagtctacgaacctgaagtattttgactaaactttactactcgtacctaacagtacttaacaattaactacccggaagggtaccgtttcgggtacgaaacggggaccaaagggtggaagtaatacgaaaacgactaggtaggctaggctaaccatcctagttccttactacgttccttcccgctactctacgg

SEQ ID NO: 51159 - DNA, 522 bp, Homo sapiens
  misc_feature: GYAE6OF02F9EZH.8.71.G05.1.454.CMB.1.raw
  modified_base (197)..(197): a, c, t, g, unknown or other
  misc_feature (197)..(197): n is a, c, g, or t
  modified_base (487)..(487): a, c, t, g, unknown or other
  misc_feature (487)..(487): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtggganacagcgtcaccatcacttgccgggcagtcagtccattaacaactattaaattggtatcaaacaaaaaccagggaaagcccctaaatacctggtctatactgcatccactttgcaaagtggggtcccatcaaggttcagtggcagtggatttgggactaggttttcactctcacaatcagcagtctcgaacctgaagattttgactaacttactactgtcaacagacttaacaatataccgaggtacgttcgtacaagggaccaaggtggagatacgaaacgaactgtcgntgcacatctgtcttcactccttcccgctatctacg

SEQ ID NO: 51160 - DNA, 572 bp, Homo sapiens
  misc_feature: GYAE6OF02I4RB3.8.71.G05.1.454.CMB.1.raw
tcagctcgcgtgtccacgaccggtgctcgatttagtgtcgtcgcaagagagagggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatccacttgccgggcgagtcagtccattaacaactattaaattgtatcaacaaaaaccagggaaacacccctaaatacctggtactatactgcatccactttgcaaagtcggggtcccaatcgtaaggttcagtggcaggtggagtttgggactagttttcacttctacactaatcagcatctacgaacctgaagtattttgactaacttactactagtacaacagtacttaacaattaactaccgaggtacgttacggactaacggggaaccaaggtcggaagtactacgaaaacgtactaggtgactcggacctaacctatctacgttcgttacctacttccttacccgcctactctacgg

SEQ ID NO: 51161 - DNA, 558 bp, Homo sapiens
  misc_feature: GYAE6OF02G98JH.8.71.G05.1.454.CMB.1.raw
  modified_base (390)..(390): a, c, t, g, unknown or other
  misc_feature (390)..(390): n is a, c, g, or t
  modified_base (411)..(411): a, c, t, g, unknown or other
  misc_feature (411)..(411): n is a, c, g, or t
  modified_base (495)..(495): a, c, t, g, unknown or other
  misc_feature (495)..(495): n is a, c, g, or t
  modified_base (516)..(516): a, c, t, g, unknown or other
  misc_feature (516)..(516): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttcgacccagtcctccctcctctctgtctgtcttctggtgggagacagcgtcaccatcacttggccgggcgacgtcacgtccattaacaactatttaattggtatacaaacaaaaccagggaaacgacccctaaatacgtggtactatactgacactccactttcgactaagtcgggtccatcgtaaggttcagtgcagtggtagttggactagtttacgctctcacatcganctagtctacgaacctgaagtntttcgactaacttactacttctacaactatacttacaattacacgagtcgttacgacgaaggaccagggtagagatacgaaacncgtagcgtcgtacgcaaccgnttctacgtttacttacttccttcccgactactcgttagaccg

SEQ ID NO: 51162 - DNA, 635 bp, Homo sapiens
  misc_feature: GYAE6OF02H9DNE.8.71.G05.1.454.CMB.1.raw
tcagctcgcgtgtccacgaccggtgctcgatttagtgtcgtcgcaagagagagggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcagtcagtccattaacaactattaaattgtatacaaacaaaaacaggaaagacccctaaatacctaggtactatactgactactccaactttgacaaaggtcgggtcccaatactaaggttcaagtggcaagtggtagttagggactagttttcactctacaacaatcagtctagtctacgaactgtaaagtatttagctaacttactaactgtacaactagtacttaacaattactacgaggtacgttacggtacgaaacgggtaaccgaaggtacgtaacgtagtaacaaaaaccggtaacgtacggttacgggacttacgggaaccctaacctaacgttacccgttaacgttccggttttaccaacgtttaccccgtttacccccgggaccttaaccgttcccgttaacggg

SEQ ID NO: 51163 - DNA, 628 bp, Homo sapiens
  misc_feature: GYAE6OF02HFF3H.8.71.G05.1.454.CMB.1.raw
  modified_base (199)..(199): a, c, t, g, unknown or other
  misc_feature (199)..(199): n is a, c, g, or t
  modified_base (393)..(393): a, c, t, g, unknown or other
  misc_feature (393)..(393): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtcctccctcctctctgtctgcttctggtggganacagcgtcaccatcacttggccggcgagtcagtccaattaacaactatttaaatggtatacaaacaaaacaggaaacacccctaaatacctggtactaatactgcatcctactttgacgtaaaggtcgggttacccatacgaaggttcaagtggactaggtgagtttggatagttttcacgtctcaactatcanctaagtctacgaacctgaagttatttgactaaacttactactgtactaaacacgtacttaacaaatacgtaacccgaggttaccgttacggactaacgggtaaccaagggtacgaagtaacgtaaccgaaaacggtacctaggttacgggacttacgggaacccttaacccgtaagttcctacggtttcccttactaccgttaccctttccccggaccttacgtttcccgaacgg

SEQ ID NO: 51164 - DNA, 729 bp, Homo sapiens
  misc_feature: GYAE6OF02HEOW6.8.71.G05.1.454.CMB.1.raw
  modified_base (102)..(102): a, c, t, g, unknown or other
  misc_feature (102)..(102): n is a, c, g, or t
  modified_base (189)..(189): a, c, t, g, unknown or other
  misc_feature (189)..(189): n is a, c, g, or t
  modified_base (195)..(195): a, c, t, g, unknown or other
  misc_feature (195)..(195): n is a, c, g, or t
tcagctcgcgtgtccacgaccggtgctcgatttagtgtcgtcgcaagagagaggggggagtcagtctcagtcaggacacagcatggacatgagggtccccgntcagctcctggggctcctgctctctggctcgaggtgccagttgtgacatccagttgacccagtcctccctcctctctgtctgcttcngtgganacagcgtcacctatccacttggaccgggcgtagtcacgtaccaattaaccaacttaatttaaattggtatacaaacgaaaaacctagggaaacgacccctaaaataccctaggtacctaatactgactactaccgtactttgacgtaaaggtcggggtcccaagtccgtaaggttaccaggtcggcaggtaggtagtttgggaactaggttttacacttactacgaactaattccgtaacgttagttccgtacggaacccgttaggaaacgtttacttttaggaccttaaaccgtttaactaacgttacgtaacaaaccgtaggtaaaccctttaagaacttaacgtaaccgaagggtaacccggttacgggtaaccgaaaggggtaaccctaagggttacggaagtaacgtaacctaaaacggtaacgttggtaccggtcgttacgaccgtaaacccttagtaccgtttacgtacccgttttaccgaaccgtttcccgttaccccggtaacctacggtttccaaggtaacccg

SEQ ID NO: 51165 - DNA, 573 bp, Homo sapiens
  misc_feature: GYAE6OF02FVVLY.8.71.G05.1.454.CMB.1.raw
  modified_base (339)..(339): a, c, t, g, unknown or other
  misc_feature (339)..(339): n is a, c, g, or t
  modified_base (419)..(419): a, c, t, g, unknown or other
  misc_feature (419)..(419): n is a, c, g, or t
tcagctcgcgtgtccacgaccggtgctcgatttagtgtcgtcgcaagagagagggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactattaattggtatcaacaaaaaccaggaaacgcccctaaatacctggtctatactgacatccacttgacaaagtggggtcccatcaaggttcagtgnagtggatttgggactaggtttcactctcactactcagtcagtctacgtaacctagaagtatttacgctaacttactactntacaactagtacttacaatactaccgaggtacgttacgtacgaacggtacgaaggtaggacgtaatacgtaaacgaacgttcggtacgacgtacgacctaccattccgttacgttacttacgtacttccccgtaccgtcctacgttcgtaacgg

SEQ ID NO: 51166 - DNA, 620 bp, Homo sapiens
  misc_feature: GYAE6OF02FZK4N.8.71.G05.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgaccccagtcctccctcctctctgtctgctttctggtggganacagcgtcaccatcacttggccggnagtcagtccattaacaacttatttaaattggtatacaaacaaaaaccgagggaaaacgtacccctaaaatacctggtactaactactgcatccgtactttgacaaaggtcggggtcccatacaaggttcagtgcaggtgtatttgggactagtttcactctcaacaattcagctaagtctacgtaacctgaagtattttagactaaactttactacgtcgtactaaacacgtaacttaacaaattacgtaacccgaggtaaccgttcggtacgtaacggggtaaccgtaaagggtggaacgattaaccgaaaagtaacctaggtacgtcgtacggacctaacctacttctaagtttcctttactaccgttaccttcccgactacgttcgtacgg

SEQ ID NO: 51167 - DNA, 369 bp, Homo sapiens
  misc_feature: GYAE6OF02H598Y.8.71.G05.1.454.CMB.1.raw
  modified_base (300)..(300): a, c, t, g, unknown or other
  misc_feature (300)..(300): n is a, c, g, or t
  modified_base (332)..(332): a, c, t, g, unknown or other
  misc_feature (332)..(332): n is a, c, g, or t
  modified_base (342)..(342): a, c, t, g, unknown or other
  misc_feature (342)..(342): n is a, c, g, or t
  modified_base (358)..(369): a, c, t, g, unknown or other
  misc_feature (358)..(369): n is a, c, g, or t
tcagctcgcgtgtccacgaccggtgctcgatttagtgtcgtcgcaagagagaggggggtgaggtgaaagatgagctggaggaccgcaataggggtaggtcccctgtggaaaaagggtcagaggggatagaagttattcagcaggcacacaacagaggcagttccagtttcactctcacaatcagcagtctcgaacctgaagattttgcaacttactactgtcaacagacttacaatataccgaggacgttcggtcaagggaccaaggtggagatcaaacgaactggtggctgcaccatcngtctcatcttcccgccatctgagacacgcganctgagcgggntggcaaggcgcatagnnnnnnnnnnnn

SEQ ID NO: 51168 - DNA, 757 bp, Homo sapiens
  misc_feature: GYAE6OF02IGKDM.8.71.G05.1.454.CMB.1.raw
  modified_base (201)..(201): a, c, t, g, unknown or other
  misc_feature (201)..(201): n is a, c, g, or t
  modified_base (204)..(204): a, c, t, g, unknown or other
  misc_feature (204)..(204): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttcgacccagtcctccctcctctctgtctgctttctggtggganacngctcacatcattggccgggcagtcagtccaattaacaactattaaattgtatacaaacaaaaaccgaggaaacgaccctaaatacctaggtactaatacctagactactacctactttacgacgtaaacggttccggggttacccaagttaccgtaaacggttactaaggtcgtacgtaggttacggtagtttacggggtaccttaggtttttaccaacttaccttactaactaaacttaccgacgtactacggttacctaccgtaaaccttaggaaagttatttttacgaccttaaacttacttaaccgttagtacctaaacgtaacgttaaacttaaacgtaacgttaaactaccggtaaacgggttaaccggtttaccgggttaacgaaaccggggtaaccgtaaacgggttacggggaacgggttaaaccttaacgaaaaaccggtaaacgtttacgggttacgtacgtaccggtaaccggtaacctacggttaccttaacggtccctttacgtaccttccgttaccccggtactacgtttacgtacgg

SEQ ID NO: 51169 - DNA, 583 bp, Homo sapiens
  misc_feature: GYAE6OF02HOKNL.8.71.G05.1.454.CMB.1.raw
  modified_base (199)..(199): a, c, t, g, unknown or other
  misc_feature (199)..(199): n is a, c, g, or t
  modified_base (224)..(224): a, c, t, g, unknown or other
  misc_feature (224)..(224): n is a, c, g, or t
  modified_base (454)..(454): a, c, t, g, unknown or other
  misc_feature (454)..(454): n is a, c, g, or t
tcagctcgcgtgtccacgaccggtgctcgatttagtgtcgtcgcaagagagaggggggagtcagtctcagtcaggacacagcatggacatgagggtcccccgctcagctcctggggctcctgctcctctggctccgaggtgccagttgtgacatccagttgacccagtctccctcctctctgtctgcttctggtggganacagcgtcaccatcacttgccgggngagtcagtccattaacaactattaaattgtatacaaacaaaacaggaaacgaccctaaatacctggtactatactgacactcctactttgactaaaggtcgggtacccagtacgaaggttcagtggacagtggtagtttgggactagttttcactctacaacatcagctagtctacgaacctagaagtatttcgactaacttactactagtacaacagtactaacaatanaccgtaggtacgttacggtacgaacgggaccgaaggtgaagtactaacgaaacgtaacgtggtagactcggtaaccacctattccgttgttaccttcaccttcccgttacccgacctattccgtaacgg

SEQ ID NO: 51170 - DNA, 586 bp, Homo sapiens
  misc_feature: GYAE6OF02GG8XM.8.71.G05.1.454.CMB.1.raw
  modified_base (409)..(409): a, c, t, g, unknown or other
  misc_feature (409)..(409): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactattaaattggtatacaacaaaaaccagggaaacgacccctaaatacctggtactatactgcactccactttgactaaaggtcggggtacccatcaaggttcagtggcagtggatttgggactagttttcacttctcaacaataccagctagtctacgacctgaagtntttacgactaacttactactgtacctaacagtacttacaataacgtaccggaggtaccggttacggtacgaagggtaccaagggtggaacgtatacgaaacgtacgtgtacgctcggacctaaccacgttcgttacgttccttacctacttccgttaccccgacttatccgtaacgg

SEQ ID NO: 51171 - DNA, 378 bp, Homo sapiens
  misc_feature: GYAE6OF02HOO3E.8.71.G05.1.454.CMB.1.raw
  modified_base (366)..(378): a, c, t, g, unknown or other
  misc_feature (366)..(378): n is a, c, g, or t
tcagctcgcgtgtccacgaccggtgctcgatttagtgtcgtcgcaagagagaggggggtgaggtgaaagatgagctggaggaccgcaataggggtaggtcccctgtggaaaaagggtcagagggatagaagttattcagcaggcacacaacagaggcagttccagttttcactctcacaatcagcagtctcgaacctgaagatttgcaacttactactgtcaacagacttacaatataccgaggacgttcggtacaagggaccaaggtgagatcaaacgaactgtggctgcacatctgtctcatcttcccgcatctgacgacacgcgagcctaggacggcgggctggcaagggccgacataggcannnnnnnnnnnnn

SEQ ID NO: 51172 - DNA, 831 bp, Homo sapiens
  misc_feature: GYAE6OF02HXKLN.8.71.G05.1.454.CMB.1.raw
  modified_base (200)..(200): a, c, t, g, unknown or other
  misc_feature (200)..(200): n is a, c, g, or t
tcagctcgcgtgtccacgaccggtgctcgatttagtgtcgtcgcaagagagaggggggagtcagtctcagtcaggacacagcatggacatgagggtccccgctcagctcctgggctcctgctcctctggctccgaggtgccagttgtgacatccagttcgacccagtcctccctcctctctgtctgtcttcgtgtggganacagcgtcactatcctacttcgccgggcagtcagtccaattaaccaattaattttaaattggtaactacaaaacctaaaaaccgagggtaaactacccctaaaattacccgtaggttacctaagttacctaggacctacttacctacgttttgaaccgtaaaacgggttccggggtaccctaagttaccgtaaacggttccgagggttacggcgtaacggttggttaacgtttaggggtaaccttagttttaccacttaccgtacctaaacgaacttacgaacgtccgtaacgttaccgttaaccgaacccgttaagtaaacgttttaacgttttacgaaaccttaaaccgttttaaccgttaaccgttacggttaaccctaaaaacgacgttttaaaccgttaaacgttaaaacgttaaaccgtaaacccgggtaacgggttacccgggtttaaacgggtaaccggtaaaacggggttaaaccgaaaacggggttggaaaccgttaacgttaaacccgaaaacggttaaccgttaggggtaccgtaccgtaacggacccctaaccggtcttacgttaccgtttacgtaccgttaccttcccgttaccccggaccttaggttcctaaccgg

SEQ ID NO: 51173 - DNA, 513 bp, Homo sapiens
  misc_feature: GYAE6OF02IKPSU.8.71.G05.1.454.CMB.1.raw
  modified_base (433)..(433): a, c, t, g, unknown or other
  misc_feature (433)..(433): n is a, c, g, or t
  modified_base (437)..(437): a, c, t, g, unknown or other
  misc_feature (437)..(437): n is a, c, g, or t
  modified_base (450)..(450): a, c, t, g, unknown or other
  misc_feature (450)..(450): n is a, c, g, or t
  modified_base (459)..(459): a, c, t, g, unknown or other
  misc_feature (459)..(459): n is a, c, g, or t
  modified_base (463)..(465): a, c, t, g, unknown or other
  misc_feature (463)..(465): n is a, c, g, or t
  modified_base (468)..(468): a, c, t, g, unknown or other
  misc_feature (468)..(468): n is a, c, g, or t
  modified_base (471)..(473): a, c, t, g, unknown or other
  misc_feature (471)..(473): n is a, c, g, or t
  modified_base (475)..(475): a, c, t, g, unknown or other
  misc_feature (475)..(475): n is a, c, g, or t
  modified_base (477)..(479): a, c, t, g, unknown or other
  misc_feature (477)..(479): n is a, c, g, or t
  modified_base (482)..(483): a, c, t, g, unknown or other
  misc_feature (482)..(483): n is a, c, g, or t
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
  modified_base (489)..(491): a, c, t, g, unknown or other
  misc_feature (489)..(491): n is a, c, g, or t
  modified_base (494)..(496): a, c, t, g, unknown or other
  misc_feature (494)..(496): n is a, c, g, or t
  modified_base (498)..(501): a, c, t, g, unknown or other
  misc_feature (498)..(501): n is a, c, g, or t
  modified_base (503)..(513): a, c, t, g, unknown or other
  misc_feature (503)..(513): n is a, c, g, or t
tcagctcgcgtgtccacgaccggtgctcgatttagtgtcgtcgcaagagagaggggggtgaggtgaaagatgagctggaggaccgcaataggggtaggtcccctgtaggaaaaagggtcagaggggatagaagttattcagcaggcacacaacagaggcagttcctagttttcactctacaacaatcagcagtctcgaacctagaagtatttacgactaacttactactgtacaacataacttaacaatactaacgaggtaccgttcggtacgaaggaccaaggtgaacgataacgaaaacgaacgtgtaggctacgcaacctattctcgttccttacacttccttcccgacaactctacgacacgacggtacgacgtcgtaggacggtccgggcgtacggacgaacgggacgtacgtactagcagtcgatanacgntactgacgagagngacataganagcnnnagngcnnnanannnatnnananannnacnnnannnnannnnnnnnnnn

SEQ ID NO: 51174 - DNA, 698 bp, Homo sapiens
  misc_feature: GYAE6OF02FTJC0.8.71.G05.1.454.CMB.1.raw
  modified_base (225)..(225): a, c, t, g, unknown or other
  misc_feature (225)..(225): n is a, c, g, or t
tcagctcgcgtgtccacgaccggtgctcgatttagtgtcgtcgcaagagagagggggggagtcagtctcagtcaggacacagcatggacatgagggtccccgctcagctcctggggctcctgctcctctggctccgaggtgccagttgtgacatccagttgacccagtcctccctctctctgtctgcttctggtgggagacagcgtcaccatcacttcggccggngagtcagtccaattaacaacttaatttaaattggtatacaaacaaaaaccaggaaacgacccctaaatacctggtactatactgcatccactttgacaaagtcggggtcccatacgtaaggttcaggtggctaggtggtagtttgggtactagttttcactcgtacacaatcagcctagtcctacgtaaccgtgtaaagtattttagaccttaaacctttaaccgtaccttaggttaccaaacgtacgtaacctttaacaaatttaaccgtaacccggtaagggttaacccggtttaccgggtaaccgaaacggggtaacccgtaaaggggttacgggaagtaaacgtaaccggaaaacgtacgttacggtacgggtccgtacgtaaccgaacccttgttacccgttacggtttccctttacgttaccgtttaccccgttaccccggtacccttaacggtcccgtttaacggg

SEQ ID NO: 51175 - DNA, 777 bp, Homo sapiens
  misc_feature: GYAE6OF02H5E8Q.8.71.G05.1.454.CMB.1.raw
  modified_base (228)..(228): a, c, t, g, unknown or other
  misc_feature (228)..(228): n is a, c, g, or t
tcagctcgcgtgtccacgaccggtgctcgatttagtgtcgtcgcaagagagagggggagtcgagtctcagtcaggacacagcatggacatgagggtccccgctcagctcctggggctcctgctcctctggctccgaggtgccagttgtgacatccagttcgacccagtcctccctcctctctgtctgcttactggtgggacacagtcgtacaccatcacttggccggnagtcacgtcaattaacaacttatttaagtggtatacaaacaaaacgaggaaacgaccctaaataccgtaggtacctaatacctagacctacgtacctacttttcgacgtaaaggtccggggttcccaagttaccgtaaaggtttccaggtacggacgtaaggtcggttagtttcggggaacttaggtttttccaccgtacgttaccgaactaagtccaggtactacggtacctttacgaaccgttaggaaagttcgttttagaacccttaaagttaccttagtacgttactaaacgtaacgtttaacttaacgaactttaacgaaccggtaccggtaacggttttaccgggtaacgtaaacgggtaaacccggttaaggggtaccggtaaagtaaccgttaaacggaaaacccgttaacgggtcgtacgggttaccgtttaacccggaacctaaacccggtttaattccccgggttaagttttacccgttaccgtaacccgttttccccgttaacccccgtacctttaaccgttcggtttaaacccggg

SEQ ID NO: 51176 - DNA, 653 bp, Homo sapiens
  misc_feature: GYAE6OF02JK13V.8.71.G05.1.454.CMB.1.raw
  modified_base (139)..(139): a, c, t, g, unknown or other
  misc_feature (139)..(139): n is a, c, g, or t
  modified_base (159)..(159): a, c, t, g, unknown or other
  misc_feature (159)..(159): n is a, c, g, or t
  modified_base (198)..(198): a, c, t, g, unknown or other
  misc_feature (198)..(198): n is a, c, g, or t
  modified_base (503)..(503): a, c, t, g, unknown or other
  misc_feature (503)..(503): n is a, c, g, or t
tcagctcgcgtgtccacgaccggtgctcgatttagtgtcgtcgcaagagagaggggggagtcagtctcagtcaggacacagcatggacatgagggtccccgctcagctcctgggctcctgctcctctggctccgaggtnccagttgtgacatccagttnacccagtctccctcctctctgtctgtcttctgtaggganacagcgtacacctatcacgttggcccgggctagtccagtcccaattaaaccaattaatttaaattgtaatacaaacaaaacaggaacaccctaaatcctgtactatactgactactaccagtttacgaccgtaaaggttcggggtaccctagtaccgtaaaggttcgaaggtggacgtaggtagggttagtttagggacttagttttaccaccttctactaacaactcgactcgacttaccgtaccgtaactagtaaacggttatttacgacttaacttactactgttaccaactagtacttaanaaacttagtaaccggtaaggttacgttaccggtaacgaagggtaaccgtaagggtaggaagtactaaacgaaagtaaccgtgtacggtacgtacgtctaactacgtcgttactccttacaccgttcccgtaaccgtccgtattaccgtag

SEQ ID NO: 51177 - DNA, 819 bp, Homo sapiens
  misc_feature: GYAE6OF02HK4I7.8.71.G05.1.454.CMB.1.raw
  modified_base (139)..(139): a, c, t, g, unknown or other
  misc_feature (139)..(139): n is a, c, g, or t
  modified_base (196)..(196): a, c, t, g, unknown or other
  misc_feature (196)..(196): n is a, c, g, or t
tcagctcgcgtgtccacgaccggtgctcgatttagtgtcgtcgcaagagagaggggggagtcagtctcagtcaggacacagcatggacatgaggtccccgctcagctcctggggctcctgctcctctggctccgaggtnccagttgtgacatccagttgacccagtcctccctcctctctgtctgcttctgtgganacagccgtcaccatccacttcggccggcgtagtacacgtacctattaaccaacttatttaaattggtaactaacaaaccaaaaaccgagggaaaacctacccctaaaactaccttacggtaccttatacctcgacctacttacctaacctttgaccgtaaacgggtcgggtaccctagtaccgtaaggttacgtaacggtggtacctaaggtcgggtaacgttttaggggtacctttacggtttttaccacgtttacctaccgtaaactaacgttacgacggtaccgtacgttaccgtaacccgtaacccggttaggttaaacgtttaccgttttagtaaccccgttaaacgtttacccgttaacgtttacgttaaccgaaaccgttaacgttaaccctttaaaccgaaagttaaccgtaaccggtacgggttaaccggtttaccgggaaccgggttaaacggtaaccgtaacggggtaggaaccgttaaacgtaaccgaaaaccgggttacgtagggttaccgacggtaaccgggttaacccaaccgttaccgttcccgtttacgttaccctttccggtaaccttcccgtttaccccgaccgtttaccgtaccgtttaacgg

SEQ ID NO: 51178 - DNA, 685 bp, Homo sapiens
  misc_feature: GYAE6OF02GXRJO.8.71.G05.1.454.CMB.1.raw
  modified_base (462)..(462): a, c, t, g, unknown or other
  misc_feature (462)..(462): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgctttctgtgggacgaccaggcgtcaaccgactcaccgtttgacccgggtcgaagtcagtccaattaaacaacttatttaaattggtatcaaacaaaaaccagggaaacgtcccctaaatacctcggtactaatcctagctaatcccacttttcgactaaaggtcggggtacccagtcgtaaacggttcaggtcggccgtaggtcggtagtttgggaactaggttttacacgttccttacactaagtcaacggtcacgtctacggaactaggtaagtntttagctaaccttaacgttacctagacgtaaacacggtaaccttaccaaagttactaaccggacggtaaccgttaccggtacgtaaaccgggtacgtaaagggtacgtaacgtaaacgtaccgtaaaacgtaacgtgtagggaccttagggacctaaccgtaacgttcgtacgtttaaccgtacgtacgtttacccgtaccccggtacgtaacgtctaaccgg

SEQ ID NO: 51179 - DNA, 678 bp, Homo sapiens
  misc_feature: GYAE6OF02JF0OO.8.71.G05.1.454.CMB.1.raw
  modified_base (208)..(208): a, c, t, g, unknown or other
  misc_feature (208)..(208): n is a, c, g, or t
  modified_base (637)..(637): a, c, t, g, unknown or other
  misc_feature (637)..(637): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctctctggctccgaggtgccagttgtgacatccagttgacccagtctccctcctctctcgtctgcttctgtgggagacagctcaccntacacttgccgggcagtccagtccaattaaccaacttatttaattcggtatcaaacaaaaccgaggaacaccctaatacctagtctaatactagcctatacctactttgacgtaaacgtcggggtacccctataccgtaaggttccgacggttcgggcctaaggtgggtagttttacgggaccgttagggtttttacctacgtaccctttacgaactaactacgacgcgtaacgtccgtaccgtaacctacgtaagttcttttacggaccttaaacggtttaccctacgtacgtaacctaaacggttacgttaaccttaaaccgtaatttaaacgacccgggttaaggtaccgtttacgggtaaccgaacgggtacgtaaacgggttaggactaacgtaccgaaaacgtcgaagtcgactggcctaccngtactgtaccttcgtaccttacctcccgactacgttcgacg

SEQ ID NO: 51180 - DNA, 956 bp, Homo sapiens
  misc_feature: GYAE6OF02IKMW7.8.71.G05.1.454.CMB.1.raw
tcagctcgcgtgtccacgaccggtgctcgatttagtgtcgtcgcaagagagaggggggagtcagtctcagtcaggacacagcatggacatgagggtccccgctcagctcctggggctcctgctcctctggctccggaggtcgcctagttgtgacactccagttcgacccagtcctccctcctctctgtctgtctttcgtggtgggacgacgacgtccgtacaccactacctaccgttcggccggggtaccgacggtccgtacgttacctaactttaaaccgtaaacttttaaaacgtttttaaaagtttagggttaaacttaaccgaaaaaaacccgtaaaaaacccggaacggggtaaaaaccgtaacccccttaaaacgttaaccccggtttgggtaacctttaaacttacccgtacgtacctaaccttacccgttaacggttttacggaaaccgttaaacgggggttcccggggttaacccctaaagttaaccggttaaaacggggtttccaaggggtttacgggaccgttaagggttacgggttaggttttaacgggggaacctttacggtttttaccaccgtttacctaacctaaacgtaaggtaccgtaacgtaccgtaaccggttaccgttaaacccggtaacgtttacggtaaacttttaacggtttaaccgtaaaccgtttaaaacctttaaccgtaaaccgtttcggttaaacgtaaacccttaacggtttaaaccttaaagtaaaacctttacggtaaacccggtaagggtttaacccggttacggggtaaaccgtaaacgggtaaccggtaaaggggtacgtaaaccgttaacgtaaaaccgaaaccgtcgttaggtaccgggtactacggaaccttaccgtaagtttacctcggttacccttaagtccccgttttaccgaccccgttatacctacggtaacgg

SEQ ID NO: 51181 - DNA, 696 bp, Homo sapiens
  misc_feature: GYAE6OF02JJ7JW.8.71.G05.1.454.CMB.1.raw
  modified_base (138)..(138): a, c, t, g, unknown or other
  misc_feature (138)..(138): n is a, c, g, or t
  modified_base (190)..(190): a, c, t, g, unknown or other
  misc_feature (190)..(190): n is a, c, g, or t
  modified_base (197)..(197): a, c, t, g, unknown or other
  misc_feature (197)..(197): n is a, c, g, or t
  modified_base (556)..(556): a, c, t, g, unknown or other
  misc_feature (556)..(556): n is a, c, g, or t
  modified_base (565)..(565): a, c, t, g, unknown or other
  misc_feature (565)..(565): n is a, c, g, or t
  modified_base (573)..(573): a, c, t, g, unknown or other
  misc_feature (573)..(573): n is a, c, g, or t
  modified_base (587)..(587): a, c, t, g, unknown or other
  misc_feature (587)..(587): n is a, c, g, or t
tcagctcgcgtgtccacgaccggtgctcgatttagtgtcgtcgcaagagagaggggggagtcagtctcagtcaggacacagcatggacatgagggtccccgctcagctcctgggctcctgctctctggctccgaggtnccagttgtcgacatccagttgaccctagtcctccctctctctgtctgcttcnggtgganacagcgtacacctagtcctacgttcggcccgggacgtacgtcctacgtaccatttaaaaccaactttaagtttaaagttcggtaactaccaaaacgtaaaaaccgagggtaaaccgtaaccccttaaaatacccgtaggtacttaacgttaccgtacgtacctacgtaccttacgttacggaaccgtaacgggttccgggtaccctaagtttaccgaacggtttaccgaggtacgtacgtaggttacggtacgttttacgggaacttttacgtttaccgtaaccgtcgtaacaacgtaacgtcgagtacgtacgtccgtaacgacgtagtaacgttattacgacttaacgtctaacgtntacaacgtntaacttanacgtacacgtacgngttacgagaacgtacgaggtacgatacgtacgaaacgtctaggtcgcgtaccgtactacgttagtcttaccgttattccgacgttcccgaccgttctacgttcgtaacg

SEQ ID NO: 51182 - DNA, 758 bp, Homo sapiens
  misc_feature: GYAE6OF02HI45R.8.71.G05.1.454.CMB.1.raw
  modified_base (201)..(201): a, c, t, g, unknown or other
  misc_feature (201)..(201): n is a, c, g, or t
tcagctcgcgtgtccacgaccggtgctcgatttagtgtcgtcgcaagagagagggggggagtcagtctcagtcaggacacagcatggacatgagggtccccgctcagctcctggggctcctgctcctctggcctccgaggtgccagttgtgacatccagttcgacccagtcctccctctctctgtctgcttctggtggganacaggcgtcaccatccacgttcggccgggagtacgtcacggtaccaattaaaccaacttaatttaaagttggtatacaaacaaaacgaggaaacaccctaaataccttggtactatactcgctactacctacgttacacgtaacggtccgggtaccctagtacgtaaggttccaggtacggtacgagttagggtaacgttttgggaacttaggttttaccacgttactacctaacgtaactacgacgtacgtacgttaccgtaccgaaacgttaggtaaacgtttatttacgtaaccgttaaactttaccgttaacttaggtaacctaaacgacggtttaaacttaaacaaagttacgtaaaccggtacgggttaaccggttaccgggtaacgtaacggggtaaacccgtaagggttacggtaaaccgtaacgttaaaccggtaaaacgtacccgggttaggacggttaccgtaccggaaccgttaccctaacgttccgtttaacgttaccgtttactacccgttcccgtttaccccggacttaccgtcgtaaccgg

SEQ ID NO: 51183 - DNA, 752 bp, Homo sapiens
  misc_feature: GYAE6OF02FO5P3.8.71.G05.1.454.CMB.1.raw
  modified_base (224)..(224): a, c, t, g, unknown or other
  misc_feature (224)..(224): n is a, c, g, or t
tcagctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtcctccctcctctctgtctgcttctgtgggagacagcgtcaccatcacttggccgggngagtcagtccaattaacaacttattaaattggtatacaaacaaaaaccgagggaaacacccctaaataccgtggtctaatactgactatacctactttgactaaaggttcggggtacccaattaccgtaaggttcaaggtggacgtagtagggtagtttgggaacttacgttttacaccgttctacgtaactaacttccgtagtaccgtacgttacctacccggtaaacgtacgtaaacggtttattttcggaacctttaaacccgtttaaccgttaaccgtacggttaaacctaacgtaacgttaaacccgtttaaacaaccgttaaacgtacccgggtaaaggttacccggtttaccgggttaaccggaaacggggttaaccaaagggggttaggaacgtaaactaaaccggtaaaacgtaaccgtggttaccgggtacgtaccgtaaccgtaacccgtacgtttccgtcggtttaccttaaccggtctttaccccgttccccggtacttaccgttaacgtaccgg

SEQ ID NO: 51184 - DNA, 700 bp, Homo sapiens
  misc_feature: GYAE6OF02GC69X.8.71.G05.1.454.CMB.1.raw
tcagctcgcgtgtccacgaccggtgctcgatttagtgtcgtcgcaagagagaggggggagtcagtctcagtcaggacacagcatggacatgagggtccccgctcagctcctggggctcctgctctctggctccgaggtgccagttgtgacatcctagttcgacccagtcctccctcctctctgtctgcttctggtggagacgacgtcgtaccacctagtaccagttcggccgggacgacgtcctaacgtcctaattaaaccaaacttaatttaaacgttaggtaacttacaaaaccgaaaaaaccgtaagggaaacctacccctaaaataccgtacggtactaagtactggccaactcctattcgacaaaggtcgggtacctatacgtaacggttacaggtaggacgagttggtaagtttacggacttacgtttactactcgtacaacactcgataccgtagtacctacgaactacgtaaagttactttagaacctaaagttcctaagttacgtacaactaagtaaccttaacaacgtaacgtaaccgtaacggtaccggtttacgaacggtaacgggaaaccgtaaacgggtcgaacgtaactaacgaaaacgtacgtaagggtacgtaccgttagaactaacctactacgttaccgtactttaccggactttacccgtacccgacctacgtcgtaacg

SEQ ID NO: 51185 - DNA, 904 bp, Homo sapiens
  misc_feature: GYAE6OF02J0J8N.8.71.G05.1.454.CMB.1.raw
  modified_base (367)..(367): a, c, t, g, unknown or other
  misc_feature (367)..(367): n is a, c, g, or t
  modified_base (574)..(574): a, c, t, g, unknown or other
  misc_feature (574)..(574): n is a, c, g, or t
tcagctcgcgtgtccacgaccggtgctcgatttagtgtcgtcgcaagagagagggggaggtcgagtctcagtcaggacacagcatggacatgaggtcccgctcagctcctggggctcctgctctcctggctcgaggtgccagttgtcgtacatccagttcgaccctagtcctccctcctctactcgtcttgtaccttctcgtaggggacgtacgagcgttacaccagtcctacgtttccgaccgggggctaggtacctaggttcccaacttttaaaaccgtaacttaacgttttaaaacttttcgggttaaacttacgttaaaacaaaaaaccgtaaccggggtaaaaagaccccccgtttaaaaanaaccccgtttagggtaccccttaaagttaacctagtacccgtaatttccaaaccgtttttcggacctaaaacgggtttcgggggtacccaacgttaaccaacgggttttactacggttcgggaacgaggttaccgggttaagtttacggggtaaaccgttacggtttttaccctaaccgtttcgactaaacccttaacgttaaccgnggaaccgtacggttaccttaccggtaaaccccgttaggtaaacgtttaactttaaggttaccctaaaccgttttaaccctaaacgtttcgtttaaacaaaccgttaaaccgtactttaaaacgttaacctaaggtttaacccggtaaccgggttaacggtttaccccgggtaaaggtaacccgggtaaacccgggtaaggttacggggaatttaaccgaacttaaaaccggtaacgttacggtacgggtcttaccggtaacggaccctaattaccgtttcgttaacgttcgtaccctttacgttacccccggtactacccttcgtaacgg

SEQ ID NO: 51186 - DNA, 592 bp, Homo sapiens
  misc_feature: GYAE6OF01DVCDO.33.59.F04.1.454.CMB.1.raw
tcagtacacacactcacgaccggtgctcgatttagtacacacacttagggattggggtctgggagaagagccccagccccagaattcccaggagtttccattcggtgatcagcactgaacacagaggactcaccatggagtttgggctgagctgggttttccttgttgctattataaaaggtgtccagtgtcaggtgcaactggtggagtcgtgggggaggcttgggtcaagcctggagggtccctgagactctcctgtgcagcctctggattcaccttcagtgacttctacatgagctggatccgcaggctccgagggacgggctgggagtgggttcagtacagttggtagtagtggtagaaccatatactacgcagactcgtgtaggaagggccgtattacaccatccgtaccgagggaaccaacgaccaaagaacctcaactgtatcgtagacaagtacgaacacgcctaggtagacgacccgatacggaaccgacggtcccgttacctaagttacccgtggttacgacgtaacgaacctaaagtacgtaggtacggtaaacgtttaaacggggcaaaccgtttaaacg

SEQ ID NO: 51187 - DNA, 514 bp, Homo sapiens
  misc_feature: GYAE6OF01BD7HR.33.59.F04.1.454.CMB.1.raw
  modified_base (479)..(479): a, c, t, g, unknown or other
  misc_feature (479)..(479): n is a, c, g, or t
tcagtacacacactcacgaccggtgctcgatttagtacacacacttagggattggggtctgggagaagagccccagccccagaattcccaggagtttccattcggtgatcagcactgaacacagaggactcaccatggagtttgggctgagctgggttttccttgttgctattataaaaggtgtccagtgtcaggtgcaactggtggagtctgggggaggcttggtcaagcctggagggtccctgagactctcctgtgcagcctctggattcaccttcagtgacttctacatgagctggatccgccaggctccgagggagggctgggagtgggtttcatacattggtagtagtggtagaaccatatactacgcagactctgtgaagggccgattcacatctccagggacaacgccaagactcactgtatctgcaaatgaacagcctagagagccgatcgacacggcctctattactgtncgagacaatatagtggattaaagggctacgtaacg

SEQ ID NO: 51188 - DNA, 508 bp, Homo sapiens
  misc_feature: GYAE6OF01BEDCU.33.59.F04.1.454.CMB.1.raw
  modified_base (427)..(427): a, c, t, g, unknown or other
  misc_feature (427)..(427): n is a, c, g, or t
  modified_base (458)..(458): a, c, t, g, unknown or other
  misc_feature (458)..(458): n is a, c, g, or t
  modified_base (484)..(484): a, c, t, g, unknown or other
  misc_feature (484)..(484): n is a, c, g, or t
tcagtacacacactcacgaccggtgctcgatttagtacacacacttagggattggggtctgggagaagagccccagccccagaattcccaggagtttccattcggtgatcagcactgaacacagaggactcaccatggagtttgggctgagctgggttttccttgttgctattataaaaggtgtccagtgtcaggtgcaactggtggagtctgggggaggcttggtcaagcctggagggtccctgagactctcctgtgcagcctctggattcaccttcagttactatggcatgcactgggtccgccaggctccaggcaaggggctgggagtggctatcagttatatcacatgatagaaaataatactatgcgactcgtagagggccattcagcatctccagagacaattccaagacacgttgtatcngacaaatgaacggtgtagagacctgacgacncggctgtgtattcgtgtgcgaaagtnttaatacgatgtatttgacgttgg

SEQ ID NO: 51189 - DNA, 175 bp, Homo sapiens
  misc_feature: GYAE6OF01EB3HZ.33.59.F04.1.454.CMB.1.raw
  modified_base (173)..(175): a, c, t, g, unknown or other
  misc_feature (173)..(175): n is a, c, g, or t
tcagtacacacactcacgaccggtgctcgatttagtacacacacttagggattgggggaagaggaagactgacggtcccccaggagttcaggtgctgggcacagcggccctgggctgcctggtcaaggactacttccagtgtgtgtactgagcgggctggcaaggcgcatagnnn

SEQ ID NO: 51190 - DNA, 581 bp, Homo sapiens
  misc_feature: GYAE6OF01B96CW.33.59.F04.1.454.CMB.1.raw
tcagtacacacactcacgaccggtgctcgatttagtacacacacttagggattggggtctgggagaagagccccagccccagaattcccaggagtttccattcggtgatcagcactgaacacagaggactcaccatggagtttgggctgagctgggttttccttgttgctattataaaaggtgtccagtgtcaggtgcaactggtggagtcgtggggggaggcttggtcaagcctgggagggtccctgagactctcctgtgcagcctctggacttccaccttcagttgacttctacatgagctggactcccgccaggcctccgaggggagggctgggagtgggtttcagtacagtttgggtagtagtggtaagaacctatatactacgcagacttcgtgtggaacgggccattccacctatcctaccgagggaccaacgccaaagactcactgtatctgacaaatgaacacgcctagagacgccgatcgaccacggtccgtactagttaccgtggtagacgaagaacctaaagttagtacggtagggtaaccgtttaaaacgggggcctaaacgttaaacg

SEQ ID NO: 51191 - DNA, 615 bp, Homo sapiens
  misc_feature: GYAE6OF01CDR7N.33.59.F04.1.454.CMB.1.raw
tcagtacacacactcacgaccggtgctcgatttagtacacacacttagggattggggtctgggagaagagccccagccccagaattcccaggagtttccattcggtgatcagcactgaacacagaggactcaccatggagtttgggctgagctgggttttccttgttgctattataaaaggtgtccagtgtcaggtgcaactggtggagtcgtgggggaggcttggtcaagcctggagggtccctgagactctcctgtgcagcctctggattcaccttcagtgacttctacatgagctggactccgccaggctccgagggagggctggagttgggttacatacgattgggtagtaggtggtaacgaacctatactaactacgcaggtactcgtggtaggaacgggtccgtattccaacctactccgtaccgaagggaaccaaccgaccaaagtacctcaacttgtacttcgagacaaagtcgaaacacggtacctaggacgacgaccgaagtacgaaccgtacccgggtcgttaccttagttaccgtggtacggacggtaagaacctaagttaacgtacggtacggtaacgttaaacggggcctaacgttaaacg

SEQ ID NO: 51192 - DNA, 692 bp, Homo sapiens
  misc_feature: GYAE6OF01E3U6F.33.59.F04.1.454.CMB.1.raw
tcagtacacacactcacgaccggtgctcgatttagtacacacacttagggattggggtctgggagaagagccccagccccagaattcccaggagtttccattcggtgatcagcactgaacacagaggactcaccatggagtttgggctgagctgggttttccttgttgctattataaaaggtgtccagtgtcaggtgcaactggtggagtcgtggggggagcttggtcaagcctggagggtccctgagactctcctgtgcagcctctggattccaccttcagtgacttctacatgagctggactccgccaggcctccgaggggagggctgggagttgggtttcagttacagttgggtaagtaggtaggtaagaacctataactacgtaacgcaaggtaccttcgtggtaggaacgggtcccgtaattccaacccgtattccgtacccgaaggggaaccaaccggaccgaaagaaccttaccgaacttcgttactacgtagaacctaaagtacgaaaccaacgacccgttagggaacggtacggacccgtaagtacggaacccgtccggggtacccgtttacttaaacggtttacccggtggttaccgggaaccggtaagaaaccgttaaagttacgttaacggggttacgggtaaaccgtttaaacggggggaccctaaacgttaaacccgg

SEQ ID NO: 51193 - DNA, 735 bp, Homo sapiens
  misc_feature: GYAE6OF01A9XXL.33.59.F04.1.454.CMB.1.raw
  modified_base (169)..(169): a, c, t, g, unknown or other
  misc_feature (169)..(169): n is a, c, g, or t
  modified_base (225)..(225): a, c, t, g, unknown or other
  misc_feature (225)..(225): n is a, c, g, or t
  modified_base (297)..(297): a, c, t, g, unknown or other
  misc_feature (297)..(297): n is a, c, g, or t
  modified_base (616)..(616): a, c, t, g, unknown or other
  misc_feature (616)..(616): n is a, c, g, or t
  modified_base (684)..(684): a, c, t, g, unknown or other
  misc_feature (684)..(684): n is a, c, g, or t
tcagtacacacactcacgaccggtgctcgatttagtacacacacttagggattggggtctgggagaagacgccccagccccagaattcccaggagtttccattcggtgatcagcactgaacacgagagactcaccagtggagttggctgagtcgttggtttccttgttncgttaattaagtaaagtgtactagtgtgagtgaccagtggtcgaggtggtgggagngttgtagacgtcggtaggacgtccgtagagtctcctcgtggtcgatcgtcgtacgtcgtacttctaccgttntacggttacttaccttctacgagttacggtagtcctacggacctcccggacgtacggtccccgtagggaacggggagggttaccggtgggttaagtttcggttcgtaaggttaccgttaggttaggtaaggttaaggttacggaaacgtaaccttaaagtaaccgttaacgaaccggttcaaccgttaacgtcggttaacggacggtaaccggtaccgtactaaccgtaccgtaccgtttacccgacggtaaacggaccaaacccgaactaaccggtaacctacgtaaacggttacttcgttaactacgaaccgttaanacgtaacgcgttagtacgaacgacgtacgtacgacgtacgccgttacgtacgttactacggtgaacgnggtaaacagtaacgtaagtacggttacgaacgttaacgagttacgttaacg

SEQ ID NO: 51194 - DNA, 175 bp, Homo sapiens
  misc_feature: GYAE6OF02HC2FM.33.59.F04.1.454.CMB.1.raw
  modified_base (172)..(175): a, c, t, g, unknown or other
  misc_feature (172)..(175): n is a, c, g, or t
tcagtacacacactcacgaccggtgctcgatttagtacacacacttagggattggggaagaggaagactgacggtcccccaggagttcaggtgctgggcacagcggccctgggctgcctggtcaaggactacttccagtgtgtgtactgagcgggctggcaaggcgcatagnnnn

SEQ ID NO: 51195 - DNA, 194 bp, Homo sapiens
  misc_feature: GYAE6OF02I74Y9.33.59.F04.1.454.CMB.1.raw
  modified_base (174)..(194): a, c, t, g, unknown or other
  misc_feature (174)..(194): n is a, c, g, or t
tcagtacacacactcacgaccggtgctcgatttagtacacacacttagggagttgggggaagaggaagactgacggtcccccaggagttcaggtgctgggcacagcggccctgggctgcctggtcaaggctacttccagtgtgtgtactgagcgggctggcaaggcgcatagcnnnnnnnnnnnnnnnnnnnnn

SEQ ID NO: 51196 - DNA, 174 bp, Homo sapiens
  misc_feature: GYAE6OF02FMSXM.33.59.F04.1.454.CMB.1.raw
  modified_base (173)..(174): a, c, t, g, unknown or other
  misc_feature (173)..(174): n is a, c, g, or t
tcagtacacacactcacgaccggtgctcgatttagtacacacacttagggattgggggaagaggaagactgacggtcccccaggagttcaggtgctgggcacagcggccctgggctgcctggtcaaggactacttccagtgtgtgtactgagcgggctggcaaggcgcatagnn

SEQ ID NO: 51197 - DNA, 727 bp, Homo sapiens
  misc_feature: GYAE6OF02IPZLZ.33.59.F04.1.454.CMB.1.raw
tcagtacacacactcacgaccggtgctcgatttagtacacacacttagggattgggggtctgggagaagagccccagccccagaattcccaggagtttccattcggtgatcagcactgaacacagaggactcaccatggagtttgggctgagctgggttttccttgttgctattaataaaaggtgtccagtgtcaggtgcaactggtggagtcgtggggggaggtcgttggtcaagcctgggagggtccctgagactctcctgtgcacgcctcgtggattccaccttcagtgtacttctacatgagctggactccggccaggcctccgaggggacggggcgtgggtagttgggtttcagttacgtagttgggtagttaggtaggtaacgaacctatataaccgtacgacagacctcgtaggtaggaacgggtccgtattccaaccagttccctaccggaacgggaaccaaaccggaccaaacgtaacctaccgtaacgttacgttactaccgtagaactaaacgttagaaaacccgtacggtaccccgtaagggaacggaccgtaacccggtaacgtacggaaacccggtaccgggtaccccgtttacgttaaacgttttaccggtggtttaccgggaaccgggtaacgtaaaccgttaaagttaacggttaacggggttacgggttaacggtttaaaaccgggggacccgtaaactttaaacccgg

SEQ ID NO: 51198 - DNA, 173 bp, Homo sapiens
  misc_feature: GYAE6OF02IMW0P.33.59.F04.1.454.CMB.1.raw
  modified_base (173)..(173): a, c, t, g, unknown or other
  misc_feature (173)..(173): n is a, c, g, or t
tcagtacacacactcacgaccggtgctcgatttagtacacacacttagggattgggggaagaggaagactgacggtcccccaggagttcaggtgctgggcacagcggccctgggctgcctggtcaaggactacttccagtgtgtgtactgagcgggctggcaaggcgcatagn

SEQ ID NO: 51199 - DNA, 686 bp, Homo sapiens
  misc_feature: GYAE6OF02I3H1X.33.59.F04.1.454.CMB.1.raw
tcagtacacacactcacgaccggtgctcgatttagtacacacacttagggattggggtctgggagaagagccccagccccagaattcccaggagtttccattcggtgatcagcactgaacacagaggactcaccatggagtttgggctgagctgggttttccttgttgctattataaaaggtgtccagtgtcaggtgcaactggtggagtcgtgggggaggcttggtcaagcctggagggtccctgagactctcctgtgcagcctctggacttccaccttcagtgacttctacatgagtctggactccgccaggcctccgagggaagggctgggagtgggttcagtacagttggtagtaggtaggtaacgaacctagttactaaccgtacgacaagtacctcgttaggtcggaaacggggtcctaagtttacccaacctagttcccgtaccgaaggggtaaccaaaccggacccaaaacggtaaacccttaccgtaacttaggttaacttcgtacgaacctaaaagtcgaaaccgtacgacccgtaggacggtaaccgccggtaataccggaaacgacccgggtaccgttacgttaactttacggtcggttaccggacggtaacgtaacctaaagttacgtaacggttacgggaacggtttaaacggggaccgtaaccttaaacgg

SEQ ID NO: 51200 - DNA, 639 bp, Homo sapiens
  misc_feature: GYAE6OF02IXEL6.33.59.F04.1.454.CMB.1.raw
  modified_base (426)..(426): a, c, t, g, unknown or other
  misc_feature (426)..(426): n is a, c, g, or t
tcagtacacacactcacgaccggtgctcgatttagtacacacacttagggattggggtctgggagaagagcccccagccccagaattcccaggagtttccattcggtgatcagcactgaacacagaggactcaccatggagtttgggctgagcgtgggtttccgtgtagctattataaaaggtgtccagtgtcaggtgcaactggtggagtcgtgggggaggcgtggtccagcctggggggtccctggagacctctcctgtcgcaggcctctggacttcaccttcagttactatggacatgctacgtcgggtccgccgagggcctccgacgggcgaagggggcctgggaggtggtacttatcgtagttatatcactatcgaatagaaaataatactatcgcgactcgtaggaggccgtattcgacnctatccgtaccagacgactaactaccaagtaacacgttagttactactagactaaacgtacgacgggttagtagtacgtacccgtaggaaaccggccgtaaccggtagttacggttagttttcgtttacggtacgttaggtaaccgaaaggttaactttaaggtttaacgttacttaggttacgttttacggttaaccgttggtttaacccgg

SEQ ID NO: 51201 - DNA, 988 bp, Homo sapiens
  misc_feature: GYAE6OF02IGG0A.33.59.F04.1.454.CMB.1.raw
tcagtacacacactcacgaccggtgctcgatttagtacacacacttagggattggggtctgggagaagagccccagccccagaattcccaggagtttccattcggtgatcagcactgaacacagaggactcaccatggagtttggctgagtcttgggtttccttgttgctattaataaaggtgtcctagtgtctaggtgcaacgtggtggtagtcggtgggggagtcgttggtacacgccgtgggtacgggtccctaggacgtacttccgtcctgtacgcacgtcctcgttcggtacttccgtacccgttgtacgtcgttaccttacgtactaagttccggagtaccggttacggtaccgtccccggtaccggtaccgggtcccggttaaccgggggaaacgggggggtaacggggttcggttaacgggggttacgggttttaccggggttttaaaccgtaggttaaaccgggttagggttttaacgggggttaaacggttacggggttaacggttaaacggtaaaccgttaacgtttaaccccgttaaaccggttaaccggtaccgttaacggttacccggtttacggtaaacggggtaaccggggttaaaccgggttaccctttaaccgttacccgtaaaccggttaccggtacccggtaacccgggaaaccgggtaaacccgaacccggttaaacccgaaaccggttaacccgttaccgttaacggttaccgttaacccgttaccggtaaacgtaaaccgttaaaccgtacggaaaccgttaccggtaaccgttaggaaccgggtacccgttacgggtaaccggtttacccgggaaccccgggttaccgtttaaccggttaccgtttacgggtttaacccgtcgggttaaacccggaaaggttaaccgtaaaccggtttaacggtttaggacccgggtttaacggtaaacccgggttaacgggttacccttaaacggtttaccgg

SEQ ID NO: 51202 - DNA, 668 bp, Homo sapiens
  misc_feature: GYAE6OF02G9UI9.33.59.F04.1.454.CMB.1.raw
  modified_base (391)..(391): a, c, t, g, unknown or other
  misc_feature (391)..(391): n is a, c, g, or t
tcagtacacacactcacgaccggtgctcgatttagtacacacacttagggattggggtctgggagaagagccccagccccagaattcccaggagtttccattcggtgatcagcactgaacacagaggactcaccatggagtttgggctgagctgggttttccttgttgctattataaaaggtgtccagtgtcaggtgcaacgtggtggagtcgtgggggaggcttggtcaagcctggagggtccctgagactctcctgtgcagcctcgtggactttccaccttcagtcgtacttcctaacatgagtcgtggactcccgaccgaggcctccgaggggaaggggctagggaggttgggtttacagtaacgtagttgggtagtaggtaggtaanaaccgtataactactacgacagtactcgtggtaggaacgggcctattaccacctacttcccgtaccggaacggaaccgaaccgaccgaaacgtaacctcaacgttgtactcgtacgacaaagtcgaaacacggtaccgtagagaacggccgtagtaccggaaccgtccgggtaccctttactaacgtttaccgtacggtcggaaccgtaacgtaactaaagttacggttaagggtacgggttaaacccggttaaagggacccgtaaacgttaaaccg

SEQ ID NO: 51203 - DNA, 627 bp, Homo sapiens
  misc_feature: GYAE6OF02FT7P5.33.59.F04.1.454.CMB.1.raw
  modified_base (255)..(255): a, c, t, g, unknown or other
  misc_feature (255)..(255): n is a, c, g, or t
  modified_base (294)..(294): a, c, t, g, unknown or other
  misc_feature (294)..(294): n is a, c, g, or t
  modified_base (355)..(355): a, c, t, g, unknown or other
  misc_feature (355)..(355): n is a, c, g, or t
  modified_base (506)..(506): a, c, t, g, unknown or other
  misc_feature (506)..(506): n is a, c, g, or t
tcagtacacacactcacgaccggtgctcgatttagtacacacacttagggattggggtctgggagaagagccccagccccagaattcccaggagtttccattcggtgatcagcactgaacacagaggactcaccatggagtttgggctgagctgggttttcctgttgctattataaagtgtccagtgtcaggtgcaactggtggagtcgtgggggaggcttggtcaagcctgggaggtccctgagactctcctgngcagcctcgtggacttcaccttcagttcgtacttctacntgagtctggctccgccgacggcctccggaggggacggggctgggagtggctggtcatagtntccgttgtgggtaggtgagttcgggtcgccgtttcgttccgtacggcggtactcgttggcgggtacggggtctagttcgacgtccgtaaccttccgaagtaacgacccgaaacggaccccaaacacccgttcccgtagccctacgttcccnccgaaagtcgtacggaacctaacgtcggacgacgtaccgggacgtaccgacgggtctagtaacgttattcgtacggtaccgtaacacggtaccgtaacccgttagacggcctaaggtccgg

SEQ ID NO: 51204 - DNA, 659 bp, Homo sapiens
  misc_feature: GYAE6OF02ID4EL.33.59.F04.1.454.CMB.1.raw
  modified_base (276)..(276): a, c, t, g, unknown or other
  misc_feature (276)..(276): n is a, c, g, or t
  modified_base (369)..(369): a, c, t, g, unknown or other
  misc_feature (369)..(369): n is a, c, g, or t
  modified_base (383)..(383): a, c, t, g, unknown or other
  misc_feature (383)..(383): n is a, c, g, or t
  modified_base (594)..(594): a, c, t, g, unknown or other
  misc_feature (594)..(594): n is a, c, g, or t
tcagtacacacactcacgaccggtgctcgatttagtacacacacttagggtagttggggtctgggagaagagccccagccccagaattcccaggacgtttccattccggtgatcagcactgaacacagaggactcaccatggaggtttggctgagcgtggttttccttgttgctattagtaaaaggtgtccagtgtcaggtgcaacgtggtaggagtcggtggggacggtcgttggtcaacgccgttggacgggtcctgacgacctctcctgtacncgacgtccgtctacggtctttcacccttgtacgtcgtacctttcaccgtagtcgagtcgttacgcgtccgccgtaggcctcgaggaggctggngtcggttcagtacngttgtacgtagtgaacgacgatagtaacgtcgacgtagtaccttcggacgtcgggaacggtcgtaacgtccgaaactcttacccgacgaaggtaaccaacggacctaacgtaactacgtactcgttaactcgtagaacctaatacgaacctacgaccgtacgagaccgtccgtagtaaccgtccgtaaccgcgttacgtacgttttaccgnggttacccgagtaacgaccggtaattcggtaaggtcggttaaccgtaacggtcttaacgttaacg

SEQ ID NO: 51205 - DNA, 700 bp, Homo sapiens
  misc_feature: GYAE6OF02HB2VI.33.59.F04.1.454.CMB.1.raw
  modified_base (182)..(182): a, c, t, g, unknown or other
  misc_feature (182)..(182): n is a, c, g, or t
  modified_base (219)..(219): a, c, t, g, unknown or other
  misc_feature (219)..(219): n is a, c, g, or t
tcagtacacacactcacgaccggtgctcgatttagtacacacacttagggattggggtctgggagaagagccccagccccagaattcccaggagtttccattcggtgatcagcactgaacacagaggactcaccatggagtttgggctgagctgggttttccttgttgctattataaaggtntccagtgtcaggtgcaactggtggagtcgtggggganacctggtcaagcctgggacgggtccctgagacctctcctgtcgcagcccgctggtattcagtcttcagtcgacttactacagtcgggctagggactccgacgacggcctaccggaagggggacgggcgtagggaggttggtacttttcaagtttccgaagttttaacgttaaacgttccggtttacgttccggtacccttaccccgaaaggtaccgttacccctaaacgttttaaagaaacttagtcgaacctaaggttaacttcgtagggtagggaacggtacgggtacccgttagtttccccgaaccggttccacccgaaggtaaccgaacccgaccggaccgagtacgtcctactaaccgtttacgtttacgcgtaaccgaagtagtaaccgacgacgtcccgtaggacgaccgtaccgggaaagcgtaccggtcctgttacttagttaggtgggtaaggggtggtagtaggttcggg

SEQ ID NO: 51206 - DNA, 176 bp, Homo sapiens
  misc_feature: GYAE6OF01CLYZL.38.55.E11.1.454.CMB.1.raw
  modified_base (173)..(176): a, c, t, g, unknown or other
  misc_feature (173)..(176): n is a, c, g, or t
tcagtcgatcacgtcacgaccggtgctcgatttagcactcgcacgttgggtttgggggaagaggaagactgacggtcccccaggagttcaggtgctgggcacagcggccctgggctgcctggtcaaggactacttccacgtgatcgactgagcgggctggcaaggcgcatagnnnn

SEQ ID NO: 51207 - DNA, 173 bp, Homo sapiens
  misc_feature: GYAE6OF01DY8PC.38.55.E11.1.454.CMB.1.raw
  modified_base (173)..(173): a, c, t, g, unknown or other
  misc_feature (173)..(173): n is a, c, g, or t
tcagtcgatcacgtcacgaccggtgctcgatttagcactcgcacgttgggtttgggggaagaggaagactgacggtcccccaggagttcaggtgctgggcacagcggccctgggctgcctggtcaaggactacttccacgtgatcgactgagcgggctggcaaggcgcatagn

SEQ ID NO: 51208 - DNA, 186 bp, Homo sapiens
  misc_feature: GYAE6OF01AQXJ9.38.55.E11.1.454.CMB.1.raw
  modified_base (174)..(186): a, c, t, g, unknown or other
  misc_feature (174)..(186): n is a, c, g, or t
tcagtcgatcacgtcacgaccggtgctcgatttagcactcgcacggttgggtttgggggaagaggaagactggacggtcccccaggagttcaggtgctgggcacagcggccctgggctgcctggtcaaggctacttccacgtgatcgactgagcgggctggcaaggcgcatagnnnnnnnnnnnnn

SEQ ID NO: 51209 - DNA, 187 bp, Homo sapiens
  misc_feature: GYAE6OF01C979A.38.55.E11.1.454.CMB.1.raw
  modified_base (173)..(187): a, c, t, g, unknown or other
  misc_feature (173)..(187): n is a, c, g, or t
tcagtcgatcacgtcacgaccggtgctcgatttagcactcgcacgttgggtttgggggaagaggaagactgacggtcccccaggagttcaggtgctgggcacagcggccctgggctgcctggtcaaggactacttccacgtgatcgactgagcgggctggcaaggcgcatagnnnnnnnnnnnnnnn

SEQ ID NO: 51210 - DNA, 174 bp, Homo sapiens
  misc_feature: GYAE6OF01D9B2Y.38.55.E11.1.454.CMB.1.raw
  modified_base (173)..(174): a, c, t, g, unknown or other
  misc_feature (173)..(174): n is a, c, g, or t
tcagtcgatcacgtcacgaccggtgctcgatttagcactcgcacgttgggtttgggggaagaggaagactgacggtcccccaggagttcaggtgctgggcacagcggccctgggctgcctggtcaaggactacttccacgtgatcgactgagcgggctggcaaggcgcatagnn

SEQ ID NO: 51211 - DNA, 175 bp, Homo sapiens
  misc_feature: GYAE6OF01CK83Y.38.55.E11.1.454.CMB.1.raw
  modified_base (173)..(175): a, c, t, g, unknown or other
  misc_feature (173)..(175): n is a, c, g, or t
tcagtcgatcacgtcacgaccggtgctcgatttagcactcgcacgttgggtttgggggaagaggaagactgacggtcccccaggagttcaggtgctgggcacagcggccctgggctgcctggtcaaggactacttccacgtgatcgactgagcgggctggcaaggcgcatagnnn

SEQ ID NO: 51212 - DNA, 374 bp, Homo sapiens
  misc_feature: GYAE6OF01C5NWJ.38.55.E11.1.454.CMB.1.raw
  modified_base (368)..(374): a, c, t, g, unknown or other
  misc_feature (368)..(374): n is a, c, g, or t
tcagtcgatcacgtcacgaccggtgctcgatttagcactcgcacgttgggtttgggggctgttcctggtaccagcagctcccaggaacagccccaaactcctcatttatgaccataataggcgaccctcagggattcctgaccgattctctggctccaagtctggcacgtcagccaccctgggcatcaccggcctccagactggggacgaggccgattattactgcggaacatgggataccagactgaatgcttgggtgctcggtggagggaccaggctgaccgtctaggtcagcccaaggctgccccctggtcactctgttcccacctcctcacgtgatcgactgagcggctggcaaggcgcatagnnnnnnn

SEQ ID NO: 51213 - DNA, 173 bp, Homo sapiens; identical to SEQ ID NO: 51207
  misc_feature: GYAE6OF01EWYVX.38.55.E11.1.454.CMB.1.raw
  modified_base (173)..(173): a, c, t, g, unknown or other
  misc_feature (173)..(173): n is a, c, g, or t

SEQ ID NO: 51214 - DNA, 187 bp, Homo sapiens
  misc_feature: GYAE6OF01DYL70.38.55.E11.1.454.CMB.1.raw
  modified_base (172)..(187): a, c, t, g, unknown or other
  misc_feature (172)..(187): n is a, c, g, or t
tcagtcgatcacgtcacgaccggtgctcgatttagcactcgcacgttgggtttgggggaagaggaagactgacggtcccccaggagttcaggtgctgggcacagcggccctgggctgcctggtcaaggactacttccacggatcgactgagcgggctggcaaggcgcatagnnnnnnnnnnnnnnnn

SEQ ID NO: 51215 - DNA, 174 bp, Homo sapiens; identical to SEQ ID NO: 51210
  misc_feature: GYAE6OF01AYE9I.38.55.E11.1.454.CMB.1.raw
  modified_base (173)..(174): a, c, t, g, unknown or other
  misc_feature (173)..(174): n is a, c, g, or t

SEQ ID NO: 51216 - DNA, 517 bp, Homo sapiens
  misc_feature: GYAE6OF01AMY6L.38.55.E11.1.454.CMB.1.raw
  modified_base (259)..(259): a, c, t, g, unknown or other
  misc_feature (259)..(259): n is a, c, g, or t
  modified_base (379)..(379): a, c, t, g, unknown or other
  misc_feature (379)..(379): n is a, c, g, or t
  modified_base (381)..(381): a, c, t, g, unknown or other
  misc_feature (381)..(381): n is a, c, g, or t
  modified_base (385)..(386): a, c, t, g, unknown or other
  misc_feature (385)..(386): n is a, c, g, or t
  modified_base (388)..(388): a, c, t, g, unknown or other
  misc_feature (388)..(388): n is a, c, g, or t
  modified_base (398)..(398): a, c, t, g, unknown or other
  misc_feature (398)..(398): n is a, c, g, or t
  modified_base (409)..(409): a, c, t, g, unknown or other
  misc_feature (409)..(409): n is a, c, g, or t
  modified_base (413)..(413): a, c, t, g, unknown or other
  misc_feature (413)..(413): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
  modified_base (419)..(419): a, c, t, g, unknown or other
  misc_feature (419)..(419): n is a, c, g, or t
  modified_base (422)..(422): a, c, t, g, unknown or other
  misc_feature (422)..(422): n is a, c, g, or t
  modified_base (425)..(425): a, c, t, g, unknown or other
  misc_feature (425)..(425): n is a, c, g, or t
  modified_base (489)..(489): a, c, t, g, unknown or other
  misc_feature (489)..(489): n is a, c, g, or t
  modified_base (512)..(512): a, c, t, g, unknown or other
  misc_feature (512)..(512): n is a, c, g, or t
  modified_base (514)..(514): a, c, t, g, unknown or other
  misc_feature (514)..(514): n is a, c, g, or t
  modified_base (516)..(516): a, c, t, g, unknown or other
  misc_feature (516)..(516): n is a, c, g, or t
tcagtcgatcacgtcacgaccggtgctcgatttagcactcgcacgttgggggtttcggggctgttcctcggtaccagcagctcccaggaacagccccaaactcctcatttatgaccataataggccgaccctcacgggattccgtggaccgattctcgtggctccaagtctggcacgtcagccacctaggcatcacggctcagactgggacgagccgattatactgcggaacatgggataccagctgaatgcttgggtnctcggtggagggaccaggctgaccgtcctaggtcagccaaggctgccccctggtcacgtctcgttcccgcctcgtcacgtgactcgactgagcggactggcgaacggcgaccagtacgcncncgcnncncgacgagtcncgtcgctccgnaccncncncncgngcncgcgcgcgcgcgcgcgcgcgcgtcgtcgacgtacgtactacgtcgacgacgacgacgtcgtagnggcgcgagacgacgacgagacgngngng

SEQ ID NO: 51217 - DNA, 377 bp, Homo sapiens
  misc_feature: GYAE6OF01DDBT7.38.55.E11.1.454.CMB.1.raw
  modified_base (365)..(365): a, c, t, g, unknown or other
  misc_feature (365)..(365): n is a, c, g, or t
  modified_base (368)..(368): a, c, t, g, unknown or other
  misc_feature (368)..(368): n is a, c, g, or t
  modified_base (371)..(377): a, c, t, g, unknown or other
  misc_feature (371)..(377): n is a, c, g, or t
tcagtcgatcacgtcacgaccggtgctcgatttagcactcgcacgttgggtttggggctgttcctggtaccagcagctcccaggaacagcccccaaactcctcatttatgaccataataggcgaccctcagggattcctgaccgattctctggctccaagtctggcacgtcagccaccctgggcatcaccggcctccagactggggacgaggccgattattactgcggaacatgggataccagactgaatgcttgggtgctcggtggagggaccaggctgaccgtcctaggtcagccccaaggctgccccctggtcactctgttcccgccctcctcacgtgatcgactgagcggctggcaaggcncanagnnnnnnn

SEQ ID NO: 51218 - DNA, 394 bp, Homo sapiens
  misc_feature: GYAE6OF01AP2NC.38.55.E11.1.454.CMB.1.raw
  modified_base (374)..(394): a, c, t, g, unknown or other
  misc_feature (374)..(394): n is a, c, g, or t
tcagtcgatcacgtcacgaccggtgctcgatttagcactcgcacgttgggtttgggggctagttcctggtaccagcagctcccaggaacagcccccaaactcctcatttatgaccataataggcgaccctcagggattcctgaccgattctctggctccaagtctggcacgtcagccaccctgggcatcaccggcctccagactggggacaggccgattattactgcggaacatgggataccagactgaatgcttggggtgctcggtggagggaccaggctgaccgtcctaggtcagcccaaggctgccccctggtccactctcgtcccgccctcctcacgtgatcgactgagcggctggcaacggcgcatagnnnnnnnnnnnnnnnnnnnnn

SEQ ID NO: 51219 - DNA, 175 bp, Homo sapiens
  misc_feature: GYAE6OF01AE9PC.38.55.E11.1.454.CMB.1.raw
  modified_base (173)..(175): a, c, t, g, unknown or other
  misc_feature (173)..(175): n is a, c, g, or t
tcagtcgatcacgtcacgaccggtgctcgatttagcactcgcacgttgggtttgggggaagaggaagactggcggtcccccaggagttcaggtgctgggcacagcggccctgggctgcctggtcaaggactacttccacgtgatcgactgagcgggctggcaaggcgcatagnnn

SEQ ID NO: 51220 - DNA, 386 bp, Homo sapiens
  misc_feature: GYAE6OF01EWYMM.38.55.E11.1.454.CMB.1.raw
  modified_base (373)..(386): a, c, t, g, unknown or other
  misc_feature (373)..(386): n is a, c, g, or t
tcagtcgatcacgtcacgaccggtgctcgatttagcactcgcacgttgggtttgggggctgttcctggtaccagcagctcccaggaacagcccccaaactcctcatttatgaccataataggcgaccctcagggattcctgaccgattctctggctccaagtctggcacgtcagccaccctgggcatcaccggcctccagactggggacgaggccgattatactgcggaacatgggataccagactgaatgcttggggtgctcggtggaggaccgaggctgaccgtcctaggtcagcccaaggctcgcccctcggtcactctgtcccgccctctcacgtgatcgactgacgcggctggcgaaggcgcagtagnnnnnnnnnnnnnn

SEQ ID NO: 51221 - DNA, 178 bp, Homo sapiens
  misc_feature: GYAE6OF01D8604.38.55.E11.1.454.CMB.1.raw
  modified_base (174)..(178): a, c, t, g, unknown or other
  misc_feature (174)..(178): n is a, c, g, or t
tcagtcgatcacgtcacgaccggtgctcgatttagcactcgcacgttgggtttgggggaagaggaagactgacggtccccccaggagttcaggtgctgggcacagcggccctgggctgcctggtcaaggactacttccacgtgatcgactgagcgggctggcaaggcgcatagnnnnn

SEQ ID NO: 51222 - DNA, 394 bp, Homo sapiens
  misc_feature: GYAE6OF01EZZ5U.38.55.E11.1.454.CMB.1.raw
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
  modified_base (265)..(265): a, c, t, g, unknown or other
  misc_feature (265)..(265): n is a, c, g, or t
  modified_base (318)..(318): a, c, t, g, unknown or other
  misc_feature (318)..(318): n is a, c, g, or t
  modified_base (350)..(350): a, c, t, g, unknown or other
  misc_feature (350)..(350): n is a, c, g, or t
  modified_base (377)..(394): a, c, t, g, unknown or other
  misc_feature (377)..(394): n is a, c, g, or t
tcagtcgatcacgtcacgaccggtgctcgatttagcactcgcacgttgggtttgggggctgttcctggtaccagcagctcccaggaacagccccccaaactcctcatttatgaccataataggcgaccctcagggattcctgaccgattctctggctccaagtctggtcacgtcagccaccctgggcatcaccggcctccagactggggacgaggccgattattactgcgaacatgggataccagactgaatgnttggnctcggnggaggccaggctgaccgtctaggtcagcccaaggctcggcccccctcggtacncctacgtcgttcccgccctcctcacgtgtacncgactgagcggctggcaagcgcatagnnnnnnnnnnnnnnnnnn

SEQ ID NO: 51223 - DNA, 393 bp, Homo sapiens
  misc_feature: GYAE6OF01AK2B9.38.55.E11.1.454.CMB.1.raw
  modified_base (258)..(258): a, c, t, g, unknown or other
  misc_feature (258)..(258): n is a, c, g, or t
  modified_base (381)..(393): a, c, t, g, unknown or other
  misc_feature (381)..(393): n is a, c, g, or t
tcagtcgatcacgtcacgaccggtgctcgatttagcactcgcacgttgggtttgggggctgttcctggtaccagcagctcccaggaacagcccccaaactcctcatttatgaccataataggcgaccctcagggattcctgaccgattctctggctccaagtctggcacgtcagccaccctgggcatcaccggcctccagactggggacaggccgattattactgcggaacatgggataccagactgaatgcttgggncgtcggtggaggaccaggctgaccgtctaggtcagcccaaggctcgccccctggcactctcgttccccaccctcctcaccggtgtactcgactggacggtcgggctgggcaaggcgacatagnnnnnnnnnnnnn

SEQ ID NO: 51224 - DNA, 434 bp, Homo sapiens
  misc_feature: GYAE6OF01EA0AC.38.55.E11.1.454.CMB.1.raw
  modified_base (146)..(146): a, c, t, g, unknown or other
  misc_feature (146)..(146): n is a, c, g, or t
  modified_base (411)..(434): a, c, t, g, unknown or other
  misc_feature (411)..(434): n is a, c, g, or t
tcagtcgatcacgtcacgaccggtgctcgatttagcactcgcacgttgggtttgggggctgttcctggtaccagcagctcccaggaacagcccccaaactcctcatttatgaccataataggcgaccctcagggattcctgaccgnttctctggctccaagtctggcacgtcagccaccctggcatcaccggcctccagacgtggggacgaggccgattattactgacggaacagtgggataccagactgaatgcgttggggtgcgtcggtggagggaccaggctcggaccgtcctaggtcacggaccccgaaggcctacgcccccgtcggtccaccgttcctcgttccccgccccttacctccacgtagacgtcgacgtggacggcggcgtaggacaaggcgcaacgtgnnnnnnnnnnnnnnnnnnnnnnnn

SEQ ID NO: 51225 - DNA, 518 bp, Homo sapiens
  misc_feature: GYAE6OF01DG9WW.38.55.E11.1.454.CMB.1.raw
  modified_base (110)..(110): a, c, t, g, unknown or other
  misc_feature (110)..(110): n is a, c, g, or t
  modified_base (132)..(132): a, c, t, g, unknown or other
  misc_feature (132)..(132): n is a, c, g, or t
  modified_base (265)..(265): a, c, t, g, unknown or other
  misc_feature (265)..(265): n is a, c, g, or t
  modified_base (471)..(518): a, c, t, g, unknown or other
  misc_feature (471)..(518): n is a, c, g, or t
tcagtcgatcacgtcacgaccggtgctcgatttagcactcgcacgttgggtttgggggctgttcctggtaccagcagctcccaggaacagcccccaaactcctcatttangaccataagtaggccgaccctnagggattcctgaccgattctctggctccaagtctggcacgtcagcccacccgtgggcatcgacccggcctcaggacgtggggacgaggacctattattagtaggcggaacagtgggactaccagactgaatgnggttggtgcgtggggtgggacgggaccgaaggtccgtacgtacccggtccgtacggtaccacggtccccgaaggcccgtccggccccccgttggtacccgtaccgtcgttcccggttacccccgtccctttacccgtccgtacgtacggacttcggtcgtaggaccggggtcggaccgtcgggaacggacggcgtacgaagtagcnnnnnnnnnnnnnnnnnnnnnnnnnnnnnnnnnnnnnnnnnnnnnnnn

SEQ ID NO: 51226 - DNA, 163 bp, Homo sapiens
  misc_feature: GYAE6OF02GBDMT.38.55.E11.1.454.CMB.1.raw
  modified_base (162)..(163): a, c, t, g, unknown or other
  misc_feature (162)..(163): n is a, c, g, or t
tcagtcgatcacgtcacgaccggtgctcgattagcactcgcacgttggttggaagaggagactgacggtcccacggagttcaggtgctggcacagcggccctggctgcctggtcaaggactacttccacgtgatcgactgagcggctggcaaggcgcatagnn

SEQ ID NO: 51227 - DNA, 171 bp, Homo sapiens
  misc_feature: GYAE6OF02HZGYZ.38.55.E11.1.454.CMB.1.raw
  modified_base (168)..(171): a, c, t, g, unknown or other
  misc_feature (168)..(171): n is a, c, g, or t
tcagtcgatcacgtcacgaccggtgctcgatttagcactcgcacgttggttgggaagaggaagactgacggtccccaggagttgaggtgctgggcacagcggccctgggctgcctggtcaaggactacttccacgtgatcgactgagcgggctggcaaggcgcatagnnnn

SEQ ID NO: 51228 - DNA, 371 bp, Homo sapiens
  misc_feature: GYAE6OF02F15V2.38.55.E11.1.454.CMB.1.raw
  modified_base (369)..(371): a, c, t, g, unknown or other
  misc_feature (369)..(371): n is a, c, g, or t
tcagtcgatcacgtcacgaccggtgctcgatttagcactcgcacgttgggtttggggctgttcctggtaccagcagctcccaggaacagccccaaactcctcatttatgaccataataggcgaccctcagggattcctgaccgattctctggctccaagtctggcacgtcagccaccctgggcatcaccggcctccagactggggacgaggccgattattactgcggaacatgggataccagactgaatgcttgggtgctcggtggagggaccaggctgaccgtcctaggtcagcccaaggctgccccctcggtcactctgttcccacctcctcacgtgatcgactgagcggctggcaaggcgcatagnnn

SEQ ID NO: 51229 - DNA, 170 bp, Homo sapiens
  misc_feature: GYAE6OF02FF3U8.38.55.E11.1.454.CMB.1.raw
  modified_base (169)..(170): a, c, t, g, unknown or other
  misc_feature (169)..(170): n is a, c, g, or t
tcagtcgatcacgtcacgaccggtgctcgatttagcactcgcacgttgggtttgggaagaggaagactgacggtccccaggagttcaggtgctgggcacagcggccctgggctgcctggtcaaggactacttccacgtgatcgactgagcggctggcaaggcgcatagnn

SEQ ID NO: 51230 - DNA, 186 bp, Homo sapiens
  misc_feature: GYAE6OF02FXPDV.38.55.E11.1.454.CMB.1.raw
  modified_base (173)..(186): a, c, t, g, unknown or other
  misc_feature (173)..(186): n is a, c, g, or t
tcagtcgatcacgtcacgaccggtgctcgatttagcactcgcacgttgggtttgggggaagaggaagactgacggtcccccaggagttcaggtgctgggcacagcggccctgggctgcctggtcaaggactacttccacgtgatcgactgagcgggctggcaaggcgcatagnnnnnnnnnnnnnn

SEQ ID NO: 51231 - DNA, 176 bp, Homo sapiens
  misc_feature: GYAE6OF02GPADV.38.55.E11.1.454.CMB.1.raw
  modified_base (172)..(176): a, c, t, g, unknown or other
  misc_feature (172)..(176): n is a, c, g, or t
tcagtcgatcacgtcacgaccggtgctcgatttagcactcgcacgttgggtttggggaagaggaagactgacggtcccccaggagttcaggtgctgggcacagcggccctgggctgcctggtcaaggactacttccacgtgatcgactgagcgggctggcaaggcgcatagnnnnn

SEQ ID NO: 51232 - DNA, 186 bp, Homo sapiens; identical to SEQ ID NO: 51230
  misc_feature: GYAE6OF02F3ZZL.38.55.E11.1.454.CMB.1.raw
  modified_base (173)..(186): a, c, t, g, unknown or other
  misc_feature (173)..(186): n is a, c, g, or t

SEQ ID NO: 51233 - DNA, 178 bp, Homo sapiens
  misc_feature: GYAE6OF02FTSBA.38.55.E11.1.454.CMB.1.raw
  modified_base (173)..(178): a, c, t, g, unknown or other
  misc_feature (173)..(178): n is a, c, g, or t
tcagtcgatcacgtcacgaccggtgctcgatttagcactcgcacgttgggtttgggggaagaggaagactgacggtcccccaggagttcaggtgctgggcacagcggccctgggctgcctggtcaaggactacttccacgtgatcgactgagcgggctggcaaggcgcatagnnnnnn

SEQ ID NO: 51234 - DNA, 176 bp, Homo sapiens
  misc_feature: GYAE6OF02FXNCJ.38.55.E11.1.454.CMB.1.raw
  modified_base (173)..(176): a, c, t, g, unknown or other
  misc_feature (173)..(176): n is a, c, g, or t
tcagtcgatcacgtcacgaccggtgctcgatttagcactcgcacgttgggtttgggggaagaggaagactgacggtcccccaggagttcaggtgctgggcacagtggccctgggctgcctggtcaaggactacttccacgtgatcgactgagcgggctggcaaggcgcatagnnnn

SEQ ID NO: 51235 - DNA, 390 bp, Homo sapiens
  misc_feature: GYAE6OF02JDXG2.38.55.E11.1.454.CMB.1.raw
  modified_base (370)..(370): a, c, t, g, unknown or other
  misc_feature (370)..(370): n is a, c, g, or t
  modified_base (378)..(390): a, c, t, g, unknown or other
  misc_feature (378)..(390): n is a, c, g, or t
tcagtcgatcacgtcacgaccggtgctcgatttagcactcgcacgttgggtttgggggctgttcctggtaccagcagctcccaggaacagcccccaaactcctcatttatgaccataataggcgaccctcagggattcctgaccgattctctggctccaagtctggcacgtcagccaccctgggcatcaccggcctccagactggggacgaggccgattattactgcggaacatgggataccagactgaatgcttgggtgctcggtggagggaccagggctgaccgtcctagggtcagcccaaggctcgccccctggtcactctcgttcccgccctcctcacgtgactcgatgacgcggctggcaaggcncagtagcnnnnnnnnnnnnn

SEQ ID NO: 51236 - DNA, 180 bp, Homo sapiens
  misc_feature: GYAE6OF02G7RQQ.38.55.E11.1.454.CMB.1.raw
  modified_base (174)..(180): a, c, t, g, unknown or other
  misc_feature (174)..(180): n is a, c, g, or t
tcagtcgatcacgtcacgaccggtgctcgatttagcactcgcacgttgggtttgggggaagaggaagactgacggtccccccaggagttcaggtgctgggcacagcggccctgggctgcctggtcaaggactacttccacgtgatcgactgagcgggctggcaaggcgcatagnnnnnnn

SEQ ID NO: 51237 - DNA, 377 bp, Homo sapiens
  misc_feature: GYAE6OF02H7RN4.38.55.E11.1.454.CMB.1.raw
  modified_base (340)..(340): a, c, t, g, unknown or other
  misc_feature (340)..(340): n is a, c, g, or t
  modified_base (371)..(377): a, c, t, g, unknown or other
  misc_feature (371)..(377): n is a, c, g, or t
tcagtcgatcacgtcacgaccggtgctcgatttagcactcgcacgttgggtttgggggctgttcctggtaccagcagctcccaggaacagcccccaaactcctcatttatgaccataataggcgaccctcagggattcctgaccgattctctggctccaagtctggcacgtcagccaccctgggcatcaccggcctccagactgggacgaggccgattattactgcggaacatgggataccagactgaatgcttgggtgctcggtggagggaccaggctgaccgtcctaggtcagcccaaggctgccccctcggtcactctgttcccacctcctcacgtnatcgactgagcggctggcaaggcgcatacgnnnnnnn

SEQ ID NO: 51238 - DNA, 379 bp, Homo sapiens
  misc_feature: GYAE6OF02F5LUU.38.55.E11.1.454.CMB.1.raw
  modified_base (366)..(366): a, c, t, g, unknown or other
  misc_feature (366)..(366): n is a, c, g, or t
  modified_base (372)..(379): a, c, t, g, unknown or other
  misc_feature (372)..(379): n is a, c, g, or t
tcagtcgatcacgtcacgaccggtgctcgatttagcactcgcacgttgggtttgggggctgttcctggtaccagcagctcccaggaacagcccccaaactcctcatttatgaccataataggcgaccctcagggattcctgaccgattctctggctccaagtctggcacgtcagccaccctgggcatcaccggcctccagactggggacgaggccgattattactgcggaacatgggataccagactgaatgcttgggtgctcggtggagggaccaggctgaccgtcctaggtcagcccaaggctgccccctcggtcactctcgtcccaccctcctcacgtgatcgactgagcggctggcaaggcncatagnnnnnnnn

SEQ ID NO: 51239 - DNA, 204 bp, Homo sapiens
  misc_feature: GYAE6OF02HGJ3H.38.55.E11.1.454.CMB.1.raw
  modified_base (173)..(204): a, c, t, g, unknown or other
  misc_feature (173)..(204): n is a, c, g, or t
tcagtcgatcacgtcacgaccggtgctcgatttagcactcgcacgttgggtttggggggaagaggaagactgacggtcccccaggagttcaggtgctgggcacagcggccctgggctgcctggtcaaggctacttccacgtgatcgactgagcgggctggcaaggcgcatagnnnnnnnnnnnnnnnnnnnnnnnnnnnnnnnn

SEQ ID NO: 51240 - DNA, 378 bp, Homo sapiens
  misc_feature: GYAE6OF02GAKRK.38.55.E11.1.454.CMB.1.raw
  modified_base (334)..(334): a, c, t, g, unknown or other
  misc_feature (334)..(334): n is a, c, g, or t
  modified_base (336)..(336): a, c, t, g, unknown or other
  misc_feature (336)..(336): n is a, c, g, or t
  modified_base (371)..(378): a, c, t, g, unknown or other
  misc_feature (371)..(378): n is a, c, g, or t
tcagtcgatcacgtcacgaccggtgctcgatttagcactcgcacgttgggtttgggggctgttcctggtaccagcagctcccaggaacagcccccaaactcctcatttatgaccataataggcgaccctcagggattcctgaccgattctctggctccaagtctggcacgtcagccaccctgggcatcaccggcctccagactggggacgaggccgattattactgcggaacatgggataccagactgaatgcgttgggtgctcggtggagggaccaggctgaccgtctaggtcagcccaaggctgccccctggtcactctcgtcccgcctccncncgtgatcgactgagcggctggcaaggcgacatagnnnnnnnn

SEQ ID NO: 51241 - DNA, 176 bp, Homo sapiens
  misc_feature: GYAE6OF02GDOMV.38.55.E11.1.454.CMB.1.raw
  modified_base (174)..(176): a, c, t, g, unknown or other
  misc_feature (174)..(176): n is a, c, g, or t
tcagtcgatcacgtcacgaccggtgctcgatttagcactcgcacgttgggtttgggggaagaggaagactgacggtccccccaggagttcaggtgctgggcacagcggccctgggctgcctggtcaaggactacttccacgtgatcgactgagcgggctggcaaggcgcatagnnn

SEQ ID NO: 51242 - DNA, 174 bp, Homo sapiens
  misc_feature: GYAE6OF02GZIW1.38.55.E11.1.454.CMB.1.raw
  modified_base (174)..(174): a, c, t, g, unknown or other
  misc_feature (174)..(174): n is a, c, g, or t
tcagtcgatcacgtcacgaccggtgctcgatttagcactcgcacgttgggtttgggggaagaggaagactgacggtccccccaggagttcaggtgctgggcacagcggccctgggctgcctggtcaaggactacttccacgtgatcgactgagcgggctggcaaggcgcatagn

SEQ ID NO: 51243 - DNA, 384 bp, Homo sapiens
  misc_feature: GYAE6OF02HCHZE.38.55.E11.1.454.CMB.1.raw
  modified_base (373)..(373): a, c, t, g, unknown or other
  misc_feature (373)..(373): n is a, c, g, or t
  modified_base (377)..(384): a, c, t, g, unknown or other
  misc_feature (377)..(384): n is a, c, g, or t
tcagtcgatcacgtcacgaccggtgctcgatttagcactcgcacgttgggtttgggggctgttcctggtaccagcagctcccaggaacagcccccaaactcctcatttatgaccataataggcgaccctcagggattcctgaccgattctctggctccaagtctggcacgtcagccaccctgggcatcaccggcctccagactggggacgaggccgattattactgcggaacagtgggataccagactgaatgcgttgggtgcgtcggtggagggaccaggctgaccgtcctaggtcagcccaaggctcgccccgtcgtcactctcgtcccgccctcctcgacgtgactcgactgaggcggctggcaaggcgnatgnnnnnnnn

SEQ ID NO: 51244 - DNA, 207 bp, Homo sapiens
  misc_feature: GYAE6OF02GLP1J.38.55.E11.1.454.CMB.1.raw
  modified_base (175)..(207): a, c, t, g, unknown or other
  misc_feature (175)..(207): n is a, c, g, or t
tcagtcgatcacgtcacgaccggtgctcgatttagcactcgcacgttgggtttggggggaagaggaagactgacggtccccccaggagttcaggtgctgggcacagcggccctgggctgcctggtcaaggctacttccacgtgatcgactgagcgggctggcaagggcgcatagnnnnnnnnnnnnnnnnnnnnnnnnnnnnnnnnn

SEQ ID NO: 51245 - DNA, 514 bp, Homo sapiens
  misc_feature: GYAE6OF02HIV8W.38.55.E11.1.454.CMB.1.raw
  modified_base (269)..(269): a, c, t, g, unknown or other
  misc_feature (269)..(269): n is a, c, g, or t
  modified_base (455)..(456): a, c, t, g, unknown or other
  misc_feature (455)..(456): n is a, c, g, or t
  modified_base (460)..(460): a, c, t, g, unknown or other
  misc_feature (460)..(460): n is a, c, g, or t
  modified_base (464)..(514): a, c, t, g, unknown or other
  misc_feature (464)..(514): n is a, c, g, or t
tcagtcgatcacgtcacgaccggtgctcgatttagcactcgcacgttgggtttgggggctgttcctggtaccagcagctcccaggaacagccccccaaaactcctcattttatgaccataataggcgacccctcagggattcctgaccgattctctggctccaagtctggcacgtcagccaccctgggcatcaccggcctcagactggggacaggccgtattattactgacggaacatgggaatacccgagactgaatcgcgttgggtnctcgggtgggaggaccgaaggctagacccgttaccgtaggtccagccccgaaaggctacccggccccccgtcgggtccaccgttctccggttacccccacccctccttaccgaccggttgactacccgtagtcggacgggccgggtccgtacgggtaccgaaacggggtccgacgtaagttaacgnngacntgcnnnnnnnnnnnnnnnnnnnnnnnnnnnnnnnnnnnnnnnnnnnnnnnnnnn

SEQ ID NO: 51246 - DNA, 444 bp, Homo sapiens
  misc_feature: GYAE6OF02FUTF0.38.55.E11.1.454.CMB.1.raw
  modified_base (428)..(428): a, c, t, g, unknown or other
  misc_feature (428)..(428): n is a, c, g, or t
  modified_base (430)..(444): a, c, t, g, unknown or other
  misc_feature (430)..(444): n is a, c, g, or t
tcagtcgatcacgtcacgaccggtgctcgatttagcactcgcacgttgggtttgggggctgttcctggtaccagcagctcccaggaacagcccccaaactcctcatttatgaccataataggcgaccctcagggattcctgaccgattctctggctccaagtctggcacgtcagccaccctgggcatcaccggcctcagactggggacgaggccgattacttactgacggaacagtgggactaccgagactagaatgcgttgggtcgctgggtggacgggaccaggctacggaccgtcgtaggtccgagccccgaagggcctccggtccccccgtcggtccctaccttcccgttcggttcccccgtccccttcccgtcctaccgttcgaactcgactgggacgcgggctgggacgacggcgcagtagngnnnnnnnnnnnnnnn

SEQ ID NO: 51247 - DNA, 183 bp, Homo sapiens
  misc_feature: GYAE6OF02FNEDO.38.55.E11.1.454.CMB.1.raw
  modified_base (173)..(183): a, c, t, g, unknown or other
  misc_feature (173)..(183): n is a, c, g, or t
tcagtcgatcacgtcacgaccggtgctcgatttagcactcgcacgttgggtttggggggaagaggaagactgacggtcccccaggagttcaggtgctgggcacagcggccctgggctgcctggtcaaggctacttccacgtgatcgactgagcgggctggcaaggcgcatagnnnnnnnnnnn

SEQ ID NO: 51248 - DNA, 522 bp, Homo sapiens
  misc_feature: GYAE6OF01AL3AM.12.82.H05.1.454.CMB.1.raw
  modified_base (184)..(184): a, c, t, g, unknown or other
  misc_feature (184)..(184): n is a, c, g, or t
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
  modified_base (511)..(511): a, c, t, g, unknown or other
  misc_feature (511)..(511): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttanctccaggggaaangccaccctntcctgcagggccagtgagaatgttaacaacaggtatctggcctggtaccagcagaaacctggccaggctcccaggctcctcatgtacgttactccagcagggccatggcatcccagacaggttcactggcagtggtcngggacngacttcactctcaccatcaccagactggagcctagaacgtatttgctagtgtattattgtcagcagtatggtagcgctaccgtactacgttttcggccgtaggggtccaagcgtaggagagtagaaacgaacgtggtaggcgtgccacgatctgttcttcncttccttcccg

SEQ ID NO: 51249 - DNA, 599 bp, Homo sapiens
  misc_feature: GYAE6OF01DFDP3.12.82.H05.1.454.CMB.1.raw
  modified_base (183)..(183): a, c, t, g, unknown or other
  misc_feature (183)..(183): n is a, c, g, or t
  modified_base (194)..(194): a, c, t, g, unknown or other
  misc_feature (194)..(194): n is a, c, g, or t
  modified_base (282)..(282): a, c, t, g, unknown or other
  misc_feature (282)..(282): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtcttanctccagggaanagccaccctctcctgcagggccagtgagaatgttaacaacaggtatctggcctggtaccagcagaacctggccaggctccaggctccnatgtacgttactccagcaggccatggacactcccagacgaggttcacgtggctaggtggtctgggacagtacttcactctacacctatcgaaccagtacctggacgtccgtagaacgtagttttgacgttaggttacgttaagtttagttacgttacgtaagtcgtagttagtggtagccgacgtaacccgttacgttacgttttacggaccggtacggggtacctaacggtaccgtaggtagtaacgtacggaaaacgtacgtacggtaggactcgacgtaccgtagtcgttcgtacttacctctccgttaccccg

SEQ ID NO: 51250 - DNA, 660 bp, Homo sapiens
  misc_feature: GYAE6OF01CN2H3.12.82.H05.1.454.CMB.1.raw
  modified_base (197)..(197): a, c, t, g, unknown or other
  misc_feature (197)..(197): n is a, c, g, or t
  modified_base (294)..(294): a, c, t, g, unknown or other
  misc_feature (294)..(294): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtcttatctccgaggggaaangccaccctctcctgcagggccagtgagaatgttaaacaacaggtatcgtggcctggtaccagcaagaaaccctggccaggcctcccgaggcctcctnatgtacgttactccagcaggccatggcactcccagacaggttcacgtggctaggtcggtctaggggacaggtaccttcactctaccacctataccaaccgtagacctgggaacgtccgttaggaaagttacgtttttagggtaaatttttaacgttacgttagtacctaaacgtacggtacgtaacgtacctaaccgttcgggtacccttaccccgtaacggtttccgggacggggtacgggaacccgtaagggtacggaacgtaactaccgaaaacgtacgttgggcgtacgtcggacctaacccgagttccgttacgttcctttaccgaccgtttcccgttaccccgactagttccgttaacgg

SEQ ID NO: 51251 - DNA, 611 bp, Homo sapiens
  misc_feature: GYAE6OF01DRHNK.12.82.H05.1.454.CMB.1.raw
  modified_base (196)..(196): a, c, t, g, unknown or other
  misc_feature (196)..(196): n is a, c, g, or t
tcagatacgacgtacacgaccggtgctcgatttagtcgagctctctcgcggggagagctgctcagttaggacccagagggaaccatggaaaccccagcgcagcttctcttcctctgctactctggctcccagagaccaccggagaaattgtgttgacgcagtctccaggcaccctgtctttatctccaggggaaangccaccctctcctgcagggccagtgagaatgttaacaacaggtatcgtggcctggtaccagcaagaaacctggccaggctaccgaggctcctcatcgtacgttactccagcgagggccagtggcatcccagacaggttcacgtgggctaggtcgggtctaggggactaggtacctttcgaaccttctacacctatccaaccgaagaccgtggacgccgtagaacgtattttaggactaaggttgtatttagttgtactagtcgtagttagtggtagcgtacaccgttactagtttcggaccgtacgggtaccaacggtctagggaagtagtaacggaaaccgtaacgtcggtaggcgttcggaccgtaaccgtagttccttacggttactttacctccgttcccgttacccccgg

SEQ ID NO: 51252 - DNA, 611 bp, Homo sapiens
  misc_feature: GYAE6OF01CJFAD.12.82.H05.1.454.CMB.1.raw
  modified_base (184)..(184): a, c, t, g, unknown or other
  misc_feature (184)..(184): n is a, c, g, or t
  modified_base (197)..(197): a, c, t, g, unknown or other
  misc_feature (197)..(197): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttanctccaggggaaanagccaccctctcctgcagggccagtgagaatgttaaacaacaggtatctggcctggtaccagcagaaacctggccaggctcccaggcctctcatgtacgttactccagcgaggccatggcactcccaagacaggttcacgtggcaggtggtctgggacagtacttcactctcaccatcagcagtctcgacaaccgtgaagtcttactgtactaactttatactgtacaaacgtagtaacgttaaacctacgttaaccccttccgtaaccgttttaccgggacgggtaacgggtacccgtaagggttacggaacgtataaccgaaacggtacttcgggtaggaccgttacgacccgtaaccttacgttcttacggttccttacctaccgttccctttccccgccgttacttaccg

SEQ ID NO: 51253 - DNA, 540 bp, Homo sapiens
  misc_feature: GYAE6OF01C9O3I.12.82.H05.1.454.CMB.1.raw
  modified_base (196)..(196): a, c, t, g, unknown or other
  misc_feature (196)..(196): n is a, c, g, or t
  modified_base (408)..(408): a, c, t, g, unknown or other
  misc_feature (408)..(408): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtcttatctccaggggaaanagccaccctctcctgcagggccagtgagaatgttaacacaggtatctggcctggtaccagcaagaacctggccaggcctcccgggctcctcatgtacgttcttccagcagggccatcggcactcccagacaggttcacgtggcaggtgggtctgggacagacttcactctcaccatccaccagacctggacgcctagagtatttgactagtnttattattcgtctagtcagtagtggtacgcgcgtaccgtactacgttttcggaccggtagggtaccgaagtcgtaggagtagtagaaaccgtagtggtggctgcacatctattcttatcctccgttcccgtc

SEQ ID NO: 51254 - DNA, 790 bp, Homo sapiens
  misc_feature: GYAE6OF01ASHFB.12.82.H05.1.454.CMB.1.raw
  modified_base (197)..(197): a, c, t, g, unknown or other
  misc_feature (197)..(197): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccgaggggaanagccaccctctcctgcagggccagtgagaatgttaacaacaggtatctggtcctggtaccagcaagaacctggccaggcctccgaggcctcctcatcgtacgttactccagccacgggccacgtcggcactccccgagacctacggttcacgtcgggacgtaggtcgggtcgtaggggaccacggtacctttccgaccttctaccaaccctacgtcccaacccgaacggtaccgtacggggtaactacccgttaaggtaaaccgtttagtttttacggaccgttaagggtttagtttaaacgttttagtttacggttaaccgtacgggtaccgttaaggttacggttacggggttacgtacccggtaaccgttaaaccccgggtttaacgtttaaccgggtttttccggggaacccgggttaacggggggttaccctaaagggtcccgttaaggggtaaaccggtaacgttaaaccgggaaaaccggttacgggttcgggttaaccggtacggttaccggaccctaacccggttactttacccggtttacggttacccttttacccgtacccgtttcccccgtttacccccgg

SEQ ID NO: 51255 - DNA, 844 bp, Homo sapiens
  misc_feature: GYAE6OF01CNYKY.12.82.H05.1.454.CMB.1.raw
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccgaggggaaagagccaccctctcctgcagggccagtgagaatgttaacaacaggtatctggcctggtaccagcaagaaaccgtggccaggcctcccgaggcctcctcatcgtacgttacttccagcgacgggccacgtggaccactcccaagactaggttcacgtgggctagggtcgggtcgtacggggaactaggtaacctttccgaaccttccgtaacccaacccgtaactaccccgaaacccgtaaggtacccgttaggggaaccggtacccgttaacggtaaacggttaacgtttttacgggtaccgttaacggtttaggtttaacgttttaacgttttacgggttaaccgtaacggtaccgttaaggtttaacggtttacggggttaaccgggtcccgggtaaccgttaacccccggtttaaccgttaacccggttttttacccgggggtaccccgggttaaccggggggttaacccgtaacgggtacccggttaacggggtaacggtaaggttaaaccgggtaaaaaccgggtaaaccggtttacggggttaccggggttaccggttaccggtaaccccgtaacccgtaaccgtttacccgtttacggtttacccgtttacccgttaccgtttcccccgtttaccccccgg

SEQ ID NO: 51256 - DNA, 585 bp, Homo sapiens
  misc_feature: GYAE6OF01BMR27.12.82.H05.1.454.CMB.1.raw
  modified_base (196)..(196): a, c, t, g, unknown or other
  misc_feature (196)..(196): n is a, c, g, or t
  modified_base (288)..(288): a, c, t, g, unknown or other
  misc_feature (288)..(288): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaanagccaccctctcctgcagggccagtgagaatgttaacaacaggtatctggcctggtaccagcagaaacctggccaggcctcccaggctcctnatgtacgttactccagcgagggccacgtggcatcccagactggttcacgtggcaggtggtctgggacagacttcactctacacatcaccagacgtggactccgtagaagttattttgactagttagttatttagttgtacagtctaggttagttcgggtagccgtaccgtacccgtaacttaccgtttacgggccgtacgggtaccaaggtcgtaggagagtacggaaacgtagtcggtaggtcgtcgacctaccgtagttccgttacgttaccttaccttcgttcccgttaccccg

SEQ ID NO: 51257 - DNA, 561 bp, Homo sapiens
  misc_feature: GYAE6OF01DXKGH.12.82.H05.1.454.CMB.1.raw
  modified_base (198)..(198): a, c, t, g, unknown or other
  misc_feature (198)..(198): n is a, c, g, or t
  modified_base (508)..(508): a, c, t, g, unknown or other
  misc_feature (508)..(508): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaagngccaccctctcctgcagggccagtgagaatgttaaacaacaggtatctggcctggtaccagcagaacctggccaggctccaggctcctcatgtacgttactccaggtacggccacgtggcatcccagacgaggttcactggctaggtggtctgggacagacttcactctccacatcacagacgtggagctagaagtagtttgctagttgtattagttgtcagactagtataggtagcgtacgtaccgttacgtacgtttggaccgtagggtaccaagtcgtaggagtagtaggaaacgtaacgtggtcgngtacgccacctagttcgttacgttactttacctacttcccgttcccgtacccg

SEQ ID NO: 51258 - DNA, 569 bp, Homo sapiens
  misc_feature: GYAE6OF01DZI1J.12.82.H05.1.454.CMB.1.raw
  modified_base (197)..(197): a, c, t, g, unknown or other
  misc_feature (197)..(197): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaanagccaccctctcctgcagggccagtgagaatgttaacaacaggtatctggcctggtaccagcaagaacctggccaggcctcccgaggctctcatgtacgttacttccagcagggccacgtggcatcccaagacaggttcacgtggcaggtggtctgggacagacttcactctcaccatccaaccagtactggacgtcctaggaacgtattttacgactagtagttaatttagtttgtcagtctagtagtggtagccgcaaccgttactacgtttcgggccgtacgggtccaagcgtaggacgtagtaggaaaccgtagtggtggacgtcgacctactacgttcgttacgttccttcctgttcccttaccccg

SEQ ID NO: 51259 - DNA, 770 bp, Homo sapiens
  misc_feature: GYAE6OF01C8VTK.12.82.H05.1.454.CMB.1.raw
  modified_base (203)..(203): a, c, t, g, unknown or other
  misc_feature (203)..(203): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggcctcccagacgaccaccggaagtaaattgtgttgacgcagtctccaggccacctgttctttatctccgaagggaaancgcccaccctctccgtgcgacgggccagtgaagtaatagttaaacaactaggtatcgtcggccgtacggtaaccagacaaacgtaaacccgtggccgaacggtccctacccgaaggtcctaccctacgtaacgttcggttaaccgtttacctacccgaaggccgaacggggcccaacggttcggacctacctacccgaagaaccgtacggttccaacgttcgggactaggggttacggtcgtacgggaactacggtacttacgtactctaccaccgtatacccaacgtaaggtaccgtaggacgtaccgtaaggtaacgttacgttttagacgttagttagttaatttacgttagtacggtaacgttacgttaacggttaagtacgggtaacgtaccggtaaccgtaacccggttaaccgttaccggttttacgggaccggttaacggggttacccgtaaggtcggtaaggtaacgtaacgtaaacggtaaaacgacggttacggtacgtacgtccggaacctaccgtacgttcttacgttacgttaccttccgtcccttaaccccg

SEQ ID NO: 51260 - DNA, 534 bp, Homo sapiens
  misc_feature: GYAE6OF01BGNYM.12.82.H05.1.454.CMB.1.raw
  modified_base (197)..(197): a, c, t, g, unknown or other
  misc_feature (197)..(197): n is a, c, g, or t
tcagatacgacgtacacgaccggtgctcgatttagtcgagctctctcgcggggagagctgctcagttaggacccagagggaaccatggaaacaccagcgcagcttctcttcctcctgctactctggctcccagagaccaccggagaaattgtgttgacgcagtctccaggcaccctgtctttatctccaggggaaanagccaccctctcctgcagggccagtgagaatgttaacaacaggtatctggcctggtaccagcagaacctggccaggctcccaggctcctcatgtacgttactccagcagggccacgtggcactcccagacaggttcacgtggcaggtgggtctgggacagacttcactctcaccatcaccagactggacgcctagaagtatttgctagttgttattattgtcagtctagtagtggtacgcgtctaccgtactacgtttcggccgtacgggtaccaggcgtaggagagtagaaacgtacgtggtggtctcgacacctatcgtagtcttctcgttcccg

SEQ ID NO: 51261 - DNA, 788 bp, Homo sapiens
  misc_feature: GYAE6OF01CIJML.12.82.H05.1.454.CMB.1.raw
  modified_base (199)..(199): a, c, t, g, unknown or other
  misc_feature (199)..(199): n is a, c, g, or t
  modified_base (290)..(290): a, c, t, g, unknown or other
  misc_feature (290)..(290): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccgaaggggaaanagccaccctctcctgcgagggccagtgagaatgttaaacaacaggtatctggcctggtaccagcagaaacctggccaggctccaggctccncatgtacgttactccagcgaggccacgtggcactcccagacaggttcacgtggctaggttcgggtcgtaggggaactacggtacctttcaaccgttcctacccaaaccctactacccgaaacccgtaagggtaccgttggggaaccgtacccgttaaggtaaacggtttacgttttttacggaccgttaaagggtttaggtttaaacgtttttaacgtttacgggtttaaccgtaacggtacccgttaaagggtttaacggtttacggggttaacggtacccggtaccccgttaaacccgggtttaacccgtttaacccgggttttttaccgggggaccccggttaaccggggggttaccctaaacgggttccggttaacggggaacggttaaacggtacggtaaaaccggtaacgttcgggtacggtaccgttcggaccctaacccgtacgttccgttaccgttacctttacctaaccgtttccccgtttaccccgg

SEQ ID NO: 51262 - DNA, 570 bp, Homo sapiens
  misc_feature: GYAE6OF01AQKI9.12.82.H05.1.454.CMB.1.raw
  modified_base (197)..(197): a, c, t, g, unknown or other
  misc_feature (197)..(197): n is a, c, g, or t
  modified_base (288)..(288): a, c, t, g, unknown or other
  misc_feature (288)..(288): n is a, c, g, or t
  modified_base (553)..(553): a, c, t, g, unknown or other
  misc_feature (553)..(553): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaangccaccctctcctgcagggccagtgagaatgttaacaacaggtatctggcctggtaccagcagaacctggccaggcctcccaggcctcctnatgttaccgttactccagccacgggccacgtggcactcccagacaggttcacgtggctaggtggtctgggacagtacttcactctaccacctatcacgcgacgtcctaggacgcctagaagttagttttgacgttagtttaattacgtgtacagctaggtcgtagcgtaacgtcggtccttcggttactacgtttacggaccgtacgggtaccaggactagggatacgtacgaaacgtacgtggtcggctcgaccactattcgtnttccttcgtcttacccg

SEQ ID NO: 51263 - DNA, 851 bp, Homo sapiens
  misc_feature: GYAE6OF01BHOO2.12.82.H05.1.454.CMB.1.raw
  modified_base (198)..(198): a, c, t, g, unknown or other
  misc_feature (198)..(198): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccgaggggaaanagccaccctctcctgcagggccagtgagaatgttaacaacgaggtatcgtggcctggtaccagcagaactggaccaggcctcccaggcctcctcattgttaccgttacttccgagccgacggggcccacgtggacctacgtaccccgagaaccgtagggtttccaaccgttcgggacgtacggggtcgggttacgtacggggaacctacggtaccctttccgaaacccgttccgttacccaaaccccgtaacttacccgaaaccccgtaacggtaaccgtttacgggggaccgttaccccgttaagggtaaacggtttacgttttttacgggaaccgttaagggttttaagtttaaacgttttacgttttaccgggttacgtaacggtaccgttaagggtttaacggtttacggggttaaccggtacccggtacccgttaaaccccggtttaacgttttaacccgggtttttaccggggaacccgggttaaccggggggttacccctaaagggtacccggttaaggggtaaacggtaacgttaaacgggaaaaccgggttaaccggttggggttacggtaccggttacggaacccgtaaccgttacgttacccgttacgttacctttccctacgtttccccgttaacccccgg

SEQ ID NO: 51264 - DNA, 702 bp, Homo sapiens
  misc_feature: GYAE6OF01ASERF.12.82.H05.1.454.CMB.1.raw
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtcttatctccaggggaaagagccaccctctcctgcgagggccagtgagaatgttaacaacaggtatcgtggcctaggtaccagcagaaacctggaccaggcctacccgaggcctcctcattcgtaccgtttactccgagccgacgggccacgtggaccactcccagacgtaggttcacgtggcctaggtcggtcgtagggacagtaccttcactctaccacctactccaaccgtagtacgtgggactccgtaggtaacgttagttttacggacgtaggtttagtttaagtttagttacggttacgtaggtacgtaaggttacgttagggttacggaccgtaccggtaacccgtttaaccgttaccggttttacggggcccggtaacggggttacccgtaacggtcggttacgggaaggtaacgttacgggtaaaaccggtacggttcggtacggtccgtacggtaccgtaacccgtacgttcccgttacgtttacccgttaccttaccgtttccccgttaccccg

SEQ ID NO: 51265 - DNA, 650 bp, Homo sapiens
  misc_feature: GYAE6OF01DL0W7.12.82.H05.1.454.CMB.1.raw
  modified_base (197)..(197): a, c, t, g, unknown or other
  misc_feature (197)..(197): n is a, c, g, or t
  modified_base (238)..(238): a, c, t, g, unknown or other
  misc_feature (238)..(238): n is a, c, g, or t
  modified_base (256)..(256): a, c, t, g, unknown or other
  misc_feature (256)..(256): n is a, c, g, or t
  modified_base (283)..(283): a, c, t, g, unknown or other
  misc_feature (283)..(283): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctccagagaccaccggagaaattgtgttgacgcagtctccaggcaccctgtctttatctccgaaggggaanagcccaccctctcctgcagggccagtgagaatgtaacaacnggtatctggcctggaccngcagaacctggccaggcctccagctcncatgtacgttactccagcgacgggccacgtggcactcccaagacaggttcacgtggcaggttcgggtctaggggacacggtacctttcaaccttcctaccaaccgtatcccaaccgtagtacgtgggacgaccgttaggtaaagttattttacggacgtaggttagttaatttacgtttgtacgtagtacgtaaggttagttacgggtacgtccgtaccgtaacccgttaacgttacggttttcgggaccggtaacggggttacccgaaggtcggtaggaacgtaagtaacggaaacggtacgtggtacggcttcggaccgtacctacgttcgttacgttaccgtttactacgttcccgttaccccg

SEQ ID NO: 51266 - DNA, 549 bp, Homo sapiens
  misc_feature: GYAE6OF01B78GO.12.82.H05.1.454.CMB.1.raw
  modified_base (197)..(197): a, c, t, g, unknown or other
  misc_feature (197)..(197): n is a, c, g, or t
  modified_base (387)..(387): a, c, t, g, unknown or other
  misc_feature (387)..(387): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaangcccaccctctcctgcagggccagtgagaatgttaacaacaggtatcgtggcctggtaccagcagaaacctggccaggctcccaggctcctcatgtacgttactccagcgaggccacgtggcatcccagacaggttcacgtggcaggtggtcgtgggacagtactcactctcacatcacgagactggacncctagaagtatttgactagttgtattagttgtacagtactagtagtggtagcgacgtaaccgtactacgtttcggaccgtacgggtaccaaggtcgtaggacgtagtacggaaacgtacgtgtaggacgtcgaccactcgtctacgtcttctctccgtcccg

SEQ ID NO: 51267 - DNA, 648 bp, Homo sapiens
  misc_feature: GYAE6OF01BFJVF.12.82.H05.1.454.CMB.1.raw
  modified_base (182)..(182): a, c, t, g, unknown or other
  misc_feature (182)..(182): n is a, c, g, or t
  modified_base (195)..(195): a, c, t, g, unknown or other
  misc_feature (195)..(195): n is a, c, g, or t
  modified_base (296)..(296): a, c, t, g, unknown or other
  misc_feature (296)..(296): n is a, c, g, or t
tcagatacgacgtacacgaccggtgctcgatttagtcgagctctctcgcgggagagctgctcagttaggacccagagggaaccatggaaaccccagcgcagcttctcttcctcctgctactctggctcccagagaccaccggagaattgtgttgacgcagtctccaggcaccctgtctttanctccgagggaaangccacctctcctgcagggccagtgagaatgttaacaacgtaggtatcgtggccttgggtaaccagcagaaaccgtggaccaggctcccaggcctcccgtanattcggtacgtttactccgagtccagggccacgtggaccactccccgaagaccgtacggttccaacgtgggactagggtcgggtctaggggacagtccttcgacttcgtaccacctagtccaccgagtaccgtggacgtctaggtaacgttagttttcgacgttagttttacgttacgtgtaccgtagaccgtagtacgtaacgcgtaacgtcggttccgttacggtttaccgtacggttttacgggacccgtagggtaccaaggtccgttaggacgtagtaccgaaacggtaacgtcggtagtacgtcgaccgtactacgttcgtacgttcttactagttcccgtaccccg

SEQ ID NO: 51268 - DNA, 707 bp, Homo sapiens
  misc_feature: GYAE6OF01BSQYH.12.82.H05.1.454.CMB.1.raw
  modified_base (198)..(198): a, c, t, g, unknown or other
  misc_feature (198)..(198): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccgaggggaaangccaccctctcctgcagggccagtgagaatgttaaacaacgaggtactcgtggcctggtaccagccaagaaacctggccaggcctcccgaggcctcctcatcgtacgttactcagcagggccacgtgccatcccgagactggttcacgtggctaggtcgggtcgtagggacacgtactttccacgttctaccgaacctactccaaccgaagtaccgttgggacgtcccgttaggtaacgttagttttcgacttaaggttacgttaatttagtttacgtacgtaggtacgttaagttaacggttgggtaacgtccgaccgttaacccgttaaccggttaccgttttaccggggacccggtaacgggggttacccaacgggttacggtacgggaacgtaaacggtacgggaaaaaccggttacgttacgggttaccggtacgttcggacccgtaacccgttacgttccgttacgtttacctttaccgtaccgtttccccgtttacccccgg

SEQ ID NO: 51269 - DNA, 705 bp, Homo sapiens
  misc_feature: GYAE6OF01BKKMF.12.82.H05.1.454.CMB.1.raw
  modified_base (199)..(199): a, c, t, g, unknown or other
  misc_feature (199)..(199): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccgaaggggaaancgcccaccctctcctgcgagggccagtgagaatagttaacaacgaggtatcgtggcctggtaccagcaagaaacctggaccaggcctcccgaggcctcctcatcgttacgttacttccagcgagggcccacgtggacactcccagactaggttcacgtggctaggtcggtcgtaggggactacggtactttcaccgttctaccaaccacgttacccaaccgaggtaccgttagggaacgtacccgttaaggtaaacggttagtttttacggacgtaaggtttagtttaattttagtttacggtacctaggtacgttaaggttacggttagggttacgccggtaaccgtaacccgtttaacgttaccggttttacgggacccggttacggggttacccaaggtcgtaaggagtaacgtaacggtaaaaccggtacgttcggtacggtacgtcggaccctaacgtacttccgttacgttacctttaccgtaccgtttcccgtaccccg

SEQ ID NO: 51270 - DNA, 603 bp, Homo sapiens
  misc_feature: GYAE6OF01CEE3W.12.82.H05.1.454.CMB.1.raw
  modified_base (198)..(198): a, c, t, g, unknown or other
  misc_feature (198)..(198): n is a, c, g, or t
  modified_base (236)..(236): a, c, t, g, unknown or other
  misc_feature (236)..(236): n is a, c, g, or t
  modified_base (291)..(291): a, c, t, g, unknown or other
  misc_feature (291)..(291): n is a, c, g, or t
  modified_base (375)..(375): a, c, t, g, unknown or other
  misc_feature (375)..(375): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccgaggggaaancgccaccctctcctgcagggccagtgagaatgtaacanaggtatctggcctggtaccagcaagaaacctggccaggcctcccgaggcctcctnatgtacgttactcagcaggccatggcatcccagactaggttcacgtggctaggtggtctgggacagtacttcactctacacctntccaccgagactggacgtcctaggtaacgttagttttcggactaaggttacgttaatttagttcgtacagtcgtaagttagtggtacgaccgtcctaaccgttacgttacgtttcgggaccgtacgggtaccaaggtcgtagggaacgtagtaacgaaacggtacgtcggtacggctggacccaaccgttagttcccgttagttaccttactcgttcccgttaccccg

SEQ ID NO: 51271 - DNA, 544 bp, Homo sapiens
  misc_feature: GYAE6OF01ER1K9.12.82.H05.1.454.CMB.1.raw
  modified_base (534)..(534): a, c, t, g, unknown or other
  misc_feature (534)..(534): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaagagccaccctctcctgcagggccagtgagaatgttaacaacaggtatctggcctggtaccagcagaacctgccaggctccaggctcctcatgtacgttacttccagcagggccacgtggcactcccagacaggttcacgtggcaggtcgggtctggggactagacttcactctcaccatcaccagacctgggacgcctgaagtattttgctagttgttaattattagtctagctagtatggtagccgctacccgtactacgtttggccgaggggttccaaggtcgtggagtagtacgaaacgtacgtggtaggctgactaccagtcttcgtacttctntccgttcccg

SEQ ID NO: 51272 - DNA, 696 bp, Homo sapiens
  misc_feature: GYAE6OF01CTM53.12.82.H05.1.454.CMB.1.raw
  modified_base (197)..(197): a, c, t, g, unknown or other
  misc_feature (197)..(197): n is a, c, g, or t
  modified_base (208)..(208): a, c, t, g, unknown or other
  misc_feature (208)..(208): n is a, c, g, or t
tcagatacgacgtacacgaccggtgctcgatttagtcgagctctctcgcggggagagctgctcagttaggacccagagggaccatggaaaccccagcgcagcttctcttcctcctgctactctggctcccagagaccaccggagaaattgtgttgacgcagtctccaggcaccctgtctttatctccgaggggaaanagcccaccctntcctgcagggccagtgagatgttaacacaggtatctggcctggtaccagcagaaaccctggcccaggcctcccgaggcctcctcatgtaccgttacttccagtcagggccacgtggccatcccagacgtggttccacgtggcaggttcgggtctggggacagtccttcgactctacacctagtccaccgagacgttgggacgtcccgtggtaacgttagtttttcgacgttacggttagtttaacgtttatttgttaccgtaagtaccgtaagttagttagggtacgacccggtactaaccccgttacgttaaccggtttttcgggacccggttacgggggttaaccctaacgggtccggttagggtaacggtacggtaacggtaaaaccgttacggttacggtcgggttaccggtacggaccctacccggtactttacccgttaccggtttccctttccgtaaccgttttccccgtttaccccccgg

SEQ ID NO: 51273 - DNA, 711 bp, Homo sapiens
  misc_feature: GYAE6OF01BKKFG.12.82.H05.1.454.CMB.1.raw
  modified_base (198)..(198): a, c, t, g, unknown or other
  misc_feature (198)..(198): n is a, c, g, or t
  modified_base (444)..(444): a, c, t, g, unknown or other
  misc_feature (444)..(444): n is a, c, g, or t
  modified_base (472)..(472): a, c, t, g, unknown or other
  misc_feature (472)..(472): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccgaggggaaancgcccaccctctcctgaccgagggccagtgaagaattagttaaacaacgtaggtatcgtcggccgttaggtacccagacaacgaaaccgtggaccacggtcctacccgaggtccttccctagattacggttaaccgttaccttccgaggccgaacggggcccaacgtggacctacgtcccaaggtactacggtttcacgtggcgtaggtcgggtacgtgggactaggtacgtcactctacaacctntacagcacgctgctagtctagtaagttntttacgagtttaagtttacttacgtagtactagtactagttaaagttaacgttaaccgtttcggttaaccttcggtacccgtttacggttacccgggtttaccggggggacggggtaaccgtaaggggtacgaaggtaccgtaaaccgtaaaccgggtacgttcgggtcggtaaccgttggaccccttaacgtactttaccgtcgtttaccttacccgttacgttccccgtttaacccg

SEQ ID NO: 51274 - DNA, 579 bp, Homo sapiens
  misc_feature: GYAE6OF01EKLBO.12.82.H05.1.454.CMB.1.raw
  modified_base (197)..(197): a, c, t, g, unknown or other
  misc_feature (197)..(197): n is a, c, g, or t
  modified_base (266)..(266): a, c, t, g, unknown or other
  misc_feature (266)..(266): n is a, c, g, or t
  modified_base (288)..(288): a, c, t, g, unknown or other
  misc_feature (288)..(288): n is a, c, g, or t
  modified_base (372)..(372): a, c, t, g, unknown or other
  misc_feature (372)..(372): n is a, c, g, or t
  modified_base (562)..(562): a, c, t, g, unknown or other
  misc_feature (562)..(562): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaanagccaccctctcctgcagggccagtgagaatgtaacaacgaggtatctggcctggtaccagcagaaccnggccaggctcccaggcctcctnatgtacgttactccaggcagggccacgtgcactccagactgtcacgtggcaggttggtctagggacagtacttcactctacacntccacagtacctgagcctagaagtattttcgctagtgttattattgtcgagtacgtagtagtaggtacgcgtacaccgttactacgtttcgggtaccggtacggggtacctaacggtacgtaggacgtaagtaacggaaacgtacgtggtacggtcgtacgtaccaccgtaacgttcttacgttaccttntaccgttcgttaccccg

SEQ ID NO: 51275 - DNA, 647 bp, Homo sapiens
  misc_feature: GYAE6OF01AZC8C.12.82.H05.1.454.CMB.1.raw
  modified_base (159)..(159): a, c, t, g, unknown or other
  misc_feature (159)..(159): n is a, c, g, or t
  modified_base (185)..(185): a, c, t, g, unknown or other
  misc_feature (185)..(185): n is a, c, g, or t
  modified_base (198)..(198): a, c, t, g, unknown or other
  misc_feature (198)..(198): n is a, c, g, or t
  modified_base (238)..(238): a, c, t, g, unknown or other
  misc_feature (238)..(238): n is a, c, g, or t
tcagatacgacgtacacgaccggtgctcgatttagtcgagctctctcgcgggagagctgctcagttaggacccagagggaaccatggaaaccccagcgcagcttctcttcctcctgctactctggctcccagagaccaccggagaaattgtgttgacgnagttctccaggccaccctgtctttanctccgaggggaancgccaccctctcctgcaggccagtgagaatgttaacaagnggttatcgtggcctggtaccagcagaacctggccaggcctcccaggcctcctgatgtactttctccgagcagggccacgtggcacgtccccagacctaggttcacgttcggctaggtcggtcgtcggggaacacgtacctttcaccgttccaccgtaccatacccaccgacgtacgtacggacgtccgtagtaagtacgttttagactaaggttagttaagtttattacgtcgtacgtacgtaggtagtacggtagtaccggtaccgtaaccgttacgttacgtttacgggtaccgtacgggtacccgtaaggtcgtagggtacgtaagtacggaaacgtacgttacggtcggtacgtcgtaccaccgtcgttaccgttcgttaccttacgtaccgttccgttaccccg

SEQ ID NO: 51276 - DNA, 549 bp, Homo sapiens
  misc_feature: GYAE6OF01BT95H.12.82.H05.1.454.CMB.1.raw
  modified_base (198)..(198): a, c, t, g, unknown or other
  misc_feature (198)..(198): n is a, c, g, or t
  modified_base (308)..(308): a, c, t, g, unknown or other
  misc_feature (308)..(308): n is a, c, g, or t
  modified_base (313)..(313): a, c, t, g, unknown or other
  misc_feature (313)..(313): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggccaccctgtctttatctccaggggaaangccaccctctcctgcagggccagtgagaatgttaaacaacaggtatctgtcctggtaccagcaagaacctggccaggctcccaggctctcatgtacgtctcagcaggccngtgcnctcccagacgaggttcacgtggctaggtcgggtcgtgggacaggtaccttcactctaccaccatccaccacgactggacgccgtagaagtagtttgactagttagttatttagttgtactagacgtagtagtcgtagcgactacgtactacgtttggaccgtaggtaccgagtgtaggagtagtagaaacgtacgtggtcgctcgctacgatctacgttcttactcgttcctcccg

SEQ ID NO: 51277 - DNA, 738 bp, Homo sapiens
  misc_feature: GYAE6OF01D1AQU.12.82.H05.1.454.CMB.1.raw
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccgaggccaccctgttctttatctaccgaagggaagacgcccaccctctcctgcgagggccagtgaagtaatagttaaacaacgtaggtatcgtggcctaggtaccagacaacgaaaccgtcggaccgacggtccctacccgaggtcctacctacagttacgttaccgtttacctccgaggtccgacgggtccacgtcggacctaccgtaccaagtacgtacggttaccacgtggacgtaggtcgggtacgtacgggaactacgtaccttactacgtcctacgacctacgtacccaaccggtagtaacggtcgggtaaccgtacccgttaaggttaaacgtttcgttttacggaactttagggttaacgtttaagtttacgttacggtacgtaacggtacgtaaggttaggttacggtacgtaccgtacgtaaccgttacgttacggttcgggaccggtacgggtaccaaggtcgtaacggaagtacgtaaacggaaaccgttacggtggtagtaccgtcgacctaaccgttacgttccggttacttccttaccgtccgttcccgttaccccg

SEQ ID NO: 51278 - DNA, 750 bp, Homo sapiens
  misc_feature: GYAE6OF01DN9SK.12.82.H05.1.454.CMB.1.raw
  modified_base (102)..(102): a, c, t, g, unknown or other
  misc_feature (102)..(102): n is a, c, g, or t
  modified_base (146)..(146): a, c, t, g, unknown or other
  misc_feature (146)..(146): n is a, c, g, or t
  modified_base (200)..(200): a, c, t, g, unknown or other
  misc_feature (200)..(200): n is a, c, g, or t
  modified_base (476)..(476): a, c, t, g, unknown or other
  misc_feature (476)..(476): n is a, c, g, or t
tcagatacgacgtacacgaccggtgctcgatttagtcgagctctctcgcggggagagctgctcagttaggacccagagggaaccatggaaaccccagcgcancttctcttcctcctgctactctggctcccagacgaccaccgganaaattgtgttgacgcagtctccaggccacctgttcttatctccgaaggggaaancgccctaccctctcctgcgagggccagtgaagtaatagtaaacaactaggtatctggtcctcggaccaggactaacgaaaccctggacccgaggccttacccgacgggtccttcccgtcctagttacggtttaaccgtttacccttaccgaaggccgacggggaccccttaacgtcgggaccctaaacttcccccgaaaggtaccttacggggttacccaacggttgggactaacggggttcgggttaccggaggggtaacacggttaactttacnccctacgtacctaacctcgtaccgaacctaggtaccgttacgggacaccgttaggaacgtttacttttggaaccgttaagttaggttaatttagtttcggtacctaagtccgtaaggtttacgtaggttaccgtactaccgttaaccgttactttaccgggtttacgggtaccggtaaccgggttaaccaacggtgtaagggaacgtaaagtacggaaaacgtacgtggacgtcgtcaccgtacacgttccttgttactccacttccgtacccc

SEQ ID NO: 51279 - DNA, 536 bp, Homo sapiens
  misc_feature: GYAE6OF01D1F5L.12.82.H05.1.454.CMB.1.raw
  modified_base (197)..(197): a, c, t, g, unknown or other
  misc_feature (197)..(197): n is a, c, g, or t
  modified_base (527)..(527): a, c, t, g, unknown or other
  misc_feature (527)..(527): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaanagccaccctctcctgcagggccagtgagaatgttaacaacaggtatctggcctggtaccagcaagaaacctggccaggcctcccaggctcctcatgtacgttactccagcagggccatggcatcccagacaggttcacgtggcaggtggtctgggacagacttcactctcacatcacagactggacgcctagaagtatttgactagtagttaattattgtacagtctagtagtggtagcgactaccgtaactacgtttcggaccgtaggggtccaaggtcgtaggagtagtagaaacgtagtgtaggctgaccactatctagttcttctntcctacccg

SEQ ID NO: 51280 - DNA, 620 bp, Homo sapiens
  misc_feature: GYAE6OF01EPK3Q.12.82.H05.1.454.CMB.1.raw
  modified_base (198)..(198): a, c, t, g, unknown or other
  misc_feature (198)..(198): n is a, c, g, or t
  modified_base (429)..(429): a, c, t, g, unknown or other
  misc_feature (429)..(429): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagacgaccaccggagaattgtgttgacgcagtctccaggcaccctgtctttatctccgaggggaaanacgcccaccctctcctgcagggccagtgagaatgtaacaagaggtatcgtggcctaggtaccagcaacgaaccgtggaccacggcctcccgaggtcctcctacattcgttaccgtttacctccaggcgacgggcccagtcggctactcccgagactaggttcacgtggacgtaggtcggtcaggacacgtcttcactctacacatccacagactggacgtcctagaagttntttagacgtagttagttaatttagttagtactagtcgtagtagtaggtacgaccgtaccgtacgttacttacggtttcggaccggtagggtaccaggtacgtagggtaactacgtaacggaaacgtacggtcggtacggtactcgacctacgacttcgttacgttaccctttctaccgttcccgtaccccg

SEQ ID NO: 51281 - DNA, 797 bp, Homo sapiens
  misc_feature: GYAE6OF01BGNJ1.12.82.H05.1.454.CMB.1.raw
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccgaggggaaagagcccaccctctcctgcagggccagtgagaatgttaacaacaggtactcgtggcctggtaccagcaagaacctggccaggcctccgaggtcctcctcagttgttaccgtttactccgaggccgacggggccctacgtcgggacctaccgtaccccgaaggtaaccgtacgggttccaaccggtgggtaccgtaggggttgggttaccgtagggggaacctacggttaacctttcccgaaccttcctacccaaccctacttacccaaaccggtacgtaccgtacgggacggtaccgttaaggtaacggtttacgtttttacggacgttaaggtttacgtttaagttttaacgtttcggttacgtaacggtacgttaacgttaagtttacgggttaacggaccgtaccgtaaccggtttaaccgtttaccggtttttaccggggaacccgggttaacgggggttaaccccgaaggttaccgggttagggtaaggtaacgttaaaccgggaaaacggttacggttacgggtagggaccgttcgaaccgtaccttacgttaccttacggtttaccttaccttaccgttccccgttaaccccgg

SEQ ID NO: 51282 - DNA, 648 bp, Homo sapiens
  misc_feature: GYAE6OF01DXH57.12.82.H05.1.454.CMB.1.raw
  modified_base (200)..(200): a, c, t, g, unknown or other
  misc_feature (200)..(200): n is a, c, g, or t
  modified_base (422)..(422): a, c, t, g, unknown or other
  misc_feature (422)..(422): n is a, c, g, or t
tcagatacgacgtacacgaccggtgctcgatttagtcgagctctctcgcgggggagagctgctcagttaggacccagagggaaccatggaaaccccagcgcagcttctcttcctcctgctactctggctcccagagaccaccggagaaattgtgttgacgcagtctccaggcaccctgtctttatctccgaaggggaaanagcccaccctctcctgcacgggccagtgaagaatgtaacaacaggtatctggcctggtaccagacaagaaacctggccaaggcctacccgaggctcctcatcgtacgttactcagcgacggccagtggcactccagactggttcacgtgcagtggcgtgggactagacttcaccgtctacacctatccgaacacggtaccgtggaccgtacctagaacgttntttacgacgttaagtagttattagttcgtacgtaggtctaagttagtacgggttaacgtccgtaccgtaacccgttaccggttaaccggttttaccggggacccggttacggggtacccgtaaggtccggtagggtaaacgacgtaacggtaaacgtacgtaggtaggacgtgcccgtaaccgtactttcgttaacgttctttaacctaccgtttcccgtaccccg

SEQ ID NO: 51283 - DNA, 835 bp, Homo sapiens
  misc_feature: GYAE6OF01D9BFG.12.82.H05.1.454.CMB.1.raw
  modified_base (203)..(203): a, c, t, g, unknown or other
  misc_feature (203)..(203): n is a, c, g, or t
  modified_base (438)..(438): a, c, t, g, unknown or other
  misc_feature (438)..(438): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctccagacgaccaccggagaaattgtgttgacgcagtcctccaggccacccttgttctttatctaccgaaggggaancgcccaccctctccgtgacgacggccagtagaagtaattacgttaaacaacgtaggtactcgtcggtacccgtaggaacctacgacaaacggtaaacccgtggacccgtagcccgtacccgaggtcctccctagtacgttcgttaaccgtttacctaccgaacggccggtacggggtaccccacggttccgaccgtaaccgtaccccggaagtacggtacggttacctaccgggnggtacctaggggttcgtacggacgggaactacgttacccgttacaccgttccgaccctaaacctccgtaaccgtaaccgtaacgggtaccgtacggtaaccgtacggttaaccggttaaaggtttccgtttaacggtcggttaacggtttaacggtttaacgtttaacggtttacgtaacggtacggtaacgtttagggtttacgtttaccgggtacgtacccggttaccggtaacccggtttaacccgttacgggtttacccgggaacccgggttaccggggtaccgtaaccggtagggtacggtaacggtaaaggttaccggaaaacggttcgtcggtacggtactacggacctaacgtacgttcgttacttaccctgttcccgttacccgtccg

SEQ ID NO: 51284 - DNA, 792 bp, Homo sapiens
  misc_feature: GYAE6OF01AL3E5.12.82.H05.1.454.CMB.1.raw
  modified_base (195)..(195): a, c, t, g, unknown or other
  misc_feature (195)..(195): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccacggagaattgtgttgacgcagtctcaggcaccctgtctttatctccgaggggaaancgcccacccgtctcctgcagggccagtcgagaactgttaaaccaagtaggtatcgtggtccgtaggtaccagccaagtaaacccgtggccgtaggcctcccgaggccttaccgtacgaattcggtaacgtttccttaccgtacgccgaggggtccctacggtcgggaccctacttaccccgaggtaccgtagggttaaccctacggttcgggacttaggggttaccggggtacgtcggggggaactacggttaaaccgtttccgtaacgtttaccctaccgtacccgtaaccttacccggaaaccgttacgggaaccgtttacgggacgtcccgttaaagtaacggttacgttttaggaacctacggtttagttaacgttttaacggtagtacccgtaggtacgtaagttacggttacggttaacggtccgtaccggtaacccgttaaccgttaccggttttcgggtaaccggtacggggttaccctaaggtccgtaaggtacgtacgtaacggtaaaccgtaggtcggtacggactcggtaaccgtacccgttacgtaccgttacgttacttaccgttacccgttcgttaccccgg

SEQ ID NO: 51285 - DNA, 753 bp, Homo sapiens
  misc_feature: GYAE6OF01BUKBE.12.82.H05.1.454.CMB.1.raw
  modified_base (710)..(710): a, c, t, g, unknown or other
  misc_feature (710)..(710): n is a, c, g, or t
  modified_base (729)..(729): a, c, t, g, unknown or other
  misc_feature (729)..(729): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagacgaccacggagtaattgtagttgacgcagtctccaggccacctgttcttatcctacgaagggaaacacgcccacctctcctgcgaggccagtgaagtaattagtaaacaacgaggtactcgtggccgttacggaaccagacgaacggtaaaccgtcggcccggtcctacccgacggtcctcctacgtacgttacggtttaaccttaccgttaccgacggaccgacgggtcctacgttcggacctaccgtcccgaaggaccgtacggttcaacggtggtacgtacggttcggggtacgtacggggaacctacggttacctttacccgacttaccgtaaccgaaccctactaacccgaacgtacggtaacgtacgggtaaccgtccgtaaaggttaacgtttagttcggtaaaccgtttagggtttaatttacgtttaagttcggttacgaaggttacgtaaggttacggttacgggacgtacgtaaccgttaaccgttacgttaccgggtttccggaaccgggtaccgggttacacgggtgttaacggagttacgaaacgtaaccggatggtcgacncgtacgtcctagttccgtntttcctacgtacctccgtcctacg

SEQ ID NO: 51286 - DNA, 796 bp, Homo sapiens
  misc_feature: GYAE6OF01B5D0X.12.82.H05.1.454.CMB.1.raw
tcagatacgacgtacacgaccggtgctcgatttagtcgagctctctcgcggggagagctgctcagttaggacccagagggaaccatggaaaccccagcgcagcttctcttcctcctgctactctggctcccagacgaccaccggagaaattgtgttgacgcagtctccaggcacctgtctttatctccgagggaagacgccaccctctcctgcgacggccagtgagaatagttaacaactaggtatcgtcggccgtggtaccagacaacgaaaccgtggaccacggcctacccgaggtcctcctactacgttcgttaaccgtttacttaccgacggaccgacggggtaccccaacggttcgggacctacgtaccccgaaggtacccgtacgggtttaccaaccggtcgggtacctaggggttcgggtcgtacggggtaacctacggttacctttacccgaccttacctaccgaaccctacgtaccaaaccgtaggtacgtacgggacgtacccgtaggtaacgtttacgtttaggtaccgttaaggttacgtttaatttggttacgtacgtacgtacgttaagttacggttacgggtacgtaccggtacgtaacccggttacgtttacccgtttcggggtacccggttaacggggttacccgtaaacggtccggttaacggggtaacgtaacgttaaaccggtaaacggttacggtcgggttaccggtacgttacgaacccgtaacgtacgtttcccggttacttaccgtttacccttaccgttccccgttacccg

SEQ ID NO: 51287 - DNA, 781 bp, Homo sapiens
  misc_feature: GYAE6OF01DC1M4.12.82.H05.1.454.CMB.1.raw
  modified_base (320)..(320): a, c, t, g, unknown or other
  misc_feature (320)..(320): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtcctccaggccaccctgtctgtgtcctccgaggggaaagcgcccaccctctcctgcacgggccagtcagtagtagttaatagcgacttagccgtaggtaccagacagactacccgtggccaggcctcccgaggtcctccctacatcctagtcgggtcnctactcctacccgacggcctacgtggtacctcccgagcccgtaggttcgaggtcggtcgagggttcgggtacgtgggaactaggttacgttccgtacctcctacctaaccgataccgacggacccgtacgtcccgtagacctacgggtacttaggtaaccgtttagttttacggacgttttaagtttttacgtttaacgttcgtacgtaacgttaacgttaagtttaacttaaacgtttaccgtttcggtttacccttacggttacccgtttaccgggtttaaccggggtttccccggggggaaccggggggttaacccgttaaagggggtcgggtaaaacggttaaccggtttaaacccggaaaacccgggtttaggttacgggttcgggtaccccttacgggtaccccttaaccggttaccgtttccgggtttaccttcccgtttacggttaacccccg

SEQ ID NO: 51288 - DNA, 989 bp, Homo sapiens
  misc_feature: GYAE6OF01ASBZR.12.82.H05.1.454.CMB.1.raw
tcagatacgacgtacacgaccggtgctcgatttagtcgagctctctcgcggggagagctgctcagttaggacccagagggaaccatcggaaaccccagcgcagcttctcttcctcctgcctactctggctcccagacgaccaccggagtaattgtagttcgacgctacgttctccgacggcctacccttgttccttttatccgtaccggaagggggaaacgaccgccctacccttccgtccgtcggaccgacgggtccctaggttacgaagtaaagttaacgttaaaaccaacgtaaggttacttacgtcggtaccgttacggtaaccagaaccgaacggtaaacccgtcggaccgacgggtccctacccgacggtccttcctacgtacgtttacggttaaccgtttccttaccggacggaccggtaccgggtacctacgttccggaccacccgtaccccgtaaacggaccggttaaccgggtcctaccggttcgggtaaccggttcgggggttaccggggttaccgtaacggggtaacccgtaaccggttaaccgtttacccgtaaccgtccctaaccccgtaaccctaaccgtaaccccgtaaccgaaccgggttaccggtaaccggggtaccggttaccgtaaacgggtttaacgtttacggttttacgtaaccggtttaaggttttaagttttacgtttttacggttacgggtaccgtaacgttacgggtttaacgggtttacggtttaacgggtttaccggaccggtttacccgtttaacccggtttaccggttttaccgggttaaccggggtaccggggtaaccggggttaacccgtagggttacccggtagggttaacggtaaccgtaaacgggtaaaaccggttcggttacgggtaaccggttcggtaaccgtaccgtaaacccggttcgtttaaccgtttccggttaacctttcccgttcccgttttccccgtaacccgg

SEQ ID NO: 51289 - DNA, 704 bp, Homo sapiens
  misc_feature: GYAE6OF01BI4HI.12.82.H05.1.454.CMB.1.raw
  modified_base (198)..(198): a, c, t, g, unknown or other
  misc_feature (198)..(198): n is a, c, g, or t
tcagatacgacgtacacgaccggtgctcgatttagtcgagctctctcgcggggagagctgctcagttaggacccagagggaaccatggaaacccccagcgcagcttctcttcctcctgctactctggctcccagagaccaccggagaaattgtgttgacgcagtctccaggcaccctgtctttatctccgagggaaangccaccctctcctgcagggccagtgagaatgttaacaacgaggtatcgtggcctggtaccagacacgaaaccgtggccaggcctcccgaggtcctcctcagttcgtacgttactccgagcgacgggccacgtcggacctactcccgaagaccgtagggttcacgttggacgtagggtcgggtcgtaggggacaacggtacctttcgaaccttccgtacctaacccacttacccaacccgaacgtaaccggttacgggaacgtcccgttaaggtaaagttacttttcggaccgtagtttagttaactttacgttgtacaggtacgtaggttacgtagggtacgtccgacgttaaccgttacttacggtttcgggaccggtacggggtaccctaaggtcgtagggaacgtaacgtacgggtaaaaccgtacggtcggtaggtaccgtacgacccgtaacgttaccgttacgttcggttaccttaccgttaccgttcccgttacccccg

SEQ ID NO: 51290 - DNA, 899 bp, Homo sapiens
  misc_feature: GYAE6OF01EJZBG.12.82.H05.1.454.CMB.1.raw
tcagatacgacgtacacgaccggtgctcgatttagtcgagctctctcgcgggggagagctgctcagttaggacccagagggaaccatggaaaccccagcgcagcttctcttcctcctgctactctggcctccagacgaccgacggagtaattgtgttgacgcgtagtctccgaggccaccttgttctttatcctaccggaaggggaaagacgccctaccctctccgtgacgacggaccgagtagaagtaacttagtaaccaagtaggtactcgtcggccgtacggtaccagacgaacggtaaccgtcggaccgtacggcccctacccgacggtccttacctacgacgtttacggttacccgtttacctaccgacggaccgggtaccggggaccctaccgggtcggacctaaccgtaccccgaaacggtacgttacgggtaccctacggtacggtacgtaggggtcgggttacgacgggtaactaacgttccgtttaccaaccgttcctaaccctaaccgtacttaacccgaaaccgacggttaccgggtaacggtcgtaacccgttaaggtaacgttttctttacggacggtttaagtttacgtttaatttacggttacgtaacgtacggttagttaaacgggttagttacgggtaacccgtaccggtaacccgtttaaacccggttaaccgggtttttacggttaaccccggggacccggggtttaaaccgggaacccgttaacgggttcgggttaaaggggtaacttaaaccggggtaaacgggtaaacccggttaggttacggggttacccggtaacggttccggaaccccgtaaacttccgggttttacccttacgtttacccgtttacccttacccgtttaacccggttccccc

SEQ ID NO: 51291 - DNA, 941 bp, Homo sapiens
  misc_feature: GYAE6OF01BUWP8.12.82.H05.1.454.CMB.1.raw
  modified_base (96)..(96): a, c, t, g, unknown or other
  misc_feature (96)..(96): n is a, c, g, or t
  modified_base (185)..(185): a, c, t, g, unknown or other
  misc_feature (185)..(185): n is a, c, g, or t
  modified_base (197)..(197): a, c, t, g, unknown or other
  misc_feature (197)..(197): n is a, c, g, or t
tcagatacgacgtacacgaccggtgctcgatttagtcgagctctctcgcggggagagctgctcagttaggacccagagggaaccatggaaaccccngcgcagcttctcttcctcctgctactctggctcccagagaccaccggagaaattgtgttgacgcagtctccaggccaccctgtctttanctccgagggaancgcccacctctcctgcgaggcagtgagatgtaacacgaggtatcgtggcctaggtaccagcaacgaaacccgtggaccacgggtcctacccgacggccttaccgtagtacgttacggttaaccccgtttacgttccccgaggaccgtaaccggggccctaacgttccgggaccctaaccgttaccccgaagggttaacccggttacgggtttacccgaaccgggtttggacccggtaagggttcgggggttaccttagggggaacccttaacggttaccctttacgacctttaccgtaccaacccgttagttaccccgaaacccgtaacggtcccggtttagggaaaccgttcccgttaaggtaaaccggtttttacgttttacggtaccgttaaacggtttggttttaaaccgttttacggtttaccgggaaccgttaacggttacggtttaaacggttaccgttaacggggtaccgtaccccgggttaaccccttaacccgggtttaaaccgttttacccgggtttttacgggggtaaccccgggttaacggggggtttaacccctaaacggggttaccggttaacgggggtaaacgtttaacggggaaaccgggttaaaaccgggttcggttaaccgggttacgggtacccgttaacggtaccccgtaacccgtttacggtttacccgttacggttttaccccggtttccttaaaccggttttcccccggttaacccccgg

SEQ ID NO: 51292 - DNA, 820 bp, Homo sapiens
  misc_feature: GYAE6OF01D76ZX.12.82.H05.1.454.CMB.1.raw
  modified_base (548)..(548): a, c, t, g, unknown or other
  misc_feature (548)..(548): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagacgaccaccggagaaattgtgttgacgcagtctccaggcacctgttcttatcctcgagggaagcgccaccctctcctgcgacgggcctagtacgagtaattcgttaaacaacgaggttactcgtcggtccgtggtaaccagaccgaacgtaaaccgtcggaccgtacggtcccgtacccgagggtcctccctactacgttaccggttacctttacccttaccggacggaccggaccgggtacccctacggttccgggacctaacccgttacccgaacggtaccgttaccggtttaccaaccggttggcccggtaaggggttcggtccggttagggacctacggttaccttacgaccttcgtaccacgtacctaccgaacgtacggttacggcggacaccgttaggtaaacgtttntttacggacgttaacgttacgtttagtttacgttcgtacgtacgtactagggttacgtcgggttacgacccgtaccgtttacccggtacgtttcgggttttaccggggaacccggttttaccggggaacgtacgttacgggtaacgggtaacgtaccggtaaacggttaaacgccgggtttcgggaccggtttacggccgttaaccccgacgtttaaccgttccgttttacgggttacccctttacgttaacccggttcccccgtttcccgg

SEQ ID NO: 51293 - DNA, 915 bp, Homo sapiens
  misc_feature: GYAE6OF01D21K9.12.82.H05.1.454.CMB.1.raw
tcagatacgacgtacacgaccggtgctcgatttagtcgagctctctcgcggggagagctgctcagttaggacccagagggaaccatggaaaccccagcgcagcttctcttcctcctgctactctggctccagagaccaccggagaaattgtgttgacgcagtctccagccaccctgtctgtgtctaccgaggggaaacgcgccctaccctctccgtgccgacgggccagtcaggacgttattaaatacgcgtacttacggccgtacggtaccagtacgaacgactacccgtggacccgaaggtcccttcccggaaggtccctcccgtacgtacttaccgttaggtacggtacgaccttaacgtacccgtaacccggtaccgggtaccctacggttaccggttaacctccccgaaacgggttaccccgtaagggtttacgtacggttaggggtaccgttaggggttaccgggttacggtaccgggtaacgtacggttaaccgttacccggtacccttaccctaaccgtaaccgtacgaacgttaccgaccgtaccgtaccgttccggaacgtacggttacccgttaagtaaacgtttacgtttaggtaccgtttacgtttttaacgtaccgtttcgtaacgttaacgggtactttaaaaccggtttaaactttaaacggtttaccgggtttaccgttttacccggttacggttaacccgttttaccgggttacccggggttaacccgggggggtaaccgggttaaccgggtaaggggttaaccgtaacggttaaaccgttaaccggtaaaaaccgggttacgggttcggttaacccggttacccgtaaacgaccccggtttaaaccccgaggttttaacccggtccttttaacccggttccgtttaaccccccggg

SEQ ID NO: 51294 - DNA, 838 bp, Homo sapiens
  misc_feature: GYAE6OF01DXFKA.12.82.H05.1.454.CMB.1.raw
  modified_base (189)..(189): a, c, t, g, unknown or other
  misc_feature (189)..(189): n is a, c, g, or t
  modified_base (205)..(205): a, c, t, g, unknown or other
  misc_feature (205)..(205): n is a, c, g, or t
tcagatacgacgtacacgaccggtgctcgatttagtcgagctctctcgcggggagagctgctcagttaggacccagagggaaccatggaaaccccagcgcagcttctcttcctcctgcctactctggcctcccagacgaccaccggagaaattgtgttgacgcagtctccgaggccaccctgtctttanctaccgaaggggaaancgccctaccctctccgtgcgagggccagtacgagaatacgttaaacaacgtaggttactcgtacggccgttacggtaaccacggaccgtaaagaaacccgtggacccgaacgggtccctaccccgacggtccctacctaccgtaagttcggttaacccgttttaacccgttaccgaacggtaccgaacggggtacccctaaccggtaccggtaccgtaccttacccccgaaaggacccgttaacggttacccgtaacggtcgggaaccgttacgggggtcgggttaccggtagggtaaccgtaccgttaaccctttccgtaaccttccgtacccgtaaccctacgtacccaacccggaaggtaacccgttagggaacccgtacccgttaaggtaacgtttagttttacggtacgtaaggttagtttaatttacgttagtacgtacggtagtaacgttaggtacggtacgaccgtcccgttaaccgttacgttaccggtttaccgggtaccgggtaacgggttaccgaaggtaccggtagggtaaccgtaacgtaaacggaacgtaaccgtgggtacctacggtacacccgtacgtacgttacgttcgttaccttcgtcccttccccgtacccg

SEQ ID NO: 51295 - DNA, 758 bp, Homo sapiens
  misc_feature: GYAE6OF01BOBJE.12.82.H05.1.454.CMB.1.raw
  modified_base (191)..(191): a, c, t, g, unknown or other
  misc_feature (191)..(191): n is a, c, g, or t
  modified_base (206)..(206): a, c, t, g, unknown or other
  misc_feature (206)..(206): n is a, c, g, or t
tcagatacgacgtacacgaccggtgctcgatttagtcgagctctctcgcgggggagagctgctcagttaggacccagagggaaccagtggaaaccccagcgcagcttctcttcctcctgctactctggcctcccagagaccaccggaagaaattggtgttgacgcagtcctccaggcaccctgttctttancctaccgaggggaangaccaaccctctcctgcgacggccagcagagtagttaacagattacgtagccgtaggacctgcaggacgtacctggaccaggccttcccgaggtccctccgtactatctaatcgtaactaacgtagtttacggaacggttaccggggacctacggtcggcctaacgtttccgcgacggctacgtacgtttacacggtcggaccgtagggttcgggtacgtacggacttacggtacccttacgaccgttccctaccctaacccctacgaacccgacggttacctaacggtccgtacggttaaggttaacgtttagttttaacggttaattttacgttacgttacgtaaccgtaacgtcgtaaccgttacgtacctaccggttacccgtaccccttaaccgggttccggttaaccggggaccggggtaaccggaccgggttaaagggacgggtaacgacgttaaccggaagtaccggttaacgtcggttaccgacgttccgaccgtacgtacggttcccttacgttaccgttccttaccgttcccttaccccgg

SEQ ID NO: 51296 - DNA, 754 bp, Homo sapiens
  misc_feature: GYAE6OF01BT59X.12.82.H05.1.454.CMB.1.raw
  modified_base (194)..(194): a, c, t, g, unknown or other
  misc_feature (194)..(194): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctcggctcccagacgaccaccggagaaattgtgttgacgcagtctcagcacctgtcttatctccgagggaanacgcccacctctcctgcgacggccagtgaagtaattagttaaacaacgaggtactcgtaggtcctaggtaccagacgaacggaaaccgtcggaccgacggccctacccggagtccttaccgtactaaggttacgttaccgtttaccgttcccgacgtaccggacgggtaccctacgtcggactaccgtacccgtaagtaccgtacgggtttaccaccggttacggaccgtaaggggttcggtacggacggggtaaccacggttacctttccgaccttccgtaccaacctaccgttaccaaccgtcggtacgtacgggactaccgtaggttaacttacgtttacgacgtaggtttacttaagttgttacgagtaaccgtcgtaaggtacgtacgggtacaccgttccgtaaccgttaccgtttcggttaccgggccgggttaacgggtaccaacgggtgtaagggtacgtaaacgttacggaaaacgttcgtcgggtcgtacgccggtacctaccggttactttccgtacgtttacccgttactcccggtttccctacccg

SEQ ID NO: 51297 - DNA, 787 bp, Homo sapiens
  misc_feature: GYAE6OF01DN0GP.12.82.H05.1.454.CMB.1.raw
  modified_base (473)..(473): a, c, t, g, unknown or other
  misc_feature (473)..(473): n is a, c, g, or t
  modified_base (501)..(501): a, c, t, g, unknown or other
  misc_feature (501)..(501): n is a, c, g, or t
tcagatacgacgtacacgaccggtgctcgatttagtcgagctctctcgcggggagagctgctcagttaggacccagagggaaccatacggaaaccccagcgcagcttctcttcctctgctactctcggcctccagactaccacgtggaagaaatagtgaatgaagctagtcctccacgcccacctgtatgtcgtctaccggaaggggaacacgccctacccttctccgtgcgacgggccagtacagtacgttagttaagtacgccgtaacttaggccgttacgggaacctagaccgtaaagtaccgttaccgtacggacccgtacgggtccctacccgacgttcctaccgtactaacgttcgttagtcggtacactaaccgtccgtaaccggacggtacctacgttacggacctcccgaggtctacggtcgacggtggtaccgtgggtcggtacgaggactagtcgtctaccnctaacacgactagcgtacgaccgtccgngttaccggtagttaccgtaaggtttaaacgtttcgtttattaccgttttaagtttacgttactggtaaccgtagttaaaccgtttaagtaacgtttttaaaccgttaacggttttccgttaactcccgggtttaaacccgttcggggttttacgggggcccgggggttaaaacccggggtaagtagggtaaacgggtaaaccgttaaaccgtaaaacccggggtaagtccggtttacgggcccgttacgtacggtacctaacttcgggtttaacgtcggttacccc

SEQ ID NO: 51298 - DNA, 763 bp, Homo sapiens
  misc_feature: GYAE6OF01A0YZO.12.82.H05.1.454.CMB.1.raw
  modified_base (145)..(145): a, c, t, g, unknown or other
  misc_feature (145)..(145): n is a, c, g, or t
  modified_base (186)..(186): a, c, t, g, unknown or other
  misc_feature (186)..(186): n is a, c, g, or t
  modified_base (213)..(213): a, c, t, g, unknown or other
  misc_feature (213)..(213): n is a, c, g, or t
  modified_base (216)..(216): a, c, t, g, unknown or other
  misc_feature (216)..(216): n is a, c, g, or t
  modified_base (250)..(250): a, c, t, g, unknown or other
  misc_feature (250)..(250): n is a, c, g, or t
tcagatacgacgtacacgaccggtgctcgatttagtcgagctctctcgcggggagagctgctcagttaggacccaaagggaaccatggaaaccccagccgcagcttctcttcctcctgctactctggcctccagagaccacgganaaatggtgttgacgcagtcctccgaggcaccctgtctttanctccggagggaaagacgcccaccctcnccngcgagggccagtgactaatcgttaaacacaggtntccgtcggcctacggtacccaggacctaacggaaacctgggaacccacgggtccctacccccgaaggcccttacccgtcgttaacgttacggtttaacccgtttaccgttacccgagggaccgtacgggtaccctaacggttcggacctaccgaacccgtacggtaaccgttacgggttacaccgttcggggacgtaacgggttcgggtacgttagggacctaagggtcccttacaccttccacgtaccacgtccactagaccgtggaccctctaggtaactttgtttgacgttgttacgtacgttagtttacgactaggtacgtaacgtcgtacggtaacgccgtacccgtaacgttacgttaacggttcgggtacccggtacgggtactaacgggttcgtaagggaacgttaagtaaccggtaaacgtacggttcggttacgcccgtaacgtcccctaaggtaccttcggttacctttaaccgacgtttaacccctccggtaccccttacg

SEQ ID NO: 51299 - DNA, 764 bp, Homo sapiens
  misc_feature: GYAE6OF01ER48F.12.82.H05.1.454.CMB.1.raw
  modified_base (199)..(199): a, c, t, g, unknown or other
  misc_feature (199)..(199): n is a, c, g, or t
  modified_base (229)..(229): a, c, t, g, unknown or other
  misc_feature (229)..(229): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgttctttatctccgaggggaaanacgccaccctctcctgcgagggccagtganaatagttaacaacaggtatcgtggcctggtaccagacaagaaaccgtggaccaggcctacccgaggccttacctacattcgttaaccgtttaccttccaacggccgtacgggcccaacgtcgggacctaccgtaccaggtacgtacgggttaccaccgtggacgtacgggttcgggtacgtacggggaacacggttacttcaaccgtttccaccgtaaaccctagtaccccgtaaccgaacgtaccggtaacgggtaaccgtacccgtttaagggtaaacgtttacgtttttacggacgttaacggtttaacgtttaagttttaaacgttcggtacgtaacggttaccgtaaggttacggttacggtaccggccggtaaccgttaaccgtaacgtttaacggtttaccgggaccgtaacggggttacccaaggttaccgtaagggtacgtaaacggtaacggtaaacgtacggtcggttagacgtaccggactaccgtacgttctacggttacttactaccgttccgtaaccccg

SEQ ID NO: 51300 - DNA, 882 bp, Homo sapiens
  misc_feature: GYAE6OF01EYYWZ.12.82.H05.1.454.CMB.1.raw
  modified_base (193)..(193): a, c, t, g, unknown or other
  misc_feature (193)..(193): n is a, c, g, or t
tcagatacgacgtacacgaccggtgctcgatttagtcgagctctctcgcggggagagctgctcagttaggacccagagggaaccatggaaaccccagcgcagcttctcttcctcctgctactcgtggcctcccagagaacccaccggaagaattggtgttgacgcagtctccgaggcctaccctgtcctttancgtaccgaaggggaaagcgcccacccttactccgtggaccgacgggaccaaggtagaagaaacgttacggttaaacaacgtaggtacgttccgtcggccgttaggaaccagaccgtaaacgaaacccggtcggaccgaacgggtcctacccgtacggtcctaccgtactagttaccggttaaccgttcctccggagccggtacgggccctaagttccgggacctactacccggagtaccgtagttccgacgtcgggactacggggttcggacggtggaactaccgttaccgtactaacccgttcgtaacccctaagtacctaccgtaacccggtacgtaccggtacgggtacgtacccgttaaaggtaacggtttacgttttaagggaactttacgggttaacgtttagtttaaccgtcggggtaccttagggtacccgtttaaggttacggttcggggtccccggtaacggttaccgttaaacccgtttacgggttaccgttttaccgggggaacccgggttagggttaaacctaaccggggttggttaaacgggaaacgggttaacccgtttaaaacggggaaaaccctttgggggttccggtaacccgggtttcaacccggtaaccttaacgttacgtttcccgggtttataaccccgttcgtttaccccgttcccggttaacccc

SEQ ID NO: 51301 - DNA, 526 bp, Homo sapiens
  misc_feature: GYAE6OF02G10DG.12.82.H05.1.454.CMB.1.raw
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaagagccaccctctcctgcagggccagtgagaatgttaacaacaggtatctggcctggtaccagcagaaacctggccaggctcccaggctcctcatgtacgttacttccagcaggccactggcatcccagacaggttcactggcagtggtctgggacagacttcactctcaccatccaccagactggagcctgaagtatttgactagtttattactgtcagctagcgtagcaactggcctcggttctacgttttggccaggggaccaagcgtacggagactacgaaacgtacgtgtcggctgacaccatccgttgtccttcactccttcccg

SEQ ID NO: 51302 - DNA, 524 bp, Homo sapiens
  misc_feature: GYAE6OF02GLR8J.12.82.H05.1.454.CMB.1.raw
  modified_base (198)..(198): a, c, t, g, unknown or other
  misc_feature (198)..(198): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaagngccaccctctcctgcagggccagtgagaatgttaacaacaggtatctggcctggtaccagcagaaacctggccaggctcccaggctcctcatgtacgttactccagcagggccactggcatcccagacaggttcactggcaggtggtctgggacagacttcactctcaccatccaccagactggacgcctagaagtatttgctagtgttattattgtctagcagtatggtagcgcaccgtactacgttttcggccgtagggtaccaagcgtaggagagtagaacgaacgtggtggcgtgcacgtactctgtcttctactcctcccg

SEQ ID NO: 51303 - DNA, 575 bp, Homo sapiens
  misc_feature: GYAE6OF02ISWWA.12.82.H05.1.454.CMB.1.raw
  modified_base (260)..(260): a, c, t, g, unknown or other
  misc_feature (260)..(260): n is a, c, g, or t
  modified_base (291)..(291): a, c, t, g, unknown or other
  misc_feature (291)..(291): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggcctcccagagaccaccggagaaattgtgttgacgcagtctccaggcaccctgtctttatctccaggggaaagagcccaccctctcctgcagggccagtgagaatgttaaacaacaggtatctggcctggtaccngcagaacctggccaggcctcccaggctcctnatgtacgttactccagcgagggcccacgtggccactcccagacaggttcacgtggcaggtgggtctgggaacagactttcacttctacaccatccaccagacgtggacgcctagaacgtatttgactagttgttatttagttcgtcagtctagttagtgggtacgcgactaccgttacttacgttttcggccggtagggtaccaagtcgtaggagtatagaacgtacgtggtacgtcgtgaccgtacctattccgttgttccgtttactacttcccgttacccg

SEQ ID NO: 51304 - DNA, 511 bp, Homo sapiens
  misc_feature: GYAE6OF02GX8JK.12.82.H05.1.454.CMB.1.raw
  modified_base (365)..(365): a, c, t, g, unknown or other
  misc_feature (365)..(365): n is a, c, g, or t
  modified_base (496)..(496): a, c, t, g, unknown or other
  misc_feature (496)..(496): n is a, c, g, or t
  modified_base (507)..(507): a, c, t, g, unknown or other
  misc_feature (507)..(507): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaagagccaccctctcctgcagggccagtgagaatgttaacaacaggtatctggcctggtaccagcagaaacctggccaggctccaggctcctcatgtacgttactccagcagggccatggcatcccagacaggtcactggcagtggtctgggacagacttcactctcaccntcaccagactgagctgaagtatttgctagtgtattatgtactagtcagttagtggtagcgtacgaccgtactacgttttcggccgtagggtcctaagcgtaggagagtagaatgaactgtaggctgcgacntcgtgtcttcnttcc

SEQ ID NO: 51305 - DNA, 517 bp, Homo sapiens
  misc_feature: GYAE6OF02GYRW4.12.82.H05.1.454.CMB.1.raw
  modified_base (383)..(383): a, c, t, g, unknown or other
  misc_feature (383)..(383): n is a, c, g, or t
  modified_base (426)..(426): a, c, t, g, unknown or other
  misc_feature (426)..(426): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaagagccaccctctcctgcagggccagtgagaatgttaacaacaggtatctggcctggtaccagcagaaacctggccaggctcccaggctcctcatgtacgttacttccagcagggccactggcatcccagacaggttcactggcagtggtctgggacagacttcactctcaccatcaccagactggancctgaagtattttgctagtgtattattgtcagcagtatggtancgcaccgtactacttttggccgtagggtccaaggctaggagagtagaaacgtaacgtggtggctgctacatctgtcttctactcttccccg

SEQ ID NO: 51306 - DNA, 552 bp, Homo sapiens
  misc_feature: GYAE6OF02GWJ9H.12.82.H05.1.454.CMB.1.raw
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaagagccaccctctcctgcagggccagtgagaatgttaacaacaggtatctggcctggtaccagcagaaacctggccaggctccaggctctcatgtacgttactcagcagggccatggcatcccagacaggttcactggcagtggtctggggacagacttcactctcaccatcaccagactggagcctagaagtattttgctagtgttattattgtcagtctagtatggtagcgctaccgtactacgttttcggccgtacggggtccaacgtcgtaggagtagtagaaacggtaacgtggtaggtacgtacggccgtaacctacttcgttcggttacttacctacttcccgttccccg

SEQ ID NO: 51307 - DNA, 568 bp, Homo sapiens
  misc_feature: GYAE6OF02H71NF.12.82.H05.1.454.CMB.1.raw
  modified_base (197)..(197): a, c, t, g, unknown or other
  misc_feature (197)..(197): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaanagcccaccctctcctgcagggccagtgagaatgttaacaacaggtatctggcctggtaccagcagaacctggccgggctcccaggctcctcatgtacgttacttccagcagggccacgtggcatcccagacaggttcactggcaggtgggtctggggacagtaccttcactctcaccatcaccagactggacgccgtagaagtattttgctagttgtattagttgtcgtagtctagtagttaggtagcgccgtaccgttactacgttttacggaccgtacggggtaccgaagtcgtagggagacgttaggaacgtaacgtggtcggtctcggacacctagtcgttgttccttctacttccgttcccgtccc

SEQ ID NO: 51308 - DNA, 641 bp, Homo sapiens
  misc_feature: GYAE6OF02JQA1P.12.82.H05.1.454.CMB.1.raw
  modified_base (197)..(197): a, c, t, g, unknown or other
  misc_feature (197)..(197): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaanagccaccctctcctgcagggccagtgagaatgttaacaacaggtatctggcctggtaccagcagaacctggccaggctcccaggctctcatgtacgttactcagcagggccacgtggcactcccagacaggttcacgtggcaggtggtctgggacagtacttcgactctacacgtactccaaccgtagtaacgtcgggaacgtccctagaaagtacttttagccgtagttagttaattagttcgtcgaacgtacgtaagttagttggtaagcggtaccgtaccgttaacgttacgttttacgggaccgtacggggtaccctaaggtaccgttagggaacgtacgtacggtaaacggtaacgttacggttacggtacgttacggacctaaccggtacttaccggttacggtttaccttaccgttaccgttccccgtttaccccgg

SEQ ID NO: 51309 - DNA, 537 bp, Homo sapiens
  misc_feature: GYAE6OF02HQ8Y7.12.82.H05.1.454.CMB.1.raw
  modified_base (197)..(197): a, c, t, g, unknown or other
  misc_feature (197)..(197): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaanagccaccctctcctgcagggccagtgagaatgttaacaacaggtatctggcctggtaccagcagaaacctggccaggctcccaggctcctcatgtacgttactccagcagggccactggcactcccagacaggttcacgtggcaggtggtctgggacagacttcactctcacctatcaccagactggacgcctagaagtatttgactagtgttattattgtcagtctagtatggtagcgcaccgtactacgtttcggaccgtacgggtaccaaggtcgtaggagagtagaaacgtacgtggtacggctacgcacgtatcgtgttcttctactccttcccg

SEQ ID NO: 51310 - DNA, 552 bp, Homo sapiens
  misc_feature: GYAE6OF02HC1JU.12.82.H05.1.454.CMB.1.raw
  modified_base (197)..(197): a, c, t, g, unknown or other
  misc_feature (197)..(197): n is a, c, g, or t
  modified_base (383)..(383): a, c, t, g, unknown or other
  misc_feature (383)..(383): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaanagccaccctctcctgcagggccagtgagaatgttaacaacaggtatctggcctggtaccagcagaacctggccaggctcccaggctcctcatgtacgttacttccagcagggccactggcatcccagacaggttcactggcagtggtctgggacagactttcactctcaccatcaccagactggancctagaagtattttgctagtgttattattgtctagtctagtatggtagcgtacaccgtactacgttttggaccgtacggggttaccaaggtcgtgggacgtagtacggaaacgtaacgtggtggacgtggtccaccgtacttctgttctttcgtacttccgttaccccg

SEQ ID NO: 51311 - DNA, 526 bp, Homo sapiens
  misc_feature: GYAE6OF02IA8IO.12.82.H05.1.454.CMB.1.raw
  modified_base (197)..(197): a, c, t, g, unknown or other
  misc_feature (197)..(197): n is a, c, g, or t
  modified_base (382)..(382): a, c, t, g, unknown or other
  misc_feature (382)..(382): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaangccaccctctcctgcagggccagtgagaatgttaacaacaggtatctggcctggtaccagcagaaacctggccaggctccaggctcctcatgtacgttacttccagcagggccactggcatcccagacaggttcactggcaggtggtctgggacagacttcactctcaccatcaccagactgganctgaagtatttgctagtgttattattgtcagtctagtagtggtagcgctaccgtactacgtttcggaccgtacggggtaccaagcgtaggagagtagaacgtagtggtaggctcgacaccatctgttcttactactccttcccg

SEQ ID NO: 51312 - DNA, 522 bp, Homo sapiens
  misc_feature: GYAE6OF02HWBN0.12.82.H05.1.454.CMB.1.raw
  modified_base (197)..(197): a, c, t, g, unknown or other
  misc_feature (197)..(197): n is a, c, g, or t
  modified_base (287)..(287): a, c, t, g, unknown or other
  misc_feature (287)..(287): n is a, c, g, or t
  modified_base (381)..(381): a, c, t, g, unknown or other
  misc_feature (381)..(381): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaangccaccctctcctgcagggccagtgagaatgttaacaacaggtatctggcctggtaccagcagaaacctggccaggctcccaggctcctnatgtacgttacttccagcagggccactggcatcccagacaggttcactggcaggtggtctgggacagcttcactctcacatcaccagactggancctagaagtattttgctagtgtatttattgtcagctagtagtggtagcgacaccgtactacgtttggccgtagggtccaaggcgtagggagagtagaaacgacgtggtaggcgtgcactatctgttcttactctcctcccg

SEQ ID NO: 51313 - DNA, 540 bp, Homo sapiens
  misc_feature: GYAE6OF02HGPU4.12.82.H05.1.454.CMB.1.raw
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaagagccaccctctcctgcagggccagtgagaatgttaacaacaggtatctggcctggtaccagcagaaacctggccaggctcccaggcctcctcatgtacgttacttccagcagggccacgtggcatcccagacaggttcactggcaggtcggtctgggacagtacttcactctcaccatccaccagactggacgcctagaagtatttgctagttgtattagttgtctagtcgtagtagtggtagcgcgaccgttactacgttttcggccgtacgggtccagcgtaggagagtaggaacgtacgtggtggcgtcgacacgtactctgttctctacgtccttcccg

SEQ ID NO: 51314 - DNA, 553 bp, Homo sapiens
  misc_feature: GYAE6OF02G5G59.12.82.H05.1.454.CMB.1.raw
  modified_base (197)..(197): a, c, t, g, unknown or other
  misc_feature (197)..(197): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaangccaccctctcctgcagggccagtgagaatgttaacaacaggtatctggcctggtaccagcagaaacctggccaggctccaggctctcatgtacgttactcagcagggccactggcatcccagacaggttcactggcaggtggtctgggacagactttcactctcaccatccaccagacgtggacgcctagaacgtattttgctagttgttaattattgtacagtctagtatggtagcgacgtaccgtactacgttttcggaccgtacggggttccaagtcgtagggagagtacgaaacggtacgtggtacggcgtgaccacgtacgttcgttgttccttcgtacttcccttcccg

SEQ ID NO: 51315 - DNA, 618 bp, Homo sapiens
  misc_feature: GYAE6OF02G9IOI.12.82.H05.1.454.CMB.1.raw
  modified_base (191)..(191): a, c, t, g, unknown or other
  misc_feature (191)..(191): n is a, c, g, or t
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (332)..(332): a, c, t, g, unknown or other
  misc_feature (332)..(332): n is a, c, g, or t
  modified_base (352)..(352): a, c, t, g, unknown or other
  misc_feature (352)..(352): n is a, c, g, or t
tcagatacgacgtacacgaccggtgctcgatttagtcgagctctctcgcggggagagctgctcagttaggacccaggaggggaaccatggaaaccccagcgcagcttctcttcctcctgctactctggcctcccagacgaccaccggtagaaatttgtgttgacgtcagtctccaggcaccctgtctttanctccaggggaaangccaccctntcctgcagggccagtgagatgttaacacaggtatctggcctggtaccagcagaacctggccaggctccaggctcctcatcgtacgttactccgagcgagggccagtggcatcccagacnggttcacgtggcagtggtcngggacagacttcatctcaccctatccgaccagacttcggacgccgtagaacgtatttcgactacgtagttacttagttacgtacgtacgtactagtagtggtacgtccgtaccgtaaccgttaccgtaccgttttcggaccgtacggggtacccgtaacggtaccgtaacggtaacgtacggtaacggaacgtacggttacggcgtacgtaccgtaacctacgttaccgttacgttccgttaccgtacttccgttacccgtacccg

SEQ ID NO: 51316 - DNA, 536 bp, Homo sapiens
  misc_feature: GYAE6OF02GL50X.12.82.H05.1.454.CMB.1.raw
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaagagccaccctctcctgcagggccagtgagaatgttaacaacaggtatctggcctggtaccagcagaaacctggccaggctcccaggctcctcatgtacgttacttccagcagggccactggcatcccagacaggttcactggcaggtggtctggggacagacttcactctcaccatccaccagactggacgcctagaagtatttgcgtagttgtatttattgtcagtctagtatggtagcgcaccgtactacgttttggccgtacgggtccaagcgtaggagtagtacgaacgtacgtggtaggctgaccaccgtatcgtgttcttctacttccttcccg

SEQ ID NO: 51317 - DNA, 550 bp, Homo sapiens
  misc_feature: GYAE6OF02IN46D.12.82.H05.1.454.CMB.1.raw
  modified_base (198)..(198): a, c, t, g, unknown or other
  misc_feature (198)..(198): n is a, c, g, or t
  modified_base (424)..(424): a, c, t, g, unknown or other
  misc_feature (424)..(424): n is a, c, g, or t
tcagatacgacgtacacgaccggtgctcgatttagtcgagctctctcgcgggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaangccaccctctcctgcagggccagtgagaatgttaacaacaggtatctggcctggtaccagcagaaacctggccaggctcccaggctcctcatgtacgttacttccagcagggccactggcatcccagacaggttcactggcagtggtctgggacagtacttcactctcaccatcaccagactggagctgaagtatttgctagtgtattatgtcagtcagtatgtancgctaccgtactacgtttggccgtacgggtaccaaggtcgtgggagtagtagaaacgtacgtggtacgggtctcggaccaccgtacgttccgttcggttacctttccgtaccttccttacccccgg

SEQ ID NO: 51318 - DNA, 538 bp, Homo sapiens
  misc_feature: GYAE6OF02GDVL5.12.82.H05.1.454.CMB.1.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
  modified_base (366)..(366): a, c, t, g, unknown or other
  misc_feature (366)..(366): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaangccaccctctcctgcagggccagtgagatgttaacaacaggtatctggcctggtaccagcagaacctggccaggctcccaggctcctnatgtacttactcagcagggccacgtggcatcccagacaggttcactggctaggtggtctgggacagtactcactctcaccntccacagactggactccgtagaagtattttcgacgtagtgtatttagttgtcgagctagtagtgtagcgactaccgtactacgtttcgccgtacgggtccgaagtcgtaggagagtagaacggtacgtggtggcgtcgacaccgtatcgtgttacttctacgttccctcccg

SEQ ID NO: 51319 - DNA, 563 bp, Homo sapiens
  misc_feature: GYAE6OF02GKAOZ.12.82.H05.1.454.CMB.1.raw
  modified_base (197)..(197): a, c, t, g, unknown or other
  misc_feature (197)..(197): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaangccaccctctcctgcagggccagtgagaatgttaaacaacaggtatctggcctggtaccagcagaacctggccaggctccaggctcctcatgtacgttactccagcaggccactggcatcccagaccaggttccactggcaggtgggtctggggacagtacttcactctcaccatccaccagactggacgcctgaagtatttgctagtgttatttattgtcgagtcagttagtggtagcgacgtaccgtactacgttttcggccgtacggggtaccaagtcgtagggagtagtacgaaacggtaacgtggtacggtctcggcctaacctagttccgttcgttactttacgtacttcccttaccccg

SEQ ID NO: 51320 - DNA, 514 bp, Homo sapiens
  misc_feature: GYAE6OF02INMML.12.82.H05.1.454.CMB.1.raw
  modified_base (198)..(198): a, c, t, g, unknown or other
  misc_feature (198)..(198): n is a, c, g, or t
  modified_base (327)..(327): a, c, t, g, unknown or other
  misc_feature (327)..(327): n is a, c, g, or t
  modified_base (494)..(494): a, c, t, g, unknown or other
  misc_feature (494)..(494): n is a, c, g, or t
tcagatacgacgtacacgaccggtgctcgatttagtcgagctctctcgcgggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaangccaccctctcctgcagggccagtgagaatgttaacaacaggtatctggcctggtaccagcagaaacctggccaggcctccaggctcctcatgtacgttactccagcagggccactggcatcccagacnggttcactggcaggtggtctgggacagtacttcactctcaccatcaccagactgacgctagagtatttgctagtgttattattgtcagtcagttatggtagcgtcaccgtatacgtttgccgtagggtccaaggctaggagagtacgaacgtacgtgtgctgcactntctgtcttctactcgtcccg

SEQ ID NO: 51321 - DNA, 640 bp, Homo sapiens
  misc_feature: GYAE6OF02JS7HF.12.82.H05.1.454.CMB.1.raw
  modified_base (198)..(198): a, c, t, g, unknown or other
  misc_feature (198)..(198): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccgaggggaaanagccaccctctcctgcagggccagtgagaatgttaacaacaggtatctggcctggtaccagacagaaactggccaggctcccgaggctcctcactctatgatgcagtaccgaaaacgggccaacgtggtaccacttacccgacgaccgaggttccaggtcggcgtaggtcgggtcgtcgggggactacggtacttcaacgttccaccacctactcgtacgcgacgtaccgtagacgaccgtagtaacgttatttcggtacttaagtttacttacgttcgtacagtcacggtacgtacgtaccgtacgtcggtccgttacggttacgttaccgttttacgggaccgtaacgggaacctacggtacggtacggagtaacgtaaccgtaaacggtacgtacggttacggtcgtacgtacctacgtacgtcgttcgtaccgttacg

SEQ ID NO: 51322 - DNA, 505 bp, Homo sapiens
  misc_feature: GYAE6OF02JBB0X.12.82.H05.1.454.CMB.1.raw
  modified_base (197)..(197): a, c, t, g, unknown or other
  misc_feature (197)..(197): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaangccaccctctcctgcagggccagtgagaatgttaacaacaggtatctggcctggtaccagcagaaacctggccaggctcccaggctcctcatgtacgttacttcccagcagggccactggcatcccagacaggttcactggcagtggtctgggacaggacttcactctcaccatcaccagactggagcctgaagattttgctagtgtattattgtcagcagtatggtagcgcaccgtactacgttttggcctacggggtccaagctgagatgaacgactgtggctgcaccgatctgtctcatctcccg

SEQ ID NO: 51323 - DNA, 576 bp, Homo sapiens
  misc_feature: GYAE6OF02IK9T7.12.82.H05.1.454.CMB.1.raw
  modified_base (197)..(197): a, c, t, g, unknown or other
  misc_feature (197)..(197): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaangccaccctctcctgcagggccagtgagaatgttaaacaacaggtatctggcctggtaccagcagaaacctggccgggctcccgaggcctcctcatgtacgttacttccagcagggccacgtggcatcccagactaggtcacgtggctaggtggtctgggacagtacttcactctcaccatccacagactggacgcctagaagtatttgactagttgttattattgtcagtacagtagtggtagcgacaccgtactacgttttcggaccgtaggggtaccaaggtcgtaggaacgtagtaaggaaccgtaacgttaggtcggaccgtggtacctaaccgtagttccttacggttcttaccgtacttcccgttcccgtacc

SEQ ID NO: 51324 - DNA, 643 bp, Homo sapiens
  misc_feature: GYAE6OF02JCERC.12.82.H05.1.454.CMB.1.raw
  modified_base (196)..(196): a, c, t, g, unknown or other
  misc_feature (196)..(196): n is a, c, g, or t
  modified_base (287)..(287): a, c, t, g, unknown or other
  misc_feature (287)..(287): n is a, c, g, or t
  modified_base (354)..(354): a, c, t, g, unknown or other
  misc_feature (354)..(354): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaanagccaccctctcctgcagggccagtgagaatgttaaacacaggtatctggcctggtaccagcagaacctggccaggctcccaggcctcctnatgtaccgttacttccagcagggcccacgtggccatccccagacaggttcacgtgcgaggttcggtntaggggactagtaccgtttcaaccgttctaccaacctatcccgaacctagaaccgtcggaacgacccgttagaaagttacgttttacggacttaggttagttaactttattcgtacgtagtctaagttagtagggtacgtaccgtaccgtaccgttacgttaccgtttcggtaccggtacgggtaccgtaacgtacgtaggaacggtagtacgaaacggtaacggtaggtacggtcgtacggtactaccgtacgtacttcgttacttaccgttacttacccgttacccg

SEQ ID NO: 51325 - DNA, 529 bp, Homo sapiens
  misc_feature: GYAE6OF02GH8FS.12.82.H05.1.454.CMB.1.raw
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaagagccaccctctcctgcagggccagtgagaatgttaacaacaggtatctggcctggtaccagcagaaacctggccaggctcccaggctcctcatgtacttacttccagcagggccactggcatcccagacaggttcactggcaggtggtctgggacagacttcactctcaccatccaccagacctggacgcctagaagtattttgctagtgttattattgtcagctagtagtggtagcgctaccgtactacgtttcggaccgtagggtccaagcgtggagtagtagaacgtacgtggtaggctcgcactatcgtgttcttctattcctccccg

SEQ ID NO: 51326 - DNA, 680 bp, Homo sapiens
  misc_feature: GYAE6OF02HAFSI.12.82.H05.1.454.CMB.1.raw
  modified_base (184)..(184): a, c, t, g, unknown or other
  misc_feature (184)..(184): n is a, c, g, or t
  modified_base (196)..(196): a, c, t, g, unknown or other
  misc_feature (196)..(196): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttanctccgagggaangccaccctctcctgcagggccagtgagaatgttaacacaggtatcgtggcctggtaccagcaagaacctggaccaggcctcccgaggcctcctcattcgtacgttacctccgagcgacgggccacgtggaccactcccgaagaccgtaggttccacgtggctaggtcgggtctaggggactacggtcctttacgaccttcctaccaacccgtactacccgaaccgacgtaccgtcgggacgtacccgtaggtaaacgtttacgttttacggacgtaaggtttagttaacgtttacgtttacggtacgtaacgtacgtaaggttagttagggtacgcggtaccgtaccgttacttaccggttttcggacccggtacgggtacctaaggtcgtagggaacgtacgtacggaaacgtacgttcggtacgtacgtacgaccgtaccgtacgttaccgttcgtttcctacgttaccgttcccgtccccg

SEQ ID NO: 51327 - DNA, 725 bp, Homo sapiens
  misc_feature: GYAE6OF02IESTK.12.82.H05.1.454.CMB.1.raw
tcagatacgacgtacacgaccggtgctcgatttagtcgagctctctcgcggggagagctgctcagttaggacccagagggaaccatcggaaaccccagcgcagcttctcttcctcctgctactctggcctcccagacgaccaccggagtaaattgtgttgacgcagtctccaggccaccctgttctttatctaccgaaggggaaagacgcccaccctctcctgcgacgggccagtgagattgtaaacaacgaggtactcgtacggccgtaggtaaccaggaccaacggtaaaccgtggaccccgtaacggcccttacccgacggtcctaccttactacttttaccgttaccttaccaggtccgaacgggccctacgtcggaccacgtacccgagtaccgtaggttccacgtggcgtagggtcggttcgacgggaactacgtaccttcaacttccaccgtacatacccaccgaagtacgtcggtaacgaccgttaggtaacgttgttttcggacgttaggtttacgttaatttacggttgacgtaacgtcgtaaggttacgtacgggtacgtccgacgtaaccgttcgttaccgtttcgggaccgtacgggtaccaagggtccgtaggaacgtagtaaccggtaacgtacgttcgggacggtccgtacgtaccgttaactacgttcgttacggttaccttacgtacccgtttccgtaccccgtacg

SEQ ID NO: 51328 - DNA, 574 bp, Homo sapiens
  misc_feature: GYAE6OF02GFAA9.12.82.H05.1.454.CMB.1.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
  modified_base (317)..(317): a, c, t, g, unknown or other
  misc_feature (317)..(317): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaangccaccctctcctgcagggccagtgagaatgttaacaacaggtatctggcctggtaccagcagaaacctggccaggctccagacttcncatctatgctgcatcctccaggtccactgacnctcccagactaggttcagtgcaggtgggtctgggacagtactcactctcaccatacaccagactgctagtctagtattgtatttcgacttaactttatacttgtacacgtactaacttaattaaagttacgttcggtacccttaccgggtaattaccgtacgtttcggaccgtaacgggacctaggtcgtaggaacgtactaaccggtaaacgtaccgttaggcggtaccgtcgtaccgtaccttagttccgtaccg

SEQ ID NO: 51329 - DNA, 552 bp, Homo sapiens
  misc_feature: GYAE6OF02GRF24.12.82.H05.1.454.CMB.1.raw
  modified_base (198)..(198): a, c, t, g, unknown or other
  misc_feature (198)..(198): n is a, c, g, or t
  modified_base (291)..(291): a, c, t, g, unknown or other
  misc_feature (291)..(291): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaagngccaccctctcctgcagggccagtgagaatgttaaacaacaggtatctggcctggtaccagcagaaacctggccaggcctcccaggcctcctnatgtacgttacttccagcagggccacgtggcactcccagactaggttcacgtggcaggtggtctgggacagtacttcactctacactatccaccagacgtggacgccgtagtaagtatttgacgtagtagttatttattgtctagtctagtagtggtagcgctaccgtactacgtttcggaccgtagggtaccagtcgtgagagtagaacgtacgtggtaggtcgtgaccactacttcgtcgttcttctactccgttcccg

SEQ ID NO: 51330 - DNA, 570 bp, Homo sapiens
  misc_feature: GYAE6OF02H7DJE.12.82.H05.1.454.CMB.1.raw
  modified_base (196)..(196): a, c, t, g, unknown or other
  misc_feature (196)..(196): n is a, c, g, or t
  modified_base (284)..(284): a, c, t, g, unknown or other
  misc_feature (284)..(284): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaanagccaccctctcctgcagggccagtgagaatgtaacaacaggtatctggcctggtaccagcagaaacctggccaggctccaggctccncatgtacttactccagcaggccatgcatcccagcaggttcacgtggctaggtcggtctgggacagtacttcgactctccaccatccaccagtaccgtggacgcctagtaaagtatttagactagttgttattattgtacagtctagtatggtagcgctaccgttactacgtttcggaccgtacgggtaccaaggcgtagggaagtagtaggaaaccgtaggtggtacggtcgtacgtacctaccgtacgttccgtacgttaccttactaccgttcccgttaccccg

SEQ ID NO: 51331 - DNA, 624 bp, Homo sapiens
  misc_feature: GYAE6OF02GHQSH.12.82.H05.1.454.CMB.1.raw
  modified_base (184)..(184): a, c, t, g, unknown or other
  misc_feature (184)..(184): n is a, c, g, or t
  modified_base (207)..(207): a, c, t, g, unknown or other
  misc_feature (207)..(207): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattggtgttgacgcagtctccaggcaccctgtcttanctccagggaaagccgccaccctntcctgcagggccagtgagaatgttaacaacaggtatcgtggcctaggtaccagcaacgaaaccgtggaccaggctccgagctcgcatcgtacgttactcgagctaggccagtggacacgtcccagactacggttcacgtggacaggtcggtctacgggactacggactttcgacttcaccacgtatccacctacggtacgtggacgtaccgtagtaacgttagtttcgacgtaggtagttaattacgttagttactacggtactaaggttacgtaggtacggccgtacgtaccgtacgttacgtttcggaccgttagggtacctaaggtcgtaggtacgtacgtacgaacgtacgtcggtacggtcgtacgacctaaccgtacgttacgttcgttacttacgtacgtccgtaccccg

SEQ ID NO: 51332 - DNA, 657 bp, Homo sapiens
  misc_feature: GYAE6OF02GG0R3.12.82.H05.1.454.CMB.1.raw
  modified_base (198)..(198): a, c, t, g, unknown or other
  misc_feature (198)..(198): n is a, c, g, or t
  modified_base (292)..(292): a, c, t, g, unknown or other
  misc_feature (292)..(292): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccgaggggaaangccaccctctcctgcgagggccagtgaagaatgtaaacaacaggtatctggcctggtaccagcagaaacctggaccaggcctaccgagcctccntactgtacttactccagcgaggccacgtcgctactcccagacgtgtccagtggcaggttcggtcgtggacagtaccttcgactcacaccactaccacgagacgtggacgtaccgtagtaacgttagtttacgacctttagtttaacttacgtcgttacgacgtacgacgttacgtacgtacgtaaccgttcgggtacccgtttaccggttacctttaccggttttacggaacccggtacggggaaaccttaacggccgttacgggaactacgtaacccgtaaacggtaacgttcgggtaaggtccctacggaaccttacccaacgtttcttaccggttactttccgtaccttcccgttaccccgg

SEQ ID NO: 51333 - DNA, 731 bp, Homo sapiens
  misc_feature: GYAE6OF02JFZA1.12.82.H05.1.454.CMB.1.raw
  modified_base (185)..(185): a, c, t, g, unknown or other
  misc_feature (185)..(185): n is a, c, g, or t
  modified_base (198)..(198): a, c, t, g, unknown or other
  misc_feature (198)..(198): n is a, c, g, or t
  modified_base (237)..(237): a, c, t, g, unknown or other
  misc_feature (237)..(237): n is a, c, g, or t
  modified_base (257)..(257): a, c, t, g, unknown or other
  misc_feature (257)..(257): n is a, c, g, or t
  modified_base (298)..(298): a, c, t, g, unknown or other
  misc_feature (298)..(298): n is a, c, g, or t
tcagatacgacgtacacgaccggtgctcgatttagtcgagctctctcgcgggggagagctgctcagttaggacccagagggaaccatggaaaccccagcgcagcttctcttcctcctgctactctggctcccagagaccaccggagaaattgtgttgacgcagtctccaggcaccctgtctttanctccgaggggaangccacctctcctgccagggccagtgagaatgttaacacnggtatcgtggcctggtaccngcaacgaacctggaccagggcctacccgaggccttcccgtnacttcggttaaccgtttaccttcccgaaggtccgtaacggggccccaacgttcgggacctaaccgttaccccgaaggtaaccgtaagggtttcccaacggttcgggacctaggggtttacggggttcctgggggaaacctaggttaacctttccgaacgtttccgtaccaacccgtacttacccgacgtaacggtaccgttcgggaacgtcccgtaaggtaacgttacgtttttcgacgtaggttacgttatttagttacgtactagtacgtagttacggtacggttacgccgtacgttaccgttacgttacgttttacgggacccgtacgggtaccgacggttcggtaggtacgacgtacggtaacgtaacgttggacgtacgtacgacctacgtacgtcgttcggttaccttacgtacttcccgttacccg

SEQ ID NO: 51334 - DNA, 738 bp, Homo sapiens
  misc_feature: GYAE6OF02GWB80.12.82.H05.1.454.CMB.1.raw
  modified_base (196)..(196): a, c, t, g, unknown or other
  misc_feature (196)..(196): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccagggaaanagccaccctctcctgcaggccagtgagaatgttaacaacaggtatcgtggccgtggtaccagacaacggtaaaccgtggaccacggcctacccgaggcctccctactatcgttaccgtttactccgagtcgacggcccacgtggacacctcccagacgtacgttcacgtggctaggtcggtcgtagggacagtacttaccactcctaccaccgtactaccaaccgtacgtaccgtacggaccgtcgtacggtaacgttagtttacggacgttagtttacgttaagtttagttacggtacgtaacgtacgttaagttacgtaggtacgtaccgtaccgttaccggttaccgtttaccggttttaccgggaacccgggttaccggggttaaccgtaaacgggttcggtaacggggtaacgtaacgggttaacgggtaaacccggtaacggtttcggggtaccggtaccgtaccggaacccttacccgtaccgtttccgttaccgtttaccctttaccgttaacccgtttcccccgttaccccgg

SEQ ID NO: 51335 - DNA, 573 bp, Homo sapiens
  misc_feature: GYAE6OF02GMKJS.12.82.H05.1.454.CMB.1.raw
  modified_base (184)..(184): a, c, t, g, unknown or other
  misc_feature (184)..(184): n is a, c, g, or t
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (289)..(289): a, c, t, g, unknown or other
  misc_feature (289)..(289): n is a, c, g, or t
  modified_base (352)..(352): a, c, t, g, unknown or other
  misc_feature (352)..(352): n is a, c, g, or t
  modified_base (396)..(396): a, c, t, g, unknown or other
  misc_feature (396)..(396): n is a, c, g, or t
  modified_base (432)..(432): a, c, t, g, unknown or other
  misc_feature (432)..(432): n is a, c, g, or t
tcagatacgacgtacacgaccggtgctcgatttagtcgagctctctcgcgggggagagctgctcagttaggacccagagggaaccatggaaaccccagcgcagcttctcttcctcctgctactctggctcccagagaccaccggagaaattgtgttgacgcagtctcaggcaccctgtctttanctccgaggggaaagngccaccctntcctgcagggccagtgagaatgttaacaacaggtatcgtggcctggtaaccagcaagaaacctggccaggctccaggctcnatcgtacgttactcagcgaggccatggcacgtcccagactggttcacgtcggcaggtggtcgngggacagtactttcgactcacactagtccacacgtactaggacnccgtagtaagtagtttcgatagtgttattagtagtntacgctagtagtggtagacgcgtaacgtacttacgtttcgggaccgtacgggtactaacggcgtagggatagtacgaacgtagtaggtaggtcgtacgtacgtacgtacgtcgttacgtcttaccgtactcccgttacccg

SEQ ID NO: 51336 - DNA, 609 bp, Homo sapiens
  misc_feature: GYAE6OF02JGVGT.12.82.H05.1.454.CMB.1.raw
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
  modified_base (255)..(255): a, c, t, g, unknown or other
  misc_feature (255)..(255): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttgtctccaggggaaangcccacttctcctgcagggccagtcagngtcttagcacctacttagcctggtaccaanagaacctggccaggctccaggctcctcatctatgatacagttagaagcgggcctacgtggacatctcaggcagtattacaagtcggcaggtcgggtctagggacagtacttcacttctcaccctcgaccacgtcctagacgtcctagaacgttatttacggtaattttacgttactgtaactaacgtagtcgtagtacctaagtccggtacctacccgttacgtttaccgggaccggtacgggaaccgtagggtacggtagtaacgtacgaacgtacgtacgaggttcggaaccgtcggaccaaccgtacgttcttacgttccttaccgtaccttccccgttcccgtacttacg

SEQ ID NO: 51337 - DNA, 706 bp, Homo sapiens
  misc_feature: GYAE6OF02HVL7F.12.82.H05.1.454.CMB.1.raw
  modified_base (197)..(197): a, c, t, g, unknown or other
  misc_feature (197)..(197): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaanagccaccctctccgtgcagggccagtgagaatgttaaacaacaggtatctggcctggtaccagcagaaacctggaccaggcctcccgaggcctcgtcatgtaccgttactccgagcgacggccacgtcgcactcccagacaggttcacgtggcctaggtcggtcgagggactacggtactttacaccgttcacctaaccgtactaccgaacccgaggtaccgtacgggacgtcccgtaggtaaagttacttttcggacttaaggttgttaagtttagttcgtacgtaaggtactaaggttacgtagggtacgtccgtacgtaacccgttacgttaccggttttacgggacccgggttacggggtaaccctaacgggtacgtaaggggtagtaaacggttacggtaaaaccggtacggttaggtaccggtaccgtaacgtacccgtaaccttacgtttacccgttaccgtttaccgtttacccgttacccgtttaccccggttacccccg

SEQ ID NO: 51338 - DNA, 564 bp, Homo sapiens
  misc_feature: GYAE6OF02HC4C1.12.82.H05.1.454.CMB.1.raw
  modified_base (197)..(197): a, c, t, g, unknown or other
  misc_feature (197)..(197): n is a, c, g, or t
  modified_base (283)..(283): a, c, t, g, unknown or other
  misc_feature (283)..(283): n is a, c, g, or t
  modified_base (392)..(392): a, c, t, g, unknown or other
  misc_feature (392)..(392): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaangccaccctctcctgcagggccagtgagatgtaacacaggtatctggcctggtaccagcagaaacctggccaggcctccaggctccnatcgtacgttactcagcagggccagtggcactcccagacaggttcacgtggcaggtggtctgggactgactttcactctacaccatcacctagactggactctgaattntttgctagttgttattagttgtcgagtcgtagtgtggtacgcgacgaccgttacttacgtttcggaccgtacggggtaccaaggcgttagggagtagtacgaaacgtacggtggtcggactacggacctaccgtacttcgttccgttaccttagtaccttcccgttaccccg

SEQ ID NO: 51339 - DNA, 601 bp, Homo sapiens
  misc_feature: GYAE6OF02HDHP6.12.82.H05.1.454.CMB.1.raw
  modified_base (184)..(184): a, c, t, g, unknown or other
  misc_feature (184)..(184): n is a, c, g, or t
  modified_base (198)..(198): a, c, t, g, unknown or other
  misc_feature (198)..(198): n is a, c, g, or t
  modified_base (366)..(366): a, c, t, g, unknown or other
  misc_feature (366)..(366): n is a, c, g, or t
  modified_base (408)..(408): a, c, t, g, unknown or other
  misc_feature (408)..(408): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttanctccaggggaaagngccaccctctcctgcagggccagtgagaatgttaacaacaggtatctggcctggtaccagcagaaacctggaccaggcctcccaggcctcctcatgtaccgttacttcccagcctagggcccacgtggccactcccagactaggttcactggcaggtggtctgggacngtacttcactcacaccatcaccagacgtggacgctagaagtntttacgctagttgttattagttcgtctagtctagttagtaggtacgccgtccgtaaccggttacgttaccgttttcggaccggtacgggttccgtaacggtcgtagggacgtagtacggtaaaccgtacgtggtacggtcgtcgaccgtaccgtacgttacgttcgttccgtttcctaccgttccgttccccg

SEQ ID NO: 51340 - DNA, 904 bp, Homo sapiens
  misc_feature: GYAE6OF02HT2U5.12.82.H05.1.454.CMB.1.raw
  modified_base (194)..(194): a, c, t, g, unknown or other
  misc_feature (194)..(194): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtcttatctcaggggaanagccaccctctccgtgccgagggcctaggtacgagtaactggtttaaaccaaacgtaggttaactccgttaggcccttagggtaaccccaggaccgaacggaaaaccccgttggggaacccgtacggggcccttaccccgagggtcccttacccgtctacgttcggtttaaccgtttaccctttaccgaggaccgacggggtaccaccgtggacctaccgtaccccgaagtacgtaccgggtttacacgttggaccgtaggggtacgggtaccgttacgggggaaccttaagtaccccgtttagtaaaccccttccgtaaaccctaacccgtaaccttacccaacccggtaacgggtacccggtttagggggaccgttaacccgttagggtaaacggttttacgttttacggacgtttaaggttttacggtttaacttttaaggttttcggtacctaagggtttaccgtaaggtttaggtaccggggttacggaccccgttaccgttaaaccccggtttacgtttaccgggtttttacccggggacccgggttaaacgggggtacccttaaacgggtaccgttaaggggtacgttaacgtaaccgggttaaacggtaccggttggtacggttaccgtacggaacccctaccgttaggttacccgtttaccgttaccgttttaccgttacccgtttcccgttaacccccgg

SEQ ID NO: 51341 - DNA, 902 bp, Homo sapiens
  misc_feature: GYAE6OF02J0PJS.12.82.H05.1.454.CMB.1.raw
tcagatacgacgtacacgaccggtgctcgatttagtcgagctctctcgcggggagagctgctcagttaggacccagaggaaccatggaaaccccagcgcagcttctcttcctcctgctactctggcctcccagacgaccaccggagtaaattgtgttgacgcagtctccgaggcaccctgttcttatcctccgaagggggaaacacgccctaccccttctcccgtggaccgagggccctaaggtcgaaagtaacttcggttaaaacaacgtaggtactccgtacgggtcctagggtaacccaggacctaaacggtaaaccctgggaccctaaggggtccctacccgcggtaccttcccgtactaacgttggttaacccgttacttcccgacggacgttacgggaccctaaccggtggaccctaacgtcccccgaagtaacgtagtttccgacggttcgacgtagggtacgggttcgaacggggtaccaagtcccgtttacaacccttccgtaaaccgacccgtattacccgaacccgttaagtaccggtaccggggtaccgtacctaacggtaaaggtttacgttttaaccgacgttaaaccgggtttacgttaaagttttacggtttacggtacgttaaacggtttaccgtaagttaacgggttacggtaaccggtaccggtacccgtttaacccggtaaccgttttacgggttttaccggggacccgggtaaacggggtttacccgtaaccggttacgttaacggggtaaccgtaacggttaaccggttaaaccgtaaaccggttgggtaaccgggttaacttccggtaacccgttaaccgttacgttacgggtttaaccttttaccgtacccgttaacccgtttccccgttaaccccgg

SEQ ID NO: 51342 - DNA, 723 bp, Homo sapiens
  misc_feature: GYAE6OF02H0KZU.12.82.H05.1.454.CMB.1.raw
  modified_base (678)..(678): a, c, t, g, unknown or other
  misc_feature (678)..(678): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccagggaaagagccaccctcttcctgcacgggccagtgagaacttagttaacaacaggttatcgtcggccgtaggtaccagacgaacgaaacctggcccaggccctcccaggtcctcccgtactattcgttaacgtttaccttccgacggccgtaaggggtccctaaccgtggtaccgaccgttcccaacggtaacgtacggtttcaaccgtgggtccgaaggtttcgggtcgtcgggaactacggttaccctttacgaccgttacccgtacaaaccctcgtacccgaaccggttaacgtacctacgggtacggttaccgttaacggtaagtttacggtttttagaccttaggttcgtttaactttagtttacggtcttacggaccgttagttatagggtacgaccggtactaccggtaacgttcgtttacgtacggtacgggttcgaagtccggtagagtaacgtacgtaaaccgtaagtcgggtcgtacncgtactaccgtcttacgtcttacgttcgtaccttccgttaccccg

SEQ ID NO: 51343 - DNA, 711 bp, Homo sapiens
  misc_feature: GYAE6OF02H2JUM.12.82.H05.1.454.CMB.1.raw
  modified_base (318)..(318): a, c, t, g, unknown or other
  misc_feature (318)..(318): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagacgaccaccgggagaaattgtgttgacgcagtctccgaggccaccctgtctttaatctaccgagggaaagcgccaccctctcctaggccagggccagtggagtaacttaggtaaacaacgtaggtactcgtggccctggtaaccagacaacgaaacctcggaccgaggcctccgaggtcctcgtnacgttcgtaccgttcttccaggaccgaacggcccagtcggccacgtcccgagtacgacgtttcacgtgggactggtcggtacgtggactacgtactaccgtactcctccgaacactccgaactagacgtacgtacgtacgtagtaacgttacgtttacggactaggttagttatacgtttcggaccgttacggtaacgtaggttaagtcgggtacgaccggttcgttaacccttaggtttaccggtttacgggtaacccggtacggggttaaccgtaaccgtaggtacgggaacgttagtaaccggaaaacggtcggttaggtacccggtgtaacccgcctaacccgacgtttaccggtctttaccggttacttcccgttacccgttaccccg

SEQ ID NO: 51344 - DNA, 690 bp, Homo sapiens
  misc_feature: GYAE6OF02HNQ3Y.12.82.H05.1.454.CMB.1.raw
  modified_base (205)..(205): a, c, t, g, unknown or other
  misc_feature (205)..(205): n is a, c, g, or t
  modified_base (236)..(236): a, c, t, g, unknown or other
  misc_feature (236)..(236): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagacgaccaccggagaaattgtgtgacgcagtctccaggccaccctgttctttatccgtaccgaaggggaaacncgccctaccctctcctgcgagggccagtganaatagttaacaacgtaggtatcgtcggtccgtaggtaccagacaacgaaaccgtggaccgacggcctacccgacgtcctacctactagttcgtaccgttactacgacgcgacggcctacgtcgaccactcccgagacgtaggttacacgtggacgtaggtcgggtcgtaggactaggtaccttacacctcctaccacctactaccgaccgagtacgtcggacgtcgtagtaagtttacgtttaggacttagttacgtttagtttagttcgactagtactaggttagtcgggtactaccggtacctaaccggttacgtttaccggtttaccgggaccggtacgggttaaccgtacggtcggaaggtaagtacgtaacgtaaccgtacggtcggtacggttcgtaccgtaacctacgtacgttacgttactttaccgtacgtttacctcccgtccg

SEQ ID NO: 51345 - DNA, 859 bp, Homo sapiens
  misc_feature: GYAE6OF02F9UEQ.12.82.H05.1.454.CMB.1.raw
tcagatacgacgtacacgaccggtgctcgatttagtcgagctctctcgcggggagagctgctcagttaggaccccagagggaaccatggaaaccccagcgcagcttctcttcctcctgctactctggctcccagagaccaccggagaaattgtgttgacgcagtcctccacggcaccctgttctttatctccgaaggggaaagacgccaccctctcctgacgacgggcctaggtgaagaattacgttaaaccaacgaggtactcgtggtccgttcggtaccagacaacggaaacccgtcggacccgaacggccctaccccgacggtcccttacccgtacctagttacggttaacccgttttaacccttacccggtaacggacccggtaaccggggtaccccgtaaccggttaccgggccctaaccgttacccccggtaacggtaaccgttaccgggtttaccggtaacccggtcgggtaccgttaacggggtttccggggttacgggtaccggggtaacctaacggttaaccctttccgtacccttaccgtcccctaacctactacccgaacccgtagtacgtccggtaacgtaccgtaaggtaacgtttagttttacggttagtttagttacgtttacgttacgtacgtacgtacgtagttaggttgggtaacgtccgtaacccgtaccgtttacgttaccggttttaccggacccggttacggggtaacctacggtaccgttagggaacgtaacgtaaccggtaagacgttacgggttacggtaccgtacgtcctaaccgtacgttcccgttgtttacccgtttacgttccctttaccccggttaccccgttacccg

SEQ ID NO: 51346 - DNA, 815 bp, Homo sapiens
  misc_feature: GYAE6OF02HENQJ.12.82.H05.1.454.CMB.1.raw
  modified_base (166)..(166): a, c, t, g, unknown or other
  misc_feature (166)..(166): n is a, c, g, or t
  modified_base (184)..(184): a, c, t, g, unknown or other
  misc_feature (184)..(184): n is a, c, g, or t
  modified_base (215)..(215): a, c, t, g, unknown or other
  misc_feature (215)..(215): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagacgaccaccggagaaattgtgttgacgcagtcncaggcacctgtctttacnctaccgaaggggaaagagcccaccctctccngcacgggaccagtgagtaatagttaaacaacgaggtatcgtacggtaccgtaggtaaccagaccgaacgtaaacccgtggacccgtaggacctcccggacggtacctccctacaacttacctaagtacgtaacgtcgaccaacgtaaacccggaaaacgggtcccgaacgtacggaccctaacggtaccccgaacggtaccgtacggttacgacggtaggaccgtaaggggttcggggtacgggtacgggggtactaacgtaccgtttaccaaccgttacctaccgaaccgtaacgtcctaacggcaacggtaccgtaaagacggtccgtaagggttaaagtttacgtttacggacgtttaaacgttttacttaacggttacgttaacgagttaccgaacggtcgtaaaccgtacgtaacggtccggtaccccgttttaggttaaccttacgggtttaccgggaacccgggttaaaccggaacgttaaacggaccgggttaggtaaccgtaaccgttaaaacctaaaccgggttacgttcgggtacggtaagttacccgaacgttaacccttaggttcccgttacgttacccgttaaccg

SEQ ID NO: 51347 - DNA, 857 bp, Homo sapiens
  misc_feature: GYAE6OF02GE000.12.82.H05.1.454.CMB.1.raw
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctcaggcaccctgtctttatctccgaaggggaaagacgccaccctctccgtgccgacgggccaggtgaagaattacggttaaacaacgtaaggttactcgtcgggtcccgttacgggtaacccacggaccgaaacggtaaaccccgttcgggaccccgaacgggtccccgttacccccggaagggtccccttaacccccgtccgtaacgtttaccggtttaccccgttttaaaccgtttacccgaacgggtaccggaccggggtaccccgtacggtcgggacccttaaccgtaccccgaaggtaaccgttacgggttacctaaccggtgggtccgtaaggggttcggggttacgtaacgggggaacctaacggttacctttcgaaccttcctaaccaccctaacgacccgaaccgtacgtacggtacggtaccgaccgtaggtaaagttcgtttacgacgttagttaagtttacgttacgttacggtacgacggtagttaacgttaggtcgggtaaccgtcggacccgttaacgttaccgtttacgggtttacggaccgggtacgggttacgaacggtcgtaggtagttaacggtagggtaaacccttaggtacgggtacggttaccgaccggtacctaaccgtttcgttaccggttcctttaccgtttacgtcccgtttacccgttaccccgg

SEQ ID NO: 51348 - DNA, 695 bp, Homo sapiens
  misc_feature: GYAE6OF02FZNRQ.12.82.H05.1.454.CMB.1.raw
  modified_base (199)..(199): a, c, t, g, unknown or other
  misc_feature (199)..(199): n is a, c, g, or t
  modified_base (229)..(229): a, c, t, g, unknown or other
  misc_feature (229)..(229): n is a, c, g, or t
  modified_base (488)..(488): a, c, t, g, unknown or other
  misc_feature (488)..(488): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagacgaccaccggagaaattgtgttgacgcagtctccaggcaccctgtctttatctccgaggggaaangcccacctctccgtgcgagggccagtgaanagtaggttaacaagaggtatcgtcggacctcggtaaccacgacaacggtaaacctggaccacgggtccttaccccgaggtccttacctacagttacggttaacgtttacctacgacgcgaacgggtccacgttcggacctacgtcccgaagacgtacggtttacacgtcggacgtagggttcggtacggtaggactacgttacgtctacgtctaccgaccactccgaaccgtagacgtacggactccgtagtaacgttntttacgcgtagttattacgttctggtcaagcttaggttagtcgtagtccgaccgtacggttacttcggtttcgggaccggttacggtaccgagtcggtagtaccgtagaaccgggtaatacggttacggtaccggtacgtaaccggttccctaaacggttcctttacggtaccggtttacctccggttaccttccccgttaacccgg

SEQ ID NO: 51349 - DNA, 675 bp, Homo sapiens
  misc_feature: GYAE6OF02FYYYZ.12.82.H05.1.454.CMB.1.raw
  modified_base (199)..(199): a, c, t, g, unknown or other
  misc_feature (199)..(199): n is a, c, g, or t
tcagatacgacgtacacgaccggtgctcgatttagtcgagctctctcgcgggggagagctgctcagttaggacccagagggaaccatggaaaccccagcgcagcttctcttcctcctgctactctggctcccagagaccaccggagaaattgtgttgacgcagtctccaggcaccctgtctttatctccgaggggaaangccaccctctcctgcagggccagtgagaatgttaacacaggtatctggcctggaccagcaacgaaacctggccaggcctcccaggtcctccgtcagttacgttaccgttacttccgagccgacgggcccacgtcggacactcccagtacaggttcacgtggactaggtggtcgtagggactaacggtctttaccgacttctaccacacgtccaaccgagtacgtggacgtacgtagtaacgttagttttgactagttagttatttagttgttacgtaagtcgtaaggttacgtacggtacgaccgtaccgtaaccgttaccgttacgttttaccgggaccggtaacggggttccgtaagtaccggttaggtaaccgtaggtaacggtaaacggtaccgttagggtacggttacgtacgtacccgtaccgtacgttccggttacgtttccgttaccgttacgtttccccgtaacccg

SEQ ID NO: 51350 - DNA, 711 bp, Homo sapiens
  misc_feature: GYAE6OF02HBDSC.12.82.H05.1.454.CMB.1.raw
  modified_base (184)..(184): a, c, t, g, unknown or other
  misc_feature (184)..(184): n is a, c, g, or t
  modified_base (197)..(197): a, c, t, g, unknown or other
  misc_feature (197)..(197): n is a, c, g, or t
  modified_base (299)..(299): a, c, t, g, unknown or other
  misc_feature (299)..(299): n is a, c, g, or t
  modified_base (549)..(549): a, c, t, g, unknown or other
  misc_feature (549)..(549): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttanctccgaggggaangcccaccctctcctgcagggccagtgagaatgttaacaacgaggtatcgtggcctgggtaccagccaagaaaccgtggaccaggccctaccaggcctcctanagttgtacctttacttccgagccgacgggtccacgtcggacacctcccgaagaccgtaggttaccacgttcggacgtaggtttcgggtccggtacggggaacacggtacctttcaacccgttctccgaaccctattcccgaacccgaggtaccgttagggacgtaccgttagtaaacgttagttttcggaacgtaggtttacgttaagttttagttcggttacaacgtcgttaggttagtacggggttanccggtaccgtaaccgttaccgttacgtttccggggaaccggtaggggtaccctaagggtccgtagggtacgtacgtacggtaaaccgtacggttcggaccggtaccgtcggaactaccgtacgttcgttacgttcccttaccttaccgttacccgttccccg

SEQ ID NO: 51351 - DNA, 654 bp, Homo sapiens
  misc_feature: GYAE6OF02HGFKM.12.82.H05.1.454.CMB.1.raw
  modified_base (198)..(198): a, c, t, g, unknown or other
  misc_feature (198)..(198): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccgaggggaaancgccaccctctcctgcagggccagtgagaatgttaacagatactagcctaggtaccagcagagtaccgtggccaggcctccgaggcctacctgactctagtgtaactactagttaggaacggtacggcctacgtgggacctactcgtacgacggacgtaagtacttaccgaaggttcggactaagggttcggtaccgtaggggacctaggtacccttcgtaaccttccgtaccgtacccctacgtaccgaccgtacccgtaacgacgtcccgtaacggtagttacgttttaaggtaacttttagtacttagtaactaacgtgtacgtactacgtacgtccgtcctaccgtacgttaccgggacggacggtaacgtaggtcgagacttacgaggtacgtaacggtggtacgcgtacgtcctaacgtcttcgtcgttacttccgtacttcccgtcccg

SEQ ID NO: 51352 - DNA, 741 bp, Homo sapiens
  misc_feature: GYAE6OF02IHXMG.12.82.H05.1.454.CMB.1.raw
  modified_base (195)..(195): a, c, t, g, unknown or other
  misc_feature (195)..(195): n is a, c, g, or t
  modified_base (693)..(693): a, c, t, g, unknown or other
  misc_feature (693)..(693): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctcaggcaccctgtcttatctccgagggaaanacgccaccctctcctgcgacggccagtgagatacgtaacaacgagtactcgtggcctaggtaccagacaacgtaaaccgtggaccgaggtccctaccgacggtcctcctactagttcgttaaccgtttacctccacggtcgacgggtaccacggtcggactaccgtcccaaggtaccgtacggtttaccgacgttacgggtaccgtacggggttacgggtccggtaacggggtaaacctagggttaaccccttcgtaaacccgttcctaccgaaaccctacgttaacccgaccgtaaacggtccggttacggaccgtaccgttaaggtaaacgttttacgttttacggacgttaggttacggttactttacgtttacgaccgttaacggtacgttaaggttacgttagggtacgaccgtacgttaccgttacgttcgtttcgggacggtacgggtaccagtcggtagacgtagtacgaaacgttacgtggtaccggtnaccgtacaaccgtgttacttccgttactacgtaccgttacccgtcccg

SEQ ID NO: 51353 - DNA, 819 bp, Homo sapiens
  misc_feature: GYAE6OF02FJO5P.12.82.H05.1.454.CMB.1.raw
  modified_base (342)..(342): a, c, t, g, unknown or other
  misc_feature (342)..(342): n is a, c, g, or t
  modified_base (439)..(439): a, c, t, g, unknown or other
  misc_feature (439)..(439): n is a, c, g, or t
  modified_base (771)..(771): a, c, t, g, unknown or other
  misc_feature (771)..(771): n is a, c, g, or t
tcagatacgacgtacacgaccggtgctcgatttagtcgagctctctcgcggggagagctgctcagttaggacccagagggaacatggaaaccccagcgcagcttctcttcctctgctctctggctccagagaccaccggagaaatttgtgttcggaccgctagttcctccgacggccacccttgttctttttactcctaccggaaggggaaagacgcccacccttctccgtcgacgacgggtccagtacggaagtaattacgttaaacaacgtaggtactcgtacggtcctacggtaaccacgacaacgaaccgtcggaccgacgtccctaccgacggtccnccgttactacgttaccgttaccgtttacctacgtacggccgacgggtaccctacggtcgtaccgccaaccccgtaggtaaccgttacgggtttaccncggttacggacggttacggggttggtacccgggttaggaccgtacgttacccgtttcctaaccgttaccgtacctaaccgtcctaacccggacctaacggtaaccgttcgggaccgttacgtaaagtttacgtttaacgttcggtaacgtgtttaagtttaactttacggtccggttataaccgtgtaacggttcggtacggttccggaaccgttaacccgtttaacgtaccgtttaagggtttccccggtacgggtaacgggttcctacggtacggttagaacggttaacgtaacgaacgggtttcgtcggtaaccggccctacggtaccnccgttttaacggttccttacgtttacccttcgtaccctttccccgccg

SEQ ID NO: 51354 - DNA, 719 bp, Homo sapiens
  misc_feature: GYAE6OF02IA5MZ.12.82.H05.1.454.CMB.1.raw
  modified_base (200)..(200): a, c, t, g, unknown or other
  misc_feature (200)..(200): n is a, c, g, or t
  modified_base (219)..(219): a, c, t, g, unknown or other
  misc_feature (219)..(219): n is a, c, g, or t
  modified_base (228)..(228): a, c, t, g, unknown or other
  misc_feature (228)..(228): n is a, c, g, or t
  modified_base (677)..(677): a, c, t, g, unknown or other
  misc_feature (677)..(677): n is a, c, g, or t
tcagatacgacgtacacgaccggtgctcgatttagtcgagctctctcgcggggagagctgctcagttaggacccagagggaaccatcggaaacccagcgcagcttctcttcctctgctactctggctccagacgaccaccggagaaattgtgttgacgcagtcctccaggccaccctgttctttatctacgaaggggaancgccaccctctcctgacgngggaccagngtagaatacgttaacaacgtagtactcgtcggtccgtacggtaccagacacgtaaaccgtggaccgcggacctcccgacggccttaccgtactacgttacggttaaccgtttacgtacccgtacggtaccggaccgggaccgtacgtacggaccgtacctaccgtacgacgttacgttacacggtcggacgtaggttcggtcgtacgggtaacagttaccgtactaccgttacctaccgtaaccctaacgtacccgaaccgaacgtccgggaacggttaccgacggtttaaggtaaacgtttcgtttacggactttaggttacgttaaatttggtacgtacggagttacgttagtacgtttacggcgtaccgttaccgttaaccgttacgtttcgttaccggggaccgtacgggttacaacggtggagtagacgtacgaacgttacggngtacgtagccgtacacctgtctccgttatcttacctctaccg

SEQ ID NO: 51355 - DNA, 779 bp, Homo sapiens
  misc_feature: GYAE6OF02FYRCL.12.82.H05.1.454.CMB.1.raw
  modified_base (191)..(191): a, c, t, g, unknown or other
  misc_feature (191)..(191): n is a, c, g, or t
  modified_base (492)..(492): a, c, t, g, unknown or other
  misc_feature (492)..(492): n is a, c, g, or t
  modified_base (524)..(524): a, c, t, g, unknown or other
  misc_feature (524)..(524): n is a, c, g, or t
tcagatacgacgtacacgaccggtgctcgatttagtcgagctctctcgcggggagagctgctcagttaggacccagagggaaccatggaacccagcgcagcttctcttcctcctgctactctggctccagagaccacggagaattgtgttgacgcagtctcaggcaccctgtcttatcctcgaggggaaancgccaccctctccgtgccggacggcctagtaggaacgtaactacgttaaaaccaacgtaagggttactacgtcgggtaccctacgggaacccaggtaccgaaacgtaaccggtcggaccgaacggcctacccggacggtcctacctagacgttcggttaaccgttccttaccgaggaccgtacgggccctaggtccggaccaaccggtcccgaagtaaccggtacggttcctaacggggcgaacggttcggggtcgggtacgtacgggtaaacgtaccgggttaacttcccgtaacttccnccgtaaacctcgtaaccgaccgtacggtacgngtaccgacgtaagtaacgttacgtttcgagtaacgttcggttaactttacggttacctaggttaccgacgttaaggttacggtacgggttacggaccgtaccgttaaccgtaccggtttaccggtttacccgggtacgggtaccgggttaccgacggttagaggttaacgcgttaagggaaccgtggttacgggcgtaccgtacggtcccttaaacggcttcgttaccggttactacccgttacctccggtaccc

SEQ ID NO: 51356 - DNA, 699 bp, Homo sapiens
  misc_feature: GYAE6OF02GI7S5.12.82.H05.1.454.CMB.1.raw
  modified_base (185)..(185): a, c, t, g, unknown or other
  misc_feature (185)..(185): n is a, c, g, or t
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (225)..(225): a, c, t, g, unknown or other
  misc_feature (225)..(225): n is a, c, g, or t
tcagatacgacgtacacgaccggtgctcgatttagtcgagctctctcgcggggagagctgctcagttaggacccagagggaaccatggaaaccccagcgcagcttctcttcctcctgctactctggctcccagagaccaccggagaaatttgtgttgacgcagtctccaggcaccctgtctttanctccgagggaaangccaccctntcctgcagggccagtganaatgttaacaacgaggtatcgtggtcctagggtaccagcaagtaaaccgtcgaccgaaggcctacccgaggccttccactacgtacgttaacggttaccttcgaagccgacgggcctacgtaggactacgtcccaagtacgtagttcacgtggactagggtcggtacgtgggactaggtactttcgactctaccaactataccgacgtagtacctggaacgacccgttagaacggttaagttttccgagttaaggtagttaacgtttacgttgggtacctagtacggttaattagtacgggtactcggtaacctaccggttacttacgtttacggacccggttaacgggttccgaaagtccggttaaggagtaaccgttacggaaaccggttactacgggttccgaacggtcgtaacccgttaccgtagttacccgttacggtttacccttaccggtacttaccccgttacccg

SEQ ID NO: 51357 - DNA, 826 bp, Homo sapiens
  misc_feature: GYAE6OF02FSVPB.12.82.H05.1.454.CMB.1.raw
  modified_base (117)..(117): a, c, t, g, unknown or other
  misc_feature (117)..(117): n is a, c, g, or t
  modified_base (142)..(142): a, c, t, g, unknown or other
  misc_feature (142)..(142): n is a, c, g, or t
  modified_base (148)..(148): a, c, t, g, unknown or other
  misc_feature (148)..(148): n is a, c, g, or t
  modified_base (509)..(509): a, c, t, g, unknown or other
  misc_feature (509)..(509): n is a, c, g, or t
tcagatacgacgtacacgaccggtgctcgatttagtcgagctctctcgcggggagagctgctcagttaggacccagagggaaccatggaaaccccagcgcagcttctcttcctcctnctactctgctccagagaccacgganaattgngttgacgcacgtctccaggccaccctgttctttactcctccgaggggaaacacgcccaccctctcctggccgacggcctaagcggaagacgttacggtaaaactacgaggtactacgtcggtacctcgggtaccacgacgaacgaaacccggtccggaccgaacggtcccgtaaccccgtcggtacccctcctccttacgttacggttaacccgtttaccttaaccggcgtaaccggtcggtaccccgtacgttaccgggcctaaccgtaccccgaaggttccgtacggttacccgacgtacggtacgggtaacggttcggttacggtaacggcgttaaccgttgtaccctacgttacccnctaaccgtacctaccggacccgtaaggtaccgtacgtacccggagttaacggttaaacttccggttttagaaccgttagtttaagtttaccgttaaacggttcgtaaacggttcgtaacggtttccggtaaaggttccgggtaaagtccgtaaccggttaaccggtaccgtttaaccggttaccggacgggtaaccgttacgggtaaccgtccggttaagggtaaccgtaagttaaaccgtaccggtagttcggttacgaacgtaccgtaccctagtacgtttccggacttcggtttacccgtcttacccggtcccg

SEQ ID NO: 51358 - DNA, 210 bp, Homo sapiens
  misc_feature: GYAE6OF01DNU1V.4.7.A07.1.454.CMB.1.raw
  modified_base (210)..(210): a, c, t, g, unknown or other
  misc_feature (210)..(210): n is a, c, g, or t
tcagagcactgtagcacgaccggtgctcgatttagcacgtgtcgcaggggaggaactgctcagttaggacccagagggaaccatggaagccccagctcagcttctcttcctcctgctactctggctcccaggaactgtggctgcaccatctgtcttcatcttcccgccatctgactacagtgctctgagcgggctggcaaggcgcatagn

SEQ ID NO: 51359 - DNA, 213 bp, Homo sapiens
  misc_feature: GYAE6OF01BQA80.4.7.A07.1.454.CMB.1.raw
  modified_base (210)..(213): a, c, t, g, unknown or other
  misc_feature (210)..(213): n is a, c, g, or t
tcagagcactgtagcacgaccggtgctcgatttagcacgtgtcgcaggggaggaactgctcagttaggacccagagggaaccatggaagccccagctcagcttctcttcctcctgctactctggctcccaggaactgtggctgcaccatctgtcttcatcttcccgccatctgactacagtgctctgagcgggctggcaaggcgcatagnnnn

SEQ ID NO: 51360 - DNA, 211 bp, Homo sapiens
  misc_feature: GYAE6OF01C2B2Y.4.7.A07.1.454.CMB.1.raw
  modified_base (210)..(211): a, c, t, g, unknown or other
  misc_feature (210)..(211): n is a, c, g, or t
tcagagcactgtagcacgaccggtgctcgatttagcacgtgtcgcaggggaggaactgctcagttaggacccagagggaaccatggaagccccagctcagcttctcttcctcctgctactctggctcccaggaactgtggctgcaccatctgtcttcatcttcccgccatctgactacagtgctctgagcgggctggcaaggcgcatagnn

SEQ ID NO: 51361 - DNA, 217 bp, Homo sapiens
  misc_feature: GYAE6OF01A6R58.4.7.A07.1.454.CMB.1.raw
  modified_base (208)..(217): a, c, t, g, unknown or other
  misc_feature (208)..(217): n is a, c, g, or t
tcagagcactgtagcacgaccggtgctcgatttagcacgtgtcgcgaggggaggaactgctcagttaggacccagagggaaccatggaagccccagctcagcttctcttcctcctgctactctggctccaggactgtggctgcaccatctgtcttcatcttcccgcatctgactacagtgctctgagcgggctggcaaggcgcatagnnnnnnnnnn

SEQ ID NO: 51362 - DNA, 256 bp, Homo sapiens
  misc_feature: GYAE6OF01DJERD.4.7.A07.1.454.CMB.1.raw
  modified_base (184)..(184): a, c, t, g, unknown or other
  misc_feature (184)..(184): n is a, c, g, or t
  modified_base (195)..(195): a, c, t, g, unknown or other
  misc_feature (195)..(195): n is a, c, g, or t
  modified_base (235)..(235): a, c, t, g, unknown or other
  misc_feature (235)..(235): n is a, c, g, or t
  modified_base (238)..(256): a, c, t, g, unknown or other
  misc_feature (238)..(256): n is a, c, g, or t
tcagagcactgtagcacgaccggtgctcgatttagcacgtgtcgcgaggggagaactgctcagttaggacccagagggaaccatggaagcccagctcagcttctcttcctcctgctactctggcctcccgaggtaactgtggctcgcaccattcctgttccttcactccgttcccgcctagtcnggacctaacgngtcgctcgtggacggcgggctaggaccgaagggtcacaanggnnnnnnnnnnnnnnnnnnn

SEQ ID NO: 51363 - DNA, 209 bp, Homo sapiens
  misc_feature: GYAE6OF02GSTAV.4.7.A07.1.454.CMB.1.raw
  modified_base (207)..(209): a, c, t, g, unknown or other
  misc_feature (207)..(209): n is a, c, g, or t
tcagagcactgtagcacgaccggtgctcgatttagcacgtgtcgcagggaggaactgctcagttaggacccagagggaaccatggaagcccagctcagcttctcttcctcctgctactctggctccaggaactgtggctgcaccatctgtcttcatcttcccgccatctgactacagtgctctgagcgggctggcaaggcgcatagnnn

SEQ ID NO: 51364 - DNA, 215 bp, Homo sapiens
  misc_feature: GYAE6OF02FXV93.4.7.A07.1.454.CMB.1.raw
  modified_base (210)..(215): a, c, t, g, unknown or other
  misc_feature (210)..(215): n is a, c, g, or t
tcagagcactgtagcacgaccggtgctcgatttagcacgtgtcgcaggggaggaactgctcagttaggacccagagggaaccatggaagccccagctcagcttctcttcctcctgctactctggctcccaggaactgtggctgcaccatctgtcttcatcttcccgccatctgactacagtgctctgagcgggctggcaaggcgcatagnnnnnn

SEQ ID NO: 51365 - DNA, 288 bp, Homo sapiens
  misc_feature: GYAE6OF01EDN3S.14.22.B11.1.454.CMB.1.raw
  modified_base (286)..(288): a, c, t, g, unknown or other
  misc_feature (286)..(288): n is a, c, g, or t
tcagcgtctagtaccacgaccggtgctcgatttagacgacagctcagggattcctgaccgattctctggctccaagtctggcacgtcagccaccctgggcatcaccggactcctgactggggacgaggccgattattactgcggaacatgggatagtggcctaagtgtggggtgttcggcggagggaccaggctgaccgtcctaggtcagcccaaggctgcccctcggtcactctgttcccaccctcctcgtatctctcgctgagcgggctggcaaggcgcatagnnn

SEQ ID NO: 51366 - DNA, 289 bp, Homo sapiens
  misc_feature: GYAE6OF01BZ9RV.14.22.B11.1.454.CMB.1.raw
  modified_base (284)..(289): a, c, t, g, unknown or other
  misc_feature (284)..(289): n is a, c, g, or t
tcagcgtctagtaccacgaccggtgctcgatttagacgacagctcagggattcctgaccgattctctggctccaagtctggcacgtcagccaccctgggcatcaccggactcctgactgggacgaggccgattattactgcggaacatgggatagtggcctaagtgtggggtgttcggcggagggaccaggctgaccgtcctaggtcagcccaaggctgccccctggtcactctgttcccacctcctcgtactagacgctgagcgggctggcaaggcgcatagnnnnnn

SEQ ID NO: 51367 - DNA, 291 bp, Homo sapiens
  misc_feature: GYAE6OF01DI9HZ.14.22.B11.1.454.CMB.1.raw
  modified_base (287)..(291): a, c, t, g, unknown or other
  misc_feature (287)..(291): n is a, c, g, or t
tcagcgtctagtaccacgaccggtgctcgatttagacgacagctcagggattcctgaccgattctctggctccaagtctggcacgtcagccaccctgggcatcaccggactcctgactggggacgaggccgattattactgcggaacatgggatagtggcctaagtgtggggtgttcggcggagggaccaggctgaccgtcctaggtcagcccaaggctgccccctcggtcactctgttcccgccctcctcgtatctctcgctgagcgggctggcaaggcgcatagnnnnn

SEQ ID NO: 51368 - DNA, 291 bp, Homo sapiens
  misc_feature: GYAE6OF01CQVZ2.14.22.B11.1.454.CMB.1.raw
  modified_base (287)..(291): a, c, t, g, unknown or other
  misc_feature (287)..(291): n is a, c, g, or t
tcagcgtctagtaccacgaccggtgctcgatttagacgacagctcagggattcctgaccgattctctggctccaagtctggcacgtcagccaccctgggcatcaccggactcctgactggggacgaggccgattattactgcggaacatgggatagtggcctaagtgtgggggtgttcggcggagggaccaggctgaccgtcctaggtcagcccaaggctgccccctcggtcactctgttcccgcctcctcgtactagacgctgagcgggctggcaaggcgcatagnnnnn

SEQ ID NO: 51369 - DNA, 291 bp, Homo sapiens
  misc_feature: GYAE6OF01AVEIK.14.22.B11.1.454.CMB.1.raw
  modified_base (287)..(291): a, c, t, g, unknown or other
  misc_feature (287)..(291): n is a, c, g, or t
tcagcgtctagtaccacgaccggtgctcgatttagacgacagctcagggattcctgaccgattctctggctccaagtctggcacgtcagccaccctgggcatcaccggactcctgactggggacgaggccgattattactgcggaacatgggatagtggcctaagtgtgggggtgttcggcggagggaccaggctgaccgtcctaggtcagcccaaggctgccccctggtcactctgttcccgccctcctcgtatctctcgctgagcgggctggcaaggcgcatagnnnnn

SEQ ID NO: 51370 - DNA, 293 bp, Homo sapiens
  misc_feature: GYAE6OF01DQ4O9.14.22.B11.1.454.CMB.1.raw
  modified_base (285)..(293): a, c, t, g, unknown or other
  misc_feature (285)..(293): n is a, c, g, or t
tcagcgtctagtaccacgaccggtgctcgatttagacgacagctcagggattcctgaccgattctctggctccaagtctggcacgtcagccaccctgggcatcaccggactcctgactggggacgaggccgattattactgcggaacatgggatagtggcctaagtgtggggtgttcggcggagggaccaggctgaccgtcctaggtcagcccaaggctgccccctggtcactctgttcccacctcctcgtatctctcgctgagcgggctggcaaggcgcatagnnnnnnnnn

SEQ ID NO: 51371 - DNA, 292 bp, Homo sapiens
  misc_feature: GYAE6OF01D20HY.14.22.B11.1.454.CMB.1.raw
  modified_base (287)..(292): a, c, t, g, unknown or other
  misc_feature (287)..(292): n is a, c, g, or t
tcagcgtctagtaccacgaccggtgctcgatttagacgacagctcagggattcctgaccgattctctggctccaagtctggcacgtcagccaccctgggcatcaccggactcctgactggggacgaggccgattattactgcggaacatgggatagtggcctaagtgtggggtgttcggcggagggaccaggctgaccgtcctaggtcagcccaaggctgccccctcggtcactctgttcccaccctcctcgtactagacgctgagcgggctggcaaggcgcatagnnnnnn

SEQ ID NO: 51372 - DNA, 290 bp, Homo sapiens
  misc_feature: GYAE6OF01C1NZ2.14.22.B11.1.454.CMB.1.raw
  modified_base (287)..(290): a, c, t, g, unknown or other
  misc_feature (287)..(290): n is a, c, g, or t
tcagcgtctagtaccacgaccggtgctcgatttagacgacagctcagggattcctgaccgattctctggctccaagtctggcacgtcagccaccctgggcatcaccggactcctgactggggacgaggccgattattactgcggaacatgggatagtggcctaagtgtggggtgttcggcggagggaccaggctgaccgtcctaggtcagcccaaggctgccccctggtcactctcgttcccgccctcctcgtactagacgctgagcgggctggcaaggcgcatagnnnn

SEQ ID NO: 51373 - DNA, 289 bp, Homo sapiens
  misc_feature: GYAE6OF01EDQJF.14.22.B11.1.454.CMB.1.raw
  modified_base (281)..(281): a, c, t, g, unknown or other
  misc_feature (281)..(281): n is a, c, g, or t
  modified_base (287)..(289): a, c, t, g, unknown or other
  misc_feature (287)..(289): n is a, c, g, or t
tcagcgtctagtaccacgaccggtgctcgatttagacgacagctcagggattcctgaccgattctctggctccaagtctggcacgtcagccaccctgggcatcaccggactcctgactggggacgaggccgattattactgcggaacatgggatagtggcctaagtgtgggggtgttcggcggagggaccaggctgaccgtcctaggtcagcccaaggctgcccctggtcactctgttccccaccctcctcgtactagacgctgagcgggctggcaaggcncatagnnn

SEQ ID NO: 51374 - DNA, 290 bp, Homo sapiens
  misc_feature: GYAE6OF01CGPT3.14.22.B11.1.454.CMB.1.raw
  modified_base (288)..(290): a, c, t, g, unknown or other
  misc_feature (288)..(290): n is a, c, g, or t
tcagcgtctagtaccacgaccggtgctcgatttagacgacagctcagggattcctgaccgattctctggctccaagtctggcacgtcagccaccctgggcatcaccggactcctgactggggacgaggccgattattactgcggaacatgggatagtggcctaagtgtgggggtgttcggcggagggaccaggctgaccgtcctaggtcagcccaaggctgccccctcggtcactctgttcccaccctcctcgtactagacgctgagcgggctggcaaggcgcatagnnn

SEQ ID NO: 51375 - DNA, 290 bp, Homo sapiens
  misc_feature: GYAE6OF01AMW69.14.22.B11.1.454.CMB.1.raw
  modified_base (287)..(290): a, c, t, g, unknown or other
  misc_feature (287)..(290): n is a, c, g, or t
tcagcgtctagtaccacgaccggtgctcgatttagacgacagctcagggattcctgaccgattctctggctccaagtctggcacgtcagccaccctgggcatcaccggactcctgactggggacgaggccgattattactgcggaacatgggatagtggcctaagtgtggggtgttcggcggagggaccaggctgaccgtcctaggtcagcccaaggctgccccctcggtcactctgttcccgccctcctcgtactagacgctgagcgggctggcaaggcgcatagnnnn

SEQ ID NO: 51376 - DNA, 316 bp, Homo sapiens
  misc_feature: GYAE6OF01BD5KG.14.22.B11.1.454.CMB.1.raw
  modified_base (180)..(180): a, c, t, g, unknown or other
  misc_feature (180)..(180): n is a, c, g, or t
  modified_base (286)..(288): a, c, t, g, unknown or other
  misc_feature (286)..(288): n is a, c, g, or t
  modified_base (290)..(316): a, c, t, g, unknown or other
  misc_feature (290)..(316): n is a, c, g, or t
tcagcgtctagtaccacgaccggtgctcgatttagacgacagctcagggattcctgaccggattctctggctccaagtctggcacgtcagccaccctgggcatcaccggactcctgactggggacgaggccgattattactgcgaacagtggatagtggcctaagtgtggggtgttcggnggaggaccaggctgaccgtcctaggtcagcccaaggcctcgccccctggtcactctgttcccaccctcctcgtactagacgctgagcggctggcaaggcgcatagnnncnnnnnnnnnnnnnnnnnnnnnnnnnnn

SEQ ID NO: 51377 - DNA, 292 bp, Homo sapiens
  misc_feature: GYAE6OF01BKNG3.14.22.B11.1.454.CMB.1.raw
  modified_base (288)..(292): a, c, t, g, unknown or other
  misc_feature (288)..(292): n is a, c, g, or t
tcagcgtctagtaccacgaccggtgctcgatttagacgacagctcagggattcctgaccgattctctggctccaagtctggcacgtcagccaccctgggcatcaccggactcctgactggggacgaggccgattattactgcggaacatgggatagtggcctaagtgtggggtgttcggcggagggaccaggctgaccgtcctaggtcacgcccaaggctcgccccctggtcactctcgttcccaccctcctcgtactagacgctgagcggctggcaaggcgcatagnnnnn

SEQ ID NO: 51378 - DNA, 291 bp, Homo sapiens
  misc_feature: GYAE6OF01BZDN9.14.22.B11.1.454.CMB.1.raw
  modified_base (286)..(291): a, c, t, g, unknown or other
  misc_feature (286)..(291): n is a, c, g, or t
tcagcgtctagtaccacgaccggtgctcgatttagacgacagctcagggattcctgaccgattctctggctccaagtctggcacgtcagccaccctgggcatcaccggactcctgactggggacgaggccgattattactgcggaacatgggatagtggcctaagtgtggggtgttcggcggagggaccaagctgaccgtcctaggtcagcccaaggctgccccctggtcactctgttcccgccctcctcgtatctctcgctgagcgggctggcaaggcgcatagnnnnnn

SEQ ID NO: 51379 - DNA, 288 bp, Homo sapiens
  misc_feature: GYAE6OF01CT4NX.14.22.B11.1.454.CMB.1.raw
  modified_base (285)..(288): a, c, t, g, unknown or other
  misc_feature (285)..(288): n is a, c, g, or t
tcagcgtctagtaccacgaccggtgctcgatttagacgacagctcagggattcctgaccgattctctggctccaagtctggcacgtcagccaccctgggcatcaccggactcctgactggggacgaggccgattattactgcggaacatgggatagtggcctaagtgtggggtgttcggcggagggaccaggctgaccgtctaggtcagcccaaggctcgcccctggtcactctcgttcccgcctacctcgtactagacgctgagcggctggcaaggcacatagnnnn

SEQ ID NO: 51380 - DNA, 289 bp, Homo sapiens
  misc_feature: GYAE6OF01DVN3X.14.22.B11.1.454.CMB.1.raw
  modified_base (288)..(289): a, c, t, g, unknown or other
  misc_feature (288)..(289): n is a, c, g, or t
tcagcgtctagtaccacgaccggtgctcgatttagacgacagctcagggattcctgaccgattctctggctccaagtctggcacgtcagccaccctgggcatcaccggactcctgactggggacgaggccgattattactgcggaacatgggatagtggcctaagtgtgggggtgttcggcggagggaccaggctgaccgtctaggtcagcccaaggctcgccccctggtcacttcgttccccaccctcctcgtactagacgctgagcgggctggcaaggcgcatagnn

SEQ ID NO: 51381 - DNA, 295 bp, Homo sapiens
  misc_feature: GYAE6OF01BDIEP.14.22.B11.1.454.CMB.1.raw
  modified_base (287)..(295): a, c, t, g, unknown or other
  misc_feature (287)..(295): n is a, c, g, or t
tcagcgtctagtaccacgaccggtgctcgatttagacgacagctcagggattcctgaccgattctctggctccaagtctggcacgtcagccaccctgggcatcaccggactcctgactggggacgaggccgattattactgcggaacatgggatagtggcctaagtgtggggtgttcggcggagggaccaggctgaccgtcctaggtcagcccaaggctgccccctcggtcactctgttcccgccctcctcgtactagacgctgagcgggctggcaaggcgcatagnnnnnnnnn

SEQ ID NO: 51382 - DNA, 292 bp, Homo sapiens
  misc_feature: GYAE6OF01DCH3J.14.22.B11.1.454.CMB.1.raw
  modified_base (287)..(292): a, c, t, g, unknown or other
  misc_feature (287)..(292): n is a, c, g, or t
tcagcgtctagtaccacgaccggtgctcgatttagacgacagctcagggattcctgaccgattctctggctccaagtctggcacgtcagccaccctgggcatcaccggactcctgactggggacgaggccgattattactgcggaacatgggatagtggcctaagtggtgggggttgttcggcggagggaccaggctgccgtctaggtcacgccaaggctcgcccctgtcactctcgtcccgccctcctcgtactgacgctgacgcggctggacaaggcgacatagnnnnnn

SEQ ID NO: 51383 - DNA, 293 bp, Homo sapiens
  misc_feature: GYAE6OF02I286S.14.22.B11.1.454.CMB.1.raw
  modified_base (288)..(293): a, c, t, g, unknown or other
  misc_feature (288)..(293): n is a, c, g, or t
tcagcgtctagtaccacgaccggtgctcgatttagacgacagctcagggattcctgaccgattctctggctccaagtctggcacgtcagccaccctgggcatcaccggactcctgactggggacgaggccgattattactgcggaacatgggatagtggcctaagtgtgggggtgttcggcggagggaccaggctgaccgtcctaggtcagcccaaggctgccccctcggtcactctgttcccgccctcctcgtactagacgctgagcgggctggcaaggcgcatagnnnnnn

SEQ ID NO: 51384 - DNA, 291 bp, Homo sapiens
  misc_feature: GYAE6OF02ITJQK.14.22.B11.1.454.CMB.1.raw
  modified_base (283)..(291): a, c, t, g, unknown or other
  misc_feature (283)..(291): n is a, c, g, or t
tcagcgtctagtaccacgaccggtgctcgatttagacgacagctcagggattcctgaccgattctctggctccaagtctggcacgtcagccaccctgggcatcaccggactcctgactgggacgaggccgattattactgcggaacatgggatagtggcctaagtgtggggtgttcggcggagggaccaggctgaccgtcctaggtcagcccaaggctgcccctggtcactctgttcccaccctcctcgtatctctcgctgagcggctggcaaggcgcatagnnnnnnnnn

SEQ ID NO: 51385 - DNA, 288 bp, Homo sapiens
  misc_feature: GYAE6OF02IKQF6.14.22.B11.1.454.CMB.1.raw
  modified_base (288)..(288): a, c, t, g, unknown or other
  misc_feature (288)..(288): n is a, c, g, or t
tcagcgtctagtaccacgaccggtgctcgatttagacgacagctcagggattcctgaccgattctctggctccaagtctggcacgtcagccaccctgggcatcaccggactcctgactggggacgaggccgattattactgcggaacatgggatagtggcctaagtgtgggggtgttcggcggagggaccaggctgaccgtcctaggtcagcccaaggctgccccctcggtcactctgttcccaccctcctcgtactagacgctgagcgggctggcaaggcgcatagn

SEQ ID NO: 51386 - DNA, 291 bp, Homo sapiens
  misc_feature: GYAE6OF02F00GQ.14.22.B11.1.454.CMB.1.raw
  modified_base (288)..(291): a, c, t, g, unknown or other
  misc_feature (288)..(291): n is a, c, g, or t
tcagcgtctagtaccacgaccggtgctcgatttagacgacagctcagggattcctgaccgattctctggctccaagtctggcacgtcagccaccctgggcatcaccggactcctgactggggacgaggccgattattactgcggaacatgggatagtggcctaagtgtgggggtgttcggcggagggaccaggctgaccgtcctaggtcagcccaaggctgccccctcggtcactctgttcccgccctcctcgtactagacgctgagcgggctggcaaggcgcatagnnnn

SEQ ID NO: 51387 - DNA, 289 bp, Homo sapiens
  misc_feature: GYAE6OF02IM34P.14.22.B11.1.454.CMB.1.raw
  modified_base (287)..(289): a, c, t, g, unknown or other
  misc_feature (287)..(289): n is a, c, g, or t
tcagcgtctagtaccacgaccggtgctcgatttagacgacagctcagggattcctgaccgattctctggctccaagtctggcacgtcagccaccctgggcatcaccggactcctgactggggacgaggccgattattactgcggaacatgggatagtggcctaagtgtgggggtgttcggcggagggaccaggctgaccgtcctaggtcagcccaaggctgccccctcggtcactctgttcccgccctcctcgtactagacgctgagcggctggcaaggcgcatagnnn

SEQ ID NO: 51388 - DNA, 291 bp, Homo sapiens; identical to SEQ ID NO: 51386
  misc_feature: GYAE6OF02GUIOU.14.22.B11.1.454.CMB.1.raw
  modified_base (288)..(291): a, c, t, g, unknown or other
  misc_feature (288)..(291): n is a, c, g, or t

SEQ ID NO: 51389 - DNA, 291 bp, Homo sapiens
  misc_feature: GYAE6OF02F3W27.14.22.B11.1.454.CMB.1.raw
  modified_base (287)..(291): a, c, t, g, unknown or other
  misc_feature (287)..(291): n is a, c, g, or t
tcagcgtctagtaccacgaccggtgctcgatttagacgacagctcagggattcctgaccgattctctggctccaagtctggcacgtcagccaccctgggcatcaccggactcctgactggggacgaggccgattattactgcggaacatgggatagtggcctaagtgtgggggtgttcggcggagggaccaggctgaccgtcctaggtcagcccaaggctgccccctcggtcactctgttcccaccctcctcgtatctctcgctgagcggctggcaaggcgcatagnnnnn

SEQ ID NO: 51390 - DNA, 291 bp, Homo sapiens
  misc_feature: GYAE6OF02G4M42.14.22.B11.1.454.CMB.1.raw
  modified_base (286)..(291): a, c, t, g, unknown or other
  misc_feature (286)..(291): n is a, c, g, or t
tcagcgtctagtaccacgaccggtgctcgatttagacgacagctcagggattcctgaccgattctctggctccaagtctggcacgtcagccaccctgggcatcaccggactcctgactggggacgaggccgattattactgcggaacatgggatagtggcctaagtgtgggggtgttcggcggagggaccaggctgaccgtcctaggtcagcccaaggctgccccctggtcactctgttcccaccctcctcgtactagacgctgagcggctggcaaggcgcatagnnnnnn

SEQ ID NO: 51391 - DNA, 326 bp, Homo sapiens
  misc_feature: GYAE6OF02IAAZ9.14.22.B11.1.454.CMB.1.raw
  modified_base (270)..(270): a, c, t, g, unknown or other
  misc_feature (270)..(270): n is a, c, g, or t
  modified_base (297)..(326): a, c, t, g, unknown or other
  misc_feature (297)..(326): n is a, c, g, or t
tcagcgtctagtaccacgaccggtgctcgatttagacgacagctcagggattcctgaccgattctctggctccaagtctggcacgtcagccaccctgggcatcaccggactcctgactggggacgaggccgattatactgcggaacagtgggatagtggcctaagtggtgggggtgttcggcggaggacaggctagaccgtcctaggtcacgaccctaaggctcgccccctaggtcacctctcgttccccaccctcctcgtactgactcngagcggctggacgaggccgatagtagnnnnnnnnnnnnnnnnnnnnnnnnnnnnnn

SEQ ID NO: 51392 - DNA, 293 bp, Homo sapiens
  misc_feature: GYAE6OF02G7ENK.14.22.B11.1.454.CMB.1.raw
  modified_base (281)..(281): a, c, t, g, unknown or other
  misc_feature (281)..(281): n is a, c, g, or t
  modified_base (288)..(293): a, c, t, g, unknown or other
  misc_feature (288)..(293): n is a, c, g, or t
tcagcgtctagtaccacgaccggtgctcgatttagacgacagctcagggattcctgaccgattctctggctccaagtctggcacgtcagccaccctgggcatcaccggactcctgactggggacgaggccgattattactgcggaacatgggatagtggcctaagtgtgggggtgttcggcggagggaccaggctgaccgtcctaggtcagcccaaggctgccccctggtcactctgtttccgccctcctcgtatctctcgctgagcgggctggcaaggcncgatagnnnnnn

SEQ ID NO: 51393 - DNA, 371 bp, Homo sapiens
  misc_feature: GYAE6OF02JWWJ7.14.22.B11.1.454.CMB.1.raw
  modified_base (143)..(143): a, c, t, g, unknown or other
  misc_feature (143)..(143): n is a, c, g, or t
  modified_base (187)..(187): a, c, t, g, unknown or other
  misc_feature (187)..(187): n is a, c, g, or t
  modified_base (317)..(317): a, c, t, g, unknown or other
  misc_feature (317)..(317): n is a, c, g, or t
  modified_base (320)..(320): a, c, t, g, unknown or other
  misc_feature (320)..(320): n is a, c, g, or t
  modified_base (323)..(323): a, c, t, g, unknown or other
  misc_feature (323)..(323): n is a, c, g, or t
  modified_base (326)..(329): a, c, t, g, unknown or other
  misc_feature (326)..(329): n is a, c, g, or t
  modified_base (331)..(333): a, c, t, g, unknown or other
  misc_feature (331)..(333): n is a, c, g, or t
  modified_base (336)..(371): a, c, t, g, unknown or other
  misc_feature (336)..(371): n is a, c, g, or t
tcagcgtctagtaccacgaccggtgctcgatttagacgacagctcagggattcctgaccgattctctggctccaagtctggcacgtcagcccaccctgggcatcaccggactcctgacgtggggacgaggccgattattacgngacggaacatgggatagtggcctaaagtggtgggggtgttcggngggagggaccagggctaggaccgtcgtaggtcacgcccaaagggcctcgccccctggtcactctcgttcccaccctcctcgtactacgaccgctaggacgcgggactgggacaaggggcacgtaataggnagnacngannnnannnagnnnnnnnnnnnnnnnnnnnnnnnnnnnnnnnnnnnn

SEQ ID NO: 51394 - DNA, 299 bp, Homo sapiens
  misc_feature: GYAE6OF02GOAPK.14.22.B11.1.454.CMB.1.raw
  modified_base (175)..(175): a, c, t, g, unknown or other
  misc_feature (175)..(175): n is a, c, g, or t
  modified_base (289)..(299): a, c, t, g, unknown or other
  misc_feature (289)..(299): n is a, c, g, or t
tcagcgtctagtaccacgaccggtgctcgatttagacgacagctcagggattcctgaccgattctctggctccaagtctggcacgtcagccaccctgggcatcaccggactcctgactggggacgaggccgattattactgcggaacatgggatagtggcctaagtgtgggggtnttcggcggagggaccaggctgaccgtcctaggtcagcccaaggctcgccccctggtcactctcgttcccgccctcctcgtactagacgctgagcgggctggcaaggcgcatagnnnnnnnnnnn

SEQ ID NO: 51395 - DNA, 201 bp, Homo sapiens
  misc_feature: GYAE6OF01EP7YI.29.72.G06.1.454.CMB.1.raw
  modified_base (190)..(201): a, c, t, g, unknown or other
  misc_feature (190)..(201): n is a, c, g, or t
tcagatagagtactcacgaccggtgctcgatttagctacgactgcaagggaaagggtgagatacctcgctgtggctcactttcggcggagggaccaaggtggacatcaaaggaactgtggctgcaccatctgtcttcatcttcccgccatctgatctctcgactctgagcgggctggcaaggcgcatagnnnnnnnnnnnn

SEQ ID NO: 51396 - DNA, 192 bp, Homo sapiens
  misc_feature: GYAE6OF01D8YYX.29.72.G06.1.454.CMB.1.raw
  modified_base (190)..(192): a, c, t, g, unknown or other
  misc_feature (190)..(192): n is a, c, g, or t
tcagatagagtactcacgaccggtgctcgatttagctacgactgcaagggaaagggtgagatacctcgctgtggctcactttcggcggagggaccaaggtggacatcaaaggaactgtggctgcaccatctgtcttcatcttcccgccatctgatctctcgactctgagcgggctggcaaggcgcatagnnn

SEQ ID NO: 51397 - DNA, 191 bp, Homo sapiens
  misc_feature: GYAE6OF01B1ZYQ.29.72.G06.1.454.CMB.1.raw
  modified_base (190)..(191): a, c, t, g, unknown or other
  misc_feature (190)..(191): n is a, c, g, or t
tcagatagagtactcacgaccggtgctcgatttagctacgactgcaagggaaagggtgagatacctcgctgtggctcactttcggcggagggaccaaggtggacatcaaaggaactgtggctgcaccatctgtcttcatcttcccgccatctgatctctcgactctgagcgggctggcaaggcgcatagnn

SEQ ID NO: 51398 - DNA, 190 bp, Homo sapiens
  misc_feature: GYAE6OF01CDXEV.29.72.G06.1.454.CMB.1.raw
  modified_base (190)..(190): a, c, t, g, unknown or other
  misc_feature (190)..(190): n is a, c, g, or t
tcagatagagtactcacgaccggtgctcgatttagctacgactgcaagggaaagggtgagatacctcgctgtggctcactttcggcggagggaccaaggtggacatcaaaggaactgtggctgcaccatctgtcttcatcttcccgccatctgatctctcgactctgagcgggctggcaaggcgcatagn

SEQ ID NO: 51399 - DNA, 191 bp, Homo sapiens; identical to SEQ ID NO: 51397
  misc_feature: GYAE6OF01EYJQO.29.72.G06.1.454.CMB.1.raw
  modified_base (190)..(191): a, c, t, g, unknown or other
  misc_feature (190)..(191): n is a, c, g, or t

SEQ ID NO: 51400 - DNA, 200 bp, Homo sapiens
  misc_feature: GYAE6OF01AUSNB.29.72.G06.1.454.CMB.1.raw
  modified_base (190)..(200): a, c, t, g, unknown or other
  misc_feature (190)..(200): n is a, c, g, or t
tcagatagagtactcacgaccggtgctcgatttagctacgactgcaagggaaagggtgagatacctcgctgtggctcactttcggcggagggaccaaggtggacatcaaaggaactgtggctgcaccatctgtcttcatcttcccgccatctgatctctcgactctgagcgggctggcaaggcgcatagnnnnnnnnnnn

SEQ ID NO: 51401 - DNA, 192 bp, Homo sapiens
  misc_feature: GYAE6OF01EPWGZ.29.72.G06.1.454.CMB.1.raw
  modified_base (189)..(192): a, c, t, g, unknown or other
  misc_feature (189)..(192): n is a, c, g, or t
tcagatagagtactcacgaccggtgctcgatttagctacgactgcaagggaaagggtgagatacctcgctgtggctcactttcggcggagggaccaaggtggacatcaaaggactgtggctgcaccatctgtcttcatcttcccgccatctgatctctcgactctgagcgggctggcaaggcgcatagnnnn

SEQ ID NO: 51402 - DNA, 189 bp, Homo sapiens
  misc_feature: GYAE6OF01CS65X.29.72.G06.1.454.CMB.1.raw
tcagatagagtactcacgaccggtgctcgatttagctacgactgcaagggaaagggtgagatacctcgctgtggctcactttcggcggagggaccaaggtggacatcaaaggaactgtggctgcaccatctgtcttcatcttcccgccatctgatctctcgactctgagcgggctggcaaggcgcatag

SEQ ID NO: 51403 - DNA, 189 bp, Homo sapiens
  misc_feature: GYAE6OF01E4FMS.29.72.G06.1.454.CMB.1.raw
  modified_base (189)..(189): a, c, t, g, unknown or other
  misc_feature (189)..(189): n is a, c, g, or t
tcagatagagtactcacgaccggtgctcgatttagctacgactgcaagggaagggtgagatacctcgctgtggctcactttcggcggagggaccaaggtggacatcaaaggaactgtggctgcaccatctgtcttcatcttcccgccatctgatctctcgactctgagcgggctggcaaggcgcatagn

SEQ ID NO: 51404 - DNA, 191 bp, Homo sapiens; identical to SEQ ID NO: 51397
  misc_feature: GYAE6OF01CTF7X.29.72.G06.1.454.CMB.1.raw
  modified_base (190)..(191): a, c, t, g, unknown or other
  misc_feature (190)..(191): n is a, c, g, or t

SEQ ID NO: 51405 - DNA, 190 bp, Homo sapiens; identical to SEQ ID NO: 51398
  misc_feature: GYAE6OF01CGH1Q.29.72.G06.1.454.CMB.1.raw
  modified_base (190)..(190): a, c, t, g, unknown or other
  misc_feature (190)..(190): n is a, c, g, or t

SEQ ID NO: 51406 - DNA, 192 bp, Homo sapiens; identical to SEQ ID NO: 51396
  misc_feature: GYAE6OF01BQS2L.29.72.G06.1.454.CMB.1.raw
  modified_base (190)..(192): a, c, t, g, unknown or other
  misc_feature (190)..(192): n is a, c, g, or t

SEQ ID NO: 51407 - DNA, 191 bp, Homo sapiens; identical to SEQ ID NO: 51397
  misc_feature: GYAE6OF01BKE3S.29.72.G06.1.454.CMB.1.raw
  modified_base (190)..(191): a, c, t, g, unknown or other
  misc_feature (190)..(191): n is a, c, g, or t

SEQ ID NO: 51408 - DNA, 194 bp, Homo sapiens
  misc_feature: GYAE6OF01BMVV1.29.72.G06.1.454.CMB.1.raw
  modified_base (189)..(194): a, c, t, g, unknown or other
  misc_feature (189)..(194): n is a, c, g, or t
tcagatagagtactcacgaccggtgctcgatttagctacgactgcaagggaaagggtgagatacctcgctgtggctcactttcggcggagggaccaaggtggacatcaaaggactgtggctgcaccatctgtcttcatcttcccgccatctgatctctcgactctgagcgggctggcaaggcgcatagnnnnnn

SEQ ID NO: 51409 - DNA, 191 bp, Homo sapiens; identical to SEQ ID NO: 51397
  misc_feature: GYAE6OF01A4AZA.29.72.G06.1.454.CMB.1.raw
  modified_base (190)..(191): a, c, t, g, unknown or other
  misc_feature (190)..(191): n is a, c, g, or t

SEQ ID NO: 51410 - DNA, 190 bp, Homo sapiens
  misc_feature: GYAE6OF01D9KQ9.29.72.G06.1.454.CMB.1.raw
  modified_base (189)..(190): a, c, t, g, unknown or other
  misc_feature (189)..(190): n is a, c, g, or t
tcagatagagtactcacgaccggtgctcgatttagctacgactgcaagggaaagggtgagatacctcgctgtggctcactttcggcggagggaccaaggtggacatcaaaggaactgtggctgcaccatctgtcttcatcttccgccatctgatctctcgactctgagcgggctggcaaggcgcatagnn

SEQ ID NO: 51411 - DNA, 191 bp, Homo sapiens; identical to SEQ ID NO: 51397
  misc_feature: GYAE6OF01A9QVF.29.72.G06.1.454.CMB.1.raw
  modified_base (190)..(191): a, c, t, g, unknown or other
  misc_feature (190)..(191): n is a, c, g, or t

SEQ ID NO: 51412 - DNA, 207 bp, Homo sapiens
  misc_feature: GYAE6OF01EDM7J.29.72.G06.1.454.CMB.1.raw
  modified_base (189)..(207): a, c, t, g, unknown or other
  misc_feature (189)..(207): n is a, c, g, or t
tcagatagagtactcacgaccggtgctcgatttagctacgactgcaagggaaagggtgagatacctcgctgtggctcactttcggcggagggaccaaggtggacatcaaaggactgtggctgcaccatctgtcttcatcttcccgccatctgatctctcgactctgagcgggctggcaaggcgcatagnnnnnnnnnnnnnnnnnnn

SEQ ID NO: 51413 - DNA, 192 bp, Homo sapiens; identical to SEQ ID NO: 51396
  misc_feature: GYAE6OF01EQSHB.29.72.G06.1.454.CMB.1.raw
  modified_base (190)..(192): a, c, t, g, unknown or other
  misc_feature (190)..(192): n is a, c, g, or t

SEQ ID NO: 51414 - DNA, 191 bp, Homo sapiens; identical to SEQ ID NO: 51397
  misc_feature: GYAE6OF01EGAIC.29.72.G06.1.454.CMB.1.raw
  modified_base (190)..(191): a, c, t, g, unknown or other
  misc_feature (190)..(191): n is a, c, g, or t

SEQ ID NO: 51415 - DNA, 192 bp, Homo sapiens
  misc_feature: GYAE6OF01BOOQ7.29.72.G06.1.454.CMB.1.raw
  modified_base (189)..(192): a, c, t, g, unknown or other
  misc_feature (189)..(192): n is a, c, g, or t
tcagatagagtactcacgaccggtgctcgatttagctacgactgcaagggaaaggtgagatacctcgctgtggctcactttcggcggagggaccaaggtggacatcaaaggaactgtggctgcaccatctgtcttcatcttcccgccatctgatctctcgactctgagcgggctggcaaggcgcatagnnnn

SEQ ID NO: 51416 - DNA, 191 bp, Homo sapiens; identical to SEQ ID NO: 51397
  misc_feature: GYAE6OF01A47OU.29.72.G06.1.454.CMB.1.raw
  modified_base (190)..(191): a, c, t, g, unknown or other
  misc_feature (190)..(191): n is a, c, g, or t

SEQ ID NO: 51417 - DNA, 190 bp, Homo sapiens; identical to SEQ ID NO: 51398
  misc_feature: GYAE6OF01BM3AQ.29.72.G06.1.454.CMB.1.raw
  modified_base (190)..(190): a, c, t, g, unknown or other
  misc_feature (190)..(190): n is a, c, g, or t

SEQ ID NO: 51418 - DNA, 192 bp, Homo sapiens; identical to SEQ ID NO: 51396
  misc_feature: GYAE6OF01DN0SF.29.72.G06.1.454.CMB.1.raw
  modified_base (190)..(192): a, c, t, g, unknown or other
  misc_feature (190)..(192): n is a, c, g, or t

SEQ ID NO: 51419 - DNA, 192 bp, Homo sapiens
  misc_feature: GYAE6OF01DEWB6.29.72.G06.1.454.CMB.1.raw
  modified_base (191)..(192): a, c, t, g, unknown or other
  misc_feature (191)..(192): n is a, c, g, or t
tcagatagagtactcacgaccggtgctcgatttagctacgactgcaagggaaagggtgagatacctcgctgtggctcactttcggcggagggaccaaggtggacatcaaaggaactgtggctgcaccatctgtcttcatcttcccgccatctgatctctcgacctctgagcgggctggcaaggcgcatagnn

SEQ ID NO: 51420 - DNA, 200 bp, Homo sapiens; identical to SEQ ID NO: 51400
  misc_feature: GYAE6OF01CMB7M.29.72.G06.1.454.CMB.1.raw
  modified_base (190)..(200): a, c, t, g, unknown or other
  misc_feature (190)..(200): n is a, c, g, or t

SEQ ID NO: 51421 - DNA, 196 bp, Homo sapiens
  misc_feature: GYAE6OF01B4A24.29.72.G06.1.454.CMB.1.raw
  modified_base (190)..(196): a, c, t, g, unknown or other
  misc_feature (190)..(196): n is a, c, g, or t
tcagatagagtactcacgaccggtgctcgatttagctacgactgcaagggaaagggtgagatacctcgctgtggctcactttcggcggagggaccaaggtggacatcaaaggaactgtggctgcaccatctgtcttcatcttcccgccatctgatctctcgactctgagcgggctggcaaggcgcatagnnnnnnn

SEQ ID NO: 51422 - DNA, 221 bp, Homo sapiens
  misc_feature: GYAE6OF01CSBBW.29.72.G06.1.454.CMB.1.raw
  modified_base (192)..(221): a, c, t, g, unknown or other
  misc_feature (192)..(221): n is a, c, g, or t
tcagatagagtactcacgaccggtgctcgatttagctacgactgcaagggaaagggtgaagatacctcgctgtggactcacctttcgggcggagggaccaaggtgacatcaaaggaactgtgctgcaccatctgtcttcatcttcccgccatctgatctctcgactctgagcgggctggcaaggcgcatagnnnnnnnnnnnnnnnnnnnnnnnnnnnnnn

SEQ ID NO: 51423 - DNA, 201 bp, Homo sapiens
  misc_feature: GYAE6OF01CEBLU.29.72.G06.1.454.CMB.1.raw
  modified_base (189)..(201): a, c, t, g, unknown or other
  misc_feature (189)..(201): n is a, c, g, or t
tcagatagagtactcacgaccggtgctcgatttagctacgactgcaagggaaagggtgagagtacctcggctgtggctcactttcggcggagggaccaaggtgacatcaaaggactgtgctgcaccatctgtcttcatcttcccgccatctgatctctcgactctgagcgggctggcaaggcgcatagnnnnnnnnnnnnn

SEQ ID NO: 51424 - DNA, 191 bp, Homo sapiens; identical to SEQ ID NO: 51397
  misc_feature: GYAE6OF01DK9DB.29.72.G06.1.454.CMB.1.raw
  modified_base (190)..(191): a, c, t, g, unknown or other
  misc_feature (190)..(191): n is a, c, g, or t

SEQ ID NO: 51425 - DNA, 189 bp, Homo sapiens; identical to SEQ ID NO: 51402
  misc_feature: GYAE6OF01CLXKX.29.72.G06.1.454.CMB.1.raw

SEQ ID NO: 51426 - DNA, 190 bp, Homo sapiens; identical to SEQ ID NO: 51398
  misc_feature: GYAE6OF01CF6N2.29.72.G06.1.454.CMB.1.raw
  modified_base (190)..(190): a, c, t, g, unknown or other
  misc_feature (190)..(190): n is a, c, g, or t

SEQ ID NO: 51427 - DNA, 193 bp, Homo sapiens
  misc_feature: GYAE6OF01D9KSU.29.72.G06.1.454.CMB.1.raw
  modified_base (190)..(193): a, c, t, g, unknown or other
  misc_feature (190)..(193): n is a, c, g, or t
tcagatagagtactcacgaccggtgctcgatttagctacgactgcaagggaaagggtgagatacctcgctgtggctcactttcggcggagggaccaaggtggacatcaaaggaactgtggctgcaccatctgtcttcatcttcccgccatctgatctctcgactctgagcgggctggcaaggcgcatagnnnn

SEQ ID NO: 51428 - DNA, 194 bp, Homo sapiens
  misc_feature: GYAE6OF01BF6JJ.29.72.G06.1.454.CMB.1.raw
  modified_base (190)..(194): a, c, t, g, unknown or other
  misc_feature (190)..(194): n is a, c, g, or t
tcagatagagtactcacgaccggtgctcgatttagctacgactgcaagggaaagggtgagatacctcgctgtggctcactttcggcggagggaccaaggtggacatcaaaggaactgtggctgcaccatctgtcttcatcttcccgccatctgatctctcgactctgagcgggctggcaaggcgcatagnnnnn

SEQ ID NO: 51429 - DNA, 191 bp, Homo sapiens
  misc_feature: GYAE6OF01EGFIF.29.72.G06.1.454.CMB.1.raw
  modified_base (189)..(191): a, c, t, g, unknown or other
  misc_feature (189)..(191): n is a, c, g, or t
tcagatagagtactcacgaccggtgctcgatttagctacgactgcaagggaaagggtgagatacctcgctgtggctcactttcggcggagggaccaaggtggacatcaaaggactgtggctgcaccatctgtcttcatcttcccgcatctgatctctcgactctgagcgggctggcaaaggcgcatagnnn

SEQ ID NO: 51430 - DNA, 213 bp, Homo sapiens
  misc_feature: GYAE6OF01CIBTT.29.72.G06.1.454.CMB.1.raw
  modified_base (189)..(213): a, c, t, g, unknown or other
  misc_feature (189)..(213): n is a, c, g, or t
tcagatagagtactcacgaccggtgctcgatttagctacgactgcaagggaaagggtgagatacctcgctgtggctcactttcggcggagggaccaaggtggacatcaaaggaactgtgctgcaccatctgtcttcatcttcccgccatctgatctctcgactctgagcgggctggcaaggcgcatagnnnnnnnnnnnnnnnnnnnnnnnnn

SEQ ID NO: 51431 - DNA, 194 bp, Homo sapiens; identical to SEQ ID NO: 51428
  misc_feature: GYAE6OF01BTEEJ.29.72.G06.1.454.CMB.1.raw
  modified_base (190)..(194): a, c, t, g, unknown or other
  misc_feature (190)..(194): n is a, c, g, or t

SEQ ID NO: 51432 - DNA, 192 bp, Homo sapiens; identical to SEQ ID NO: 51396
  misc_feature: GYAE6OF01AIOBV.29.72.G06.1.454.CMB.1.raw
  modified_base (190)..(192): a, c, t, g, unknown or other
  misc_feature (190)..(192): n is a, c, g, or t

SEQ ID NO: 51433 - DNA, 191 bp, Homo sapiens; identical to SEQ ID NO: 51397
  misc_feature: GYAE6OF01CU86I.29.72.G06.1.454.CMB.1.raw
  modified_base (190)..(191): a, c, t, g, unknown or other
  misc_feature (190)..(191): n is a, c, g, or t

SEQ ID NO: 51434 - DNA, 191 bp, Homo sapiens
  misc_feature: GYAE6OF01EJGY6.29.72.G06.1.454.CMB.1.raw
  modified_base (189)..(191): a, c, t, g, unknown or other
  misc_feature (189)..(191): n is a, c, g, or t
tcagatagagtactcacgaccggtgctcgatttagctacgactgcaagggaaagggtgagatacctcgctgtggctcactttcggcggagggaccaaggtggacatcaaaggaactgtgctgcaccatctgtcttcatcttcccgccatctgatctctcgactctgagcgggctggcaaggcgcatagnnn

SEQ ID NO: 51435 - DNA, 230 bp, Homo sapiens
  misc_feature: GYAE6OF01CM3RR.29.72.G06.1.454.CMB.1.raw
  modified_base (197)..(230): a, c, t, g, unknown or other
  misc_feature (197)..(230): n is a, c, g, or t
tcagatagagtactcacgaccggtgctcgatttagctacgactgcaagggaaagggtgagatacctcgctgtggctcactttcggcggagggaccaaggtgacatcaaaggactgtgctgcacatctgtcttcatccttcccgcatctgatcctctcgacttcgtggacggcgggctggaccgaaggcgactagagnnnnnnnnnnnnnnnnnnnnnnnnnnnnnnnnnn

SEQ ID NO: 51436 - DNA, 247 bp, Homo sapiens
  misc_feature: GYAE6OF01B0D6C.29.72.G06.1.454.CMB.1.raw
  modified_base (209)..(247): a, c, t, g, unknown or other
  misc_feature (209)..(247): n is a, c, g, or t
tcagatagagtactcacgaccggtgctcgatttagctacgactgcaagggaaagggtgagatacctcgctgtgctcactttcggcggaggaccaaggtggacatacaaaggaactgtggctcgcaccatctgtcttcatccttcccgccatctgatcctctcgtacttcgtaggaggccgggtcgtcgggacgaacgggcgcaagtagnnnnnnnnnnnnnnnnnnnnnnnnnnnnnnnnnnnnnnn

SEQ ID NO: 51437 - DNA, 192 bp, Homo sapiens; identical to SEQ ID NO: 51396
  misc_feature: GYAE6OF02IWHBL.29.72.G06.1.454.CMB.1.raw
  modified_base (190)..(192): a, c, t, g, unknown or other
  misc_feature (190)..(192): n is a, c, g, or t

SEQ ID NO: 51438 - DNA, 192 bp, Homo sapiens; identical to SEQ ID NO: 51396
  misc_feature: GYAE6OF02I3CX1.29.72.G06.1.454.CMB.1.raw
  modified_base (190)..(192): a, c, t, g, unknown or other
  misc_feature (190)..(192): n is a, c, g, or t

SEQ ID NO: 51439 - DNA, 192 bp, Homo sapiens; identical to SEQ ID NO: 51396
  misc_feature: GYAE6OF02G608G.29.72.G06.1.454.CMB.1.raw
  modified_base (190)..(192): a, c, t, g, unknown or other
  misc_feature (190)..(192): n is a, c, g, or t

SEQ ID NO: 51440 - DNA, 190 bp, Homo sapiens; identical to SEQ ID NO: 51398
  misc_feature: GYAE6OF02IKG48.29.72.G06.1.454.CMB.1.raw
  modified_base (190)..(190): a, c, t, g, unknown or other
  misc_feature (190)..(190): n is a, c, g, or t

SEQ ID NO: 51441 - DNA, 190 bp, Homo sapiens; identical to SEQ ID NO: 51398
  misc_feature: GYAE6OF02HEWYH.29.72.G06.1.454.CMB.1.raw
  modified_base (190)..(190): a, c, t, g, unknown or other
  misc_feature (190)..(190): n is a, c, g, or t

SEQ ID NO: 51442 - DNA, 190 bp, Homo sapiens; identical to SEQ ID NO: 51398
  misc_feature: GYAE6OF02GJB16.29.72.G06.1.454.CMB.1.raw
  modified_base (190)..(190): a, c, t, g, unknown or other
  misc_feature (190)..(190): n is a, c, g, or t

SEQ ID NO: 51443 - DNA, 190 bp, Homo sapiens; identical to SEQ ID NO: 51398
  misc_feature: GYAE6OF02HK6J1.29.72.G06.1.454.CMB.1.raw
  modified_base (190)..(190): a, c, t, g, unknown or other
  misc_feature (190)..(190): n is a, c, g, or t

SEQ ID NO: 51444 - DNA, 191 bp, Homo sapiens; identical to SEQ ID NO: 51397
  misc_feature: GYAE6OF02HAAMN.29.72.G06.1.454.CMB.1.raw
  modified_base (190)..(191): a, c, t, g, unknown or other
  misc_feature (190)..(191): n is a, c, g, or t

SEQ ID NO: 51445 - DNA, 191 bp, Homo sapiens
  misc_feature: GYAE6OF02IGCPA.29.72.G06.1.454.CMB.1.raw
  modified_base (191)..(191): a, c, t, g, unknown or other
  misc_feature (191)..(191): n is a, c, g, or t
tcagatagagtactcacgaccggtgctcgatttagctacgactgcaagggaaagggtggagatacctcgctgtggctcactttcggcggagggaccaaggtggacatcaaaggaactgtggctgcaccatctgtcttcatcttcccgccatctgatctctcgactctgagcgggctggcaaggcgcatagn

SEQ ID NO: 51446 - DNA, 191 bp, Homo sapiens; identical to SEQ ID NO: 51397
  misc_feature: GYAE6OF02HZRKQ.29.72.G06.1.454.CMB.1.raw
  modified_base (190)..(191): a, c, t, g, unknown or other
  misc_feature (190)..(191): n is a, c, g, or t

SEQ ID NO: 51447 - DNA, 190 bp, Homo sapiens; identical to SEQ ID NO: 51398
  misc_feature: GYAE6OF02F3PUE.29.72.G06.1.454.CMB.1.raw
  modified_base (190)..(190): a, c, t, g, unknown or other
  misc_feature (190)..(190): n is a, c, g, or t

SEQ ID NO: 51448 - DNA, 191 bp, Homo sapiens; identical to SEQ ID NO: 51397
  misc_feature: GYAE6OF02I2XH9.29.72.G06.1.454.CMB.1.raw
  modified_base (190)..(191): a, c, t, g, unknown or other
  misc_feature (190)..(191): n is a, c, g, or t

SEQ ID NO: 51449 - DNA, 195 bp, Homo sapiens
  misc_feature: GYAE6OF02JBOO7.29.72.G06.1.454.CMB.1.raw
  modified_base (190)..(195): a, c, t, g, unknown or other
  misc_feature (190)..(195): n is a, c, g, or t
tcagatagagtactcacgaccggtgctcgatttagctacgactgcaagggaaagggtgagatacctcgctgtggctcactttcggcggagggaccaaggtggacatcaaaggaactgtggctgcaccatctgtcttcatcttcccgccatctgatctctcgactctgagcgggctggcaaggcgcatagnnnnnn

SEQ ID NO: 51450 - DNA, 190 bp, Homo sapiens; identical to SEQ ID NO: 51398
  misc_feature: GYAE6OF02HE4LP.29.72.G06.1.454.CMB.1.raw
  modified_base (190)..(190): a, c, t, g, unknown or other
  misc_feature (190)..(190): n is a, c, g, or t

SEQ ID NO: 51451 - DNA, 211 bp, Homo sapiens
  misc_feature: GYAE6OF02INHKX.29.72.G06.1.454.CMB.1.raw
  modified_base (191)..(211): a, c, t, g, unknown or other
  misc_feature (191)..(211): n is a, c, g, or t
tcagatagagtactcacgaccggtgctcgatttagctacgactgcaaggggaaagggtgagatacctcgctgtggctcactttcggcggagggaccaaggtggacatcaaaggaactgtggctgcaccatctgtcttcatcttcccgccatctgatctctcgactctgagcgggctggcaaggcgcatagnnnnnnnnnnnnnnnnnnnnn

SEQ ID NO: 51452 - DNA, 248 bp, Homo sapiens
  misc_feature: GYAE6OF02GD8I1.29.72.G06.1.454.CMB.1.raw
  modified_base (200)..(201): a, c, t, g, unknown or other
  misc_feature (200)..(201): n is a, c, g, or t
  modified_base (203)..(208): a, c, t, g, unknown or other
  misc_feature (203)..(208): n is a, c, g, or t
  modified_base (210)..(248): a, c, t, g, unknown or other
  misc_feature (210)..(248): n is a, c, g, or t
tcagatagagtactcacgaccggtgctcgatttagctacgactgcaagggaaagggtgagatacctcgctcgtggctcactttcggcggagggtaccaaggtggacatcaaaggaactgtggctagcaccatctgtcttctagtcttcccgccagtcttgatctctcgtaactctgagcgggctggcaaggcgcagtagnngnnnnnngnnnnnnnnnnnnnnnnnnnnnnnnnnnnnnnnnnnnnnn

SEQ ID NO: 51453 - DNA, 195 bp, Homo sapiens
  misc_feature: GYAE6OF02H86OZ.29.72.G06.1.454.CMB.1.raw
  modified_base (189)..(195): a, c, t, g, unknown or other
  misc_feature (189)..(195): n is a, c, g, or t
tcagatagagtactcacgaccggtgctcgatttagctacgactgcaagggaaaggtgagatacctcgctgtggctcactttcggcggagggaccaaggtggacatcaaaggaactgtggctgcaccatctgtcttcatcttcccgccatctgatctctcgactctgagcgggctggcaaggcgcatagnnnnnnn

SEQ ID NO: 51454 - DNA, 211 bp, Homo sapiens
  misc_feature: GYAE6OF02I0PVQ.29.72.G06.1.454.CMB.1.raw
  modified_base (188)..(211): a, c, t, g, unknown or other
  misc_feature (188)..(211): n is a, c, g, or t
tcagatagagtactcacgaccggtgctcgatttagctacgactgcaagggaaagggtgagatacctcgctgtggctcactttcggcggagggaccaaggtggacatcaaaggactgtggctgcaccatctgtcttcatcttccgcatctgatctctcgactctgagcgggctggcaaggcgcagtagnnnnnnnnnnnnnnnnnnnnnnnn

SEQ ID NO: 51455 - DNA, 217 bp, Homo sapiens
  misc_feature: GYAE6OF02F28OU.29.72.G06.1.454.CMB.1.raw
  modified_base (191)..(217): a, c, t, g, unknown or other
  misc_feature (191)..(217): n is a, c, g, or t
tcagatagagtactcacgaccggtgctcgatttagctacgactgcaagggaaagggtggagatacctcgctgtggctcactttcggcggagggaccaaggtggacatcaaaggactgtggctgcaccatctgtccttcatcttcccgccatctgatctctcgactctgagcgggctggcaaggcgcatagnnnnnnnnnnnnnnnnnnnnnnnnnnn

SEQ ID NO: 51456 - DNA, 191 bp, Homo sapiens; identical to SEQ ID NO: 51397
  misc_feature: GYAE6OF02HDC3G.29.72.G06.1.454.CMB.1.raw
  modified_base (190)..(191): a, c, t, g, unknown or other
  misc_feature (190)..(191): n is a, c, g, or t

SEQ ID NO: 51457 - DNA, 190 bp, Homo sapiens; identical to SEQ ID NO: 51398
  misc_feature: GYAE6OF02FQZTO.29.72.G06.1.454.CMB.1.raw
  modified_base (190)..(190): a, c, t, g, unknown or other
  misc_feature (190)..(190): n is a, c, g, or t

SEQ ID NO: 51458 - DNA, 190 bp, Homo sapiens; identical to SEQ ID NO: 51398
  misc_feature: GYAE6OF02GW8FZ.29.72.G06.1.454.CMB.1.raw
  modified_base (190)..(190): a, c, t, g, unknown or other
  misc_feature (190)..(190): n is a, c, g, or t

SEQ ID NO: 51459 - DNA, 196 bp, Homo sapiens; identical to SEQ ID NO: 51421
  misc_feature: GYAE6OF02GBJZE.29.72.G06.1.454.CMB.1.raw
  modified_base (190)..(196): a, c, t, g, unknown or other
  misc_feature (190)..(196): n is a, c, g, or t

SEQ ID NO: 51460 - DNA, 190 bp, Homo sapiens; identical to SEQ ID NO: 51398
  misc_feature: GYAE6OF02FRS1W.29.72.G06.1.454.CMB.1.raw
  modified_base (190)..(190): a, c, t, g, unknown or other
  misc_feature (190)..(190): n is a, c, g, or t

SEQ ID NO: 51461 - DNA, 191 bp, Homo sapiens; identical to SEQ ID NO: 51397
  misc_feature: GYAE6OF02FR3P5.29.72.G06.1.454.CMB.1.raw
  modified_base (190)..(191): a, c, t, g, unknown or other
  misc_feature (190)..(191): n is a, c, g, or t

SEQ ID NO: 51462 - DNA, 240 bp, Homo sapiens
  misc_feature: GYAE6OF02GDO5R.29.72.G06.1.454.CMB.1.raw
  modified_base (199)..(240): a, c, t, g, unknown or other
  misc_feature (199)..(240): n is a, c, g, or t
tcagatagagtactcacgaccggtgctcgatttagctacgactgcaaggggaaagggtgaagatacctcgctgtggctcactttcggcggagggaccaaaggtggacatcaaaggaactgtggctgcaccatctgtcttcattcttcccgccatctgatctctcgactctggagcgggctggacaagggcgtacaatgnnnnnnnnnnnnnnnnnnnnnnnnnnnnnnnnnnnnnnnnnn

SEQ ID NO: 51463 - DNA, 193 bp, Homo sapiens; identical to SEQ ID NO: 51427
  misc_feature: GYAE6OF02FZLFI.29.72.G06.1.454.CMB.1.raw
  modified_base (190)..(193): a, c, t, g, unknown or other
  misc_feature (190)..(193): n is a, c, g, or t

SEQ ID NO: 51464 - DNA, 193 bp, Homo sapiens; identical to SEQ ID NO: 51427
  misc_feature: GYAE6OF02I5QW4.29.72.G06.1.454.CMB.1.raw
  modified_base (190)..(193): a, c, t, g, unknown or other
  misc_feature (190)..(193): n is a, c, g, or t

SEQ ID NO: 51465 - DNA, 193 bp, Homo sapiens; identical to SEQ ID NO: 51427
  misc_feature: GYAE6OF02F1O1X.29.72.G06.1.454.CMB.1.raw
  modified_base (190)..(193): a, c, t, g, unknown or other
  misc_feature (190)..(193): n is a, c, g, or t

SEQ ID NO: 51466 - DNA, 197 bp, Homo sapiens
  misc_feature: GYAE6OF02FV24Z.29.72.G06.1.454.CMB.1.raw
  modified_base (190)..(197): a, c, t, g, unknown or other
  misc_feature (190)..(197): n is a, c, g, or t
tcagatagagtactcacgaccggtgctcgatttagctacgactgcaagggaaagggtgagatacctcgctgtggctcactttcggcggagggaccaaggtggacatcaaaggaactgtggctgcaccatctgtcttcatcttcccgccatctgatctctcgactctgagcgggctggcaaggcgcatagnnnnnnnn

SEQ ID NO: 51467 - DNA, 192 bp, Homo sapiens; identical to SEQ ID NO: 51396
  misc_feature: GYAE6OF02HII8J.29.72.G06.1.454.CMB.1.raw
  modified_base (190)..(192): a, c, t, g, unknown or other
  misc_feature (190)..(192): n is a, c, g, or t

SEQ ID NO: 51468 - DNA, 204 bp, Homo sapiens
  misc_feature: GYAE6OF02IYHAS.29.72.G06.1.454.CMB.1.raw
  modified_base (181)..(181): a, c, t, g, unknown or other
  misc_feature (181)..(181): n is a, c, g, or t
  modified_base (187)..(204): a, c, t, g, unknown or other
  misc_feature (187)..(204): n is a, c, g, or t
tcagatagagtactcacgaccggtgctcgatttagctacgactgcaagggaaagggtgagatacctcgctgtggctcactttcggcggagggaccaaggtggacatcaaaggactgtggctgcacatctgtcttcatccttcccgcatctgatctctcgactctgagcggctggcaagcgnagtagnnnnnnnnnnnnnnnnnn

SEQ ID NO: 51469 - DNA, 427 bp, Homo sapiens
  misc_feature: GYAE6OF01C14BG.11.61.F06.1.454.CMB.1.raw
  modified_base (414)..(414): a, c, t, g, unknown or other
  misc_feature (414)..(414): n is a, c, g, or t
  modified_base (419)..(427): a, c, t, g, unknown or other
  misc_feature (419)..(427): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaaagacacggctgtttacttctgtgcaagaggtggctggtcgcatggatttgatctctggggccaggggacaagtggtaaccgtctcttcagcctccaccaagggccccatccggtcttccccctggccgccctgcctccaggacgcacctcgagagcacagcggccctgggctgcctggtcaaggctacttccgtatctctcgctgagcgggctggcaaggcgnatagnnnnnnnnn

SEQ ID NO: 51470 - DNA, 435 bp, Homo sapiens
  misc_feature: GYAE6OF01D1XJJ.11.61.F06.1.454.CMB.1.raw
  modified_base (429)..(435): a, c, t, g, unknown or other
  misc_feature (429)..(435): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggcttgtttacttctgtgcaagaggtggctggtcgcatggatttgatctcgtggggccagggggacaatggtaaccgtctcttcagcctccaccaagggcccatccggtccttcccccgtggccgcccctgcctccgaggcgccaccctccgagacgcacagccggcccgtgggctgcctggtcaaggactacttccgtatctctcgctgacgcggctggcaaggcgcatagnnnnnnn

SEQ ID NO: 51471 - DNA, 416 bp, Homo sapiens
  misc_feature: GYAE6OF01AJT4Z.11.61.F06.1.454.CMB.1.raw
  modified_base (408)..(408): a, c, t, g, unknown or other
  misc_feature (408)..(408): n is a, c, g, or t
  modified_base (411)..(416): a, c, t, g, unknown or other
  misc_feature (411)..(416): n is a, c, g, or t
tcagcgagagataccacgaccggtgctcgatttagctacgctctaagggaaagggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttactctgtgcaagaggtggctggtcgcatggatttgatctctggggccagggggacaatggtaaccgtctcttcagcctccaccaagggcccatcggtcttcccctggcgccctgcctccaggcgcacctccgagagcacagcggccctgggctgcctggtcaaggactacttccgtatctctcctgagcgggctggcaggcgcanagnnnnnn

SEQ ID NO: 51472 - DNA, 439 bp, Homo sapiens
  misc_feature: GYAE6OF01BN4VB.11.61.F06.1.454.CMB.1.raw
  modified_base (424)..(424): a, c, t, g, unknown or other
  misc_feature (424)..(424): n is a, c, g, or t
  modified_base (430)..(439): a, c, t, g, unknown or other
  misc_feature (430)..(439): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtggggccaggggacaatggtaaccgtctcttcagcctccaccaagggcccatccggtccttccccctggccgccctgctccaggacgccaccctccgagacgccacacggccggccctggggctggcctggtcaaggcctacttccgtatcctctcgctgagcgggctgggcaaggcncatagnnnnnnnnnn

SEQ ID NO: 51473 - DNA, 413 bp, Homo sapiens
  misc_feature: GYAE6OF01C9E3A.11.61.F06.1.454.CMB.1.raw
  modified_base (319)..(319): a, c, t, g, unknown or other
  misc_feature (319)..(319): n is a, c, g, or t
  modified_base (406)..(413): a, c, t, g, unknown or other
  misc_feature (406)..(413): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaccgtctcttcagcctccacaaggcccatcgtcttcccctgcgccctgctcagngcacctcgagagcacagcggccctgggctgcctggtcaggactacttccgtatctctcgctgagcgggctggcgaaggcgcagtagnnnnnnnn

SEQ ID NO: 51474 - DNA, 445 bp, Homo sapiens
  misc_feature: GYAE6OF01AB8K1.11.61.F06.1.454.CMB.1.raw
  modified_base (209)..(209): a, c, t, g, unknown or other
  misc_feature (209)..(209): n is a, c, g, or t
  modified_base (217)..(217): a, c, t, g, unknown or other
  misc_feature (217)..(217): n is a, c, g, or t
  modified_base (325)..(325): a, c, t, g, unknown or other
  misc_feature (325)..(325): n is a, c, g, or t
  modified_base (413)..(433): a, c, t, g, unknown or other
  misc_feature (413)..(433): n is a, c, g, or t
  modified_base (435)..(445): a, c, t, g, unknown or other
  misc_feature (435)..(445): n is a, c, g, or t
tcagcgagagataccacgaccggtgctcgatttagctacgctctaagggaaagggggctggtgtgggtctcacgtattgacaatgatgggagtgacacaatccacgcggattctgtgaggggccattcaccacttcgagagacaacgccaagaacacggtatatctgcaaatgaacagtctgagaggcgaagacacggctgtttactcngtgcaagnggtggctggtcgcatggatttgatctcgtggggccaggggacaatggtaaccgtctcttcagcctccaccaagggcccatcggtctcccctggcgccctgctccaggngcacctccgagacgcacgagccggccctgggctgcctggtcaggactacttccgtatctctcgctgagcggctggcaaggcgacatgnnnnnnnnnnnnnnnnnnnnngnnnnnnnnnnn

SEQ ID NO: 51475 - DNA, 620 bp, Homo sapiens
  misc_feature: GYAE6OF01D32VH.11.61.F06.1.454.CMB.1.raw
  modified_base (546)..(546): a, c, t, g, unknown or other
  misc_feature (546)..(546): n is a, c, g, or t
  modified_base (549)..(549): a, c, t, g, unknown or other
  misc_feature (549)..(549): n is a, c, g, or t
  modified_base (551)..(551): a, c, t, g, unknown or other
  misc_feature (551)..(551): n is a, c, g, or t
  modified_base (554)..(554): a, c, t, g, unknown or other
  misc_feature (554)..(554): n is a, c, g, or t
  modified_base (556)..(556): a, c, t, g, unknown or other
  misc_feature (556)..(556): n is a, c, g, or t
  modified_base (562)..(562): a, c, t, g, unknown or other
  misc_feature (562)..(562): n is a, c, g, or t
  modified_base (582)..(582): a, c, t, g, unknown or other
  misc_feature (582)..(582): n is a, c, g, or t
  modified_base (592)..(592): a, c, t, g, unknown or other
  misc_feature (592)..(592): n is a, c, g, or t
  modified_base (594)..(594): a, c, t, g, unknown or other
  misc_feature (594)..(594): n is a, c, g, or t
  modified_base (596)..(596): a, c, t, g, unknown or other
  misc_feature (596)..(596): n is a, c, g, or t
  modified_base (598)..(598): a, c, t, g, unknown or other
  misc_feature (598)..(598): n is a, c, g, or t
  modified_base (602)..(602): a, c, t, g, unknown or other
  misc_feature (602)..(602): n is a, c, g, or t
  modified_base (609)..(609): a, c, t, g, unknown or other
  misc_feature (609)..(609): n is a, c, g, or t
  modified_base (615)..(615): a, c, t, g, unknown or other
  misc_feature (615)..(615): n is a, c, g, or t
  modified_base (617)..(617): a, c, t, g, unknown or other
  misc_feature (617)..(617): n is a, c, g, or t
tcagcgagagataccacgaccggtgctcgatttagctacgctctaaggaaaggggacgtggtgtgggtctcacgtattgaccaatcgagtgggtagtgactacaattccgacgcggattctgtgagggccgattcaccacttcgagagacaacgccaagaacacggtattatctgctaaaattagaacagtctgagaggcgaagacacggctgtttacttcgtggtgctaagaggtggctgggtccgcaagtggacttttgatctcgtgggcccagggacaagttcggtaaaccgttctctttcagccctccaccgaacgggtccccacgtccggtccttcccccgtgggccgcccgtgccgtccgaggtacgccgaccgtccgaggtacgcgtacgacggccggtccccgtgggacctcgaccgttacggtaaccgaaacggtaccgttaaccgtttacccggtacgttaccgttccgttccgtcgttacggaacggtaccgggtaccgttacggaaccgaaacggccgtaaccgaagttaggcncgnangcngngagagngacgagagacgcgacgtatntgtgtagagngngngngcgngcgtcgngacgcngngcg

SEQ ID NO: 51476 - DNA, 422 bp, Homo sapiens
  misc_feature: GYAE6OF01DMMH2.11.61.F06.1.454.CMB.1.raw
  modified_base (329)..(329): a, c, t, g, unknown or other
  misc_feature (329)..(329): n is a, c, g, or t
  modified_base (415)..(422): a, c, t, g, unknown or other
  misc_feature (415)..(422): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaccgtctcttcagcctccaccaagggcccatccggtcttccccctggccgccctgctccaggancacctccgagagcacagcggccctgggctgcctggtcaaggactacttccgtatctctcgctgagcgggctggcaaggcgcatagnnnnnnnn

SEQ ID NO: 51477 - DNA, 430 bp, Homo sapiens
  misc_feature: GYAE6OF01D0T7X.11.61.F06.1.454.CMB.1.raw
  modified_base (413)..(430): a, c, t, g, unknown or other
  misc_feature (413)..(430): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaacccgtctcttcagcctccaccaagggcccatcggtcttcccctggcgccctgctccagagcacctccgagagcacagcggccctgggctgcctggtaccaaggctacttccgtatctctcgctgagcgggctggcaaggcgcatagnnnnnnnnnnnnnnnnnn

SEQ ID NO: 51478 - DNA, 420 bp, Homo sapiens
  misc_feature: GYAE6OF01DQT36.11.61.F06.1.454.CMB.1.raw
  modified_base (338)..(338): a, c, t, g, unknown or other
  misc_feature (338)..(338): n is a, c, g, or t
  modified_base (407)..(407): a, c, t, g, unknown or other
  misc_feature (407)..(407): n is a, c, g, or t
  modified_base (413)..(420): a, c, t, g, unknown or other
  misc_feature (413)..(420): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttactctgtgcaagaggtggctggtcgcatggatttgatctcgtggggccaggggacaatggtaaccgtctcttcagcctccaccaagggcccatcggtcttcccctggccgccctgctccaggagcacctccgagngcacagcggccctgggctgcctggtcaaggtctacttccgtatctctcgctgagcgggctggcaaggcncatagnnnnnnnn

SEQ ID NO: 51479 - DNA, 499 bp, Homo sapiens
  misc_feature: GYAE6OF01A7PRY.11.61.F06.1.454.CMB.1.raw
  modified_base (483)..(499): a, c, t, g, unknown or other
  misc_feature (483)..(499): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtggggccaggggacaagtggtaaccgtctcttcagcctccaccaagggccccatccggtccttcccccgtggccgtcccctgcctcccaggacgccaccctccggagacgccaaccgaggcccgggccccgtggggcctcggcccgttcgggtaccaaacgggtaccttaaccgtttcccggtaattccttcctccgtctaggacggccggggctgggcaacgggcaccgagtacgnnnnnnnnnnnnnnnnn

SEQ ID NO: 51480 - DNA, 426 bp, Homo sapiens
  misc_feature: GYAE6OF01CRLY8.11.61.F06.1.454.CMB.1.raw
  modified_base (319)..(319): a, c, t, g, unknown or other
  misc_feature (319)..(319): n is a, c, g, or t
  modified_base (333)..(333): a, c, t, g, unknown or other
  misc_feature (333)..(333): n is a, c, g, or t
  modified_base (344)..(344): a, c, t, g, unknown or other
  misc_feature (344)..(344): n is a, c, g, or t
  modified_base (415)..(415): a, c, t, g, unknown or other
  misc_feature (415)..(415): n is a, c, g, or t
  modified_base (421)..(426): a, c, t, g, unknown or other
  misc_feature (421)..(426): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtggggccaggggacaagtggtaaccgtctcttcagcctccaccaagggcccagtcggtccttccccctggccnccctgctccaggancacctccgagngcacagccggccctgggctgcctggtcaaggtactacttccgtatcttcgctgagcgggctgggcaaggcncatagnnnnnn

SEQ ID NO: 51481 - DNA, 414 bp, Homo sapiens
  misc_feature: GYAE6OF01B1S6K.11.61.F06.1.454.CMB.1.raw
  modified_base (313)..(313): a, c, t, g, unknown or other
  misc_feature (313)..(313): n is a, c, g, or t
  modified_base (336)..(336): a, c, t, g, unknown or other
  misc_feature (336)..(336): n is a, c, g, or t
  modified_base (393)..(393): a, c, t, g, unknown or other
  misc_feature (393)..(393): n is a, c, g, or t
  modified_base (409)..(414): a, c, t, g, unknown or other
  misc_feature (409)..(414): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtggggccaggggacaatggtaaccgtctcttcagcctccaccaaggcccatcggtctcccctggccncctgctccaggcgcacctcgagngcacagcggccctgggctgcctggtcaaggctactccgtatctctcgctgagcgggntggcaaggcgcatagnnnnnn

SEQ ID NO: 51482 - DNA, 423 bp, Homo sapiens
  misc_feature: GYAE6OF01A9GZW.11.61.F06.1.454.CMB.1.raw
  modified_base (416)..(423): a, c, t, g, unknown or other
  misc_feature (416)..(423): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaccgtctcttcagcctccaccaagggcccatcggtcttccccctggccgccctgcctccaggagcacctccgagacgcacagcggccctgggctgcctggtcaaggactacttcgtatctctcgctgagcgggctggcaaggcgcatagnnnnnnnn

SEQ ID NO: 51483 - DNA, 448 bp, Homo sapiens
  misc_feature: GYAE6OF01A2BCS.11.61.F06.1.454.CMB.1.raw
  modified_base (435)..(448): a, c, t, g, unknown or other
  misc_feature (435)..(448): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttactctgtgcaagaggtggctggtcgcatggatttgatctcgtggggccaggggacaatggtaaccgtctcttcagcctccaccaagggcccatcggtcttccccctggccgccctgcctccaggacgccaccctccgagacgcacacgccggccctgggcctcggcctgggtccaagggacctaccgttccgtatccttctcgctgacgcgggctggcaaggcgcatacgnnnnnnnnnnnnnn

SEQ ID NO: 51484 - DNA, 547 bp, Homo sapiens
  misc_feature: GYAE6OF01BXGBI.11.61.F06.1.454.CMB.1.raw
  modified_base (227)..(227): a, c, t, g, unknown or other
  misc_feature (227)..(227): n is a, c, g, or t
  modified_base (459)..(459): a, c, t, g, unknown or other
  misc_feature (459)..(459): n is a, c, g, or t
  modified_base (467)..(467): a, c, t, g, unknown or other
  misc_feature (467)..(467): n is a, c, g, or t
  modified_base (471)..(471): a, c, t, g, unknown or other
  misc_feature (471)..(471): n is a, c, g, or t
  modified_base (500)..(500): a, c, t, g, unknown or other
  misc_feature (500)..(500): n is a, c, g, or t
  modified_base (512)..(512): a, c, t, g, unknown or other
  misc_feature (512)..(512): n is a, c, g, or t
  modified_base (517)..(517): a, c, t, g, unknown or other
  misc_feature (517)..(517): n is a, c, g, or t
  modified_base (520)..(520): a, c, t, g, unknown or other
  misc_feature (520)..(520): n is a, c, g, or t
  modified_base (536)..(536): a, c, t, g, unknown or other
  misc_feature (536)..(536): n is a, c, g, or t
  modified_base (540)..(540): a, c, t, g, unknown or other
  misc_feature (540)..(540): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttactctgtgcaagaggtgctggtcncatggatttgatctcgtggggccagggggacaagtggtaaccgtctcttcagcctccaccaagggcccagtccggtcttccccctggccgccctgcctccaggagccacctccgagacgccacagccggccctggggcctcggcctgggtaccaagggtaccttacgttccgtactccgtctccgctcggacggtccggggtcctcggcctaagggccgcgaacgtacggcncgcgacgngtcngtcgactcgctgtacgcgtgcgtcgacgngcgtcacgtcgngtacncgncgtacgcgactacgancgtncggtacg

SEQ ID NO: 51485 - DNA, 459 bp, Homo sapiens
  misc_feature: GYAE6OF01AFSII.11.61.F06.1.454.CMB.1.raw
  modified_base (216)..(216): a, c, t, g, unknown or other
  misc_feature (216)..(216): n is a, c, g, or t
  modified_base (228)..(228): a, c, t, g, unknown or other
  misc_feature (228)..(228): n is a, c, g, or t
  modified_base (428)..(431): a, c, t, g, unknown or other
  misc_feature (428)..(431): n is a, c, g, or t
  modified_base (433)..(436): a, c, t, g, unknown or other
  misc_feature (433)..(436): n is a, c, g, or t
  modified_base (438)..(459): a, c, t, g, unknown or other
  misc_feature (438)..(459): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccattcaccacttcgagagacaacgccaagaacacggtatatctgcaaatgaacagtctgagaggcgaagcacggctgtttacttctgtgcaagnggtggctggtcncatggatttgatctcgtggggccagggggacaatggtaaccgtctcttcagcctccaccaaggcccatccggtcttccccctggccgccctgcctccgaggacgcaccctccgagagcacagccggccctggcctgccctggtacaaggaccttacttcccgtatcctctcgctgacgcgggctggcaaggcgcagtagnnnncnnnngnnnnnnnnnnnnnnnnnnnnnn

SEQ ID NO: 51486 - DNA, 457 bp, Homo sapiens
  misc_feature: GYAE6OF01AZBZO.11.61.F06.1.454.CMB.1.raw
  modified_base (445)..(457): a, c, t, g, unknown or other
  misc_feature (445)..(457): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctagaaaatgaacagtctgagaggcgaagacacggcttgtttactctgtgacaaggaggtggctggtcgcagtggtatttgattctcgtggggccagggggacaatggtaaccgtctcttcagcctaccaccaacgggccccatccggtccttccccccgtggccgtcccctgcctccgaggacgccacctccgagcgccacgagccggccctgggctgcctggtcaaggtactacttccgtatcctctcgctgaggcggctgggacaaggcgacagtagnnnnnnnnnnnnn

SEQ ID NO: 51487 - DNA, 426 bp, Homo sapiens
  misc_feature: GYAE6OF01BX3N8.11.61.F06.1.454.CMB.1.raw
  modified_base (413)..(413): a, c, t, g, unknown or other
  misc_feature (413)..(413): n is a, c, g, or t
  modified_base (419)..(426): a, c, t, g, unknown or other
  misc_feature (419)..(426): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtggggcccagggggacaatggtaaccgtctcttcagcctccaccaagggcccatcggtcttccccctggccgccctgctcccaggagcacctccgagagcacagcggccctggctgcctggtcaaggactacttcccgtatctctcgctgagcgggctggcaaggcncatagnnnnnnnn

SEQ ID NO: 51488 - DNA, 461 bp, Homo sapiens
  misc_feature: GYAE6OF01EWD3T.11.61.F06.1.454.CMB.1.raw
  modified_base (423)..(423): a, c, t, g, unknown or other
  misc_feature (423)..(423): n is a, c, g, or t
  modified_base (444)..(461): a, c, t, g, unknown or other
  misc_feature (444)..(461): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtgggccagggacaagtggtaaccgtctcttcagcctccaccaacgggcccagtccggtccttcccccgtggccgccctgcctccaggacgccaccgtccgagacgcacgacgccggccctgggctcgccgtggtacaaacgggaccttacgtccgtactctctcgctggagccgggtntcggacgaaggcgacatacgnnnnnnnnnnnnnnnnnn

SEQ ID NO: 51489 - DNA, 419 bp, Homo sapiens
  misc_feature: GYAE6OF01BM9L7.11.61.F06.1.454.CMB.1.raw
  modified_base (404)..(404): a, c, t, g, unknown or other
  misc_feature (404)..(404): n is a, c, g, or t
  modified_base (410)..(419): a, c, t, g, unknown or other
  misc_feature (410)..(419): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtggggccaggggacaatggtaaccgtctcttcagcctccaccaaggcccatcggtcttccccctggcgccctgctccaggagcacctccgagagcacagcgccctgggctgcctggtcaaggctactccgtatctctcgctgagcgggctggcaaggcncatagnnnnnnnnnn

SEQ ID NO: 51490 - DNA, 478 bp, Homo sapiens
  misc_feature: GYAE6OF01BCIJU.11.61.F06.1.454.CMB.1.raw
  modified_base (216)..(216): a, c, t, g, unknown or other
  misc_feature (216)..(216): n is a, c, g, or t
  modified_base (454)..(478): a, c, t, g, unknown or other
  misc_feature (454)..(478): n is a, c, g, or t
tcagcgagagataccacgaccggtgctcgatttagctacgctctaagggaaagggctggtgtgggtctcacgtattgacaatgatgggagtgacacaatccacgcggattctgtgaggggccattcaccacttcgagagacaacgccaagaacacggtatatctgcaaatgaacagtctgagaggcgaagacacggctgtttacttctgtgcaagnggtggctggtcgcatggatttgatctcgtggggccagggggacaatggtaaccgtctcttcagcctccaccaagggcccatcggtccttccccctggccgccctgcctccgaggagccacctccgaagacgccacacgccggcccgtcgggctcggcctaggtccgaaacggaccttacttcccgtatccttctaccgcgttggacgcgggccttgggaccgaagggcgaccataggnnnnnnnnnnnnnnnnnnnnnnnnn

SEQ ID NO: 51491 - DNA, 501 bp, Homo sapiens
  misc_feature: GYAE6OF01A43AD.11.61.F06.1.454.CMB.1.raw
  modified_base (217)..(217): a, c, t, g, unknown or other
  misc_feature (217)..(217): n is a, c, g, or t
  modified_base (476)..(501): a, c, t, g, unknown or other
  misc_feature (476)..(501): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttactctgtgcaagnggtggctggtcgcatggatttgatctcgtggggccaggggacaagtggtaaccgtctcttcagcctccaccgaacggcccagtccggtccttcccccgtggccgccctgcctccgaggacgccacccgtccgagacgccacgacggccggccccgtgggcctcggccctgggtaccaaacgggtaccttaccgtttacccggtattccctcgtccgtcgtggacggccggggctgggccgtaagggcccgacgagtagnnnnnnnnnnnnnnnnnnnnnnnnnn

SEQ ID NO: 51492 - DNA, 469 bp, Homo sapiens
  misc_feature: GYAE6OF01B9H7S.11.61.F06.1.454.CMB.1.raw
  modified_base (218)..(218): a, c, t, g, unknown or other
  misc_feature (218)..(218): n is a, c, g, or t
  modified_base (454)..(469): a, c, t, g, unknown or other
  misc_feature (454)..(469): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagnggtggctggtcgcatggatttgatctcgtggggccaggggacaagtcggtaaccgtctcttcagcctccaccgaagggcccatccggtccttcccccgtggccgccctgcctccgaggacgccacctccggagacgcacgagccggcccgtgggctcgccgtggtacaacggtaccttacgttcccgtatcctccgtcgcgtggacggcgggctcgggcgaacgggcacagtacgnnnnnnnnnnnnnnnn

SEQ ID NO: 51493 - DNA, 464 bp, Homo sapiens
  misc_feature: GYAE6OF01BTYAO.11.61.F06.1.454.CMB.1.raw
  modified_base (451)..(451): a, c, t, g, unknown or other
  misc_feature (451)..(451): n is a, c, g, or t
  modified_base (456)..(464): a, c, t, g, unknown or other
  misc_feature (456)..(464): n is a, c, g, or t
tcagcgagagataccacgaccggtgctcgatttagctacgctctaagggaaaggggctggtgtgggtctcacgtattgacaatgatgggagtgacacaatccacgcggattctgtgagggccattcaccattcgagagacaacgccaaagaacacggtatatctgacaaatgaacagtctgagaggcgaaagacacggcttgtttacttctgtgacaaggaggtcggctgggtagcagttggatttgacttctgtgggccaggggacaagtggtaaccgtctcttcacgcctaccgaaccgaagggcccctaagtccggtccttcccccgtggcccgcccgtgctccaggacgccaaccgtccgagagcacgacgcggccctgggctgccttggtacaaaggtactacttccgtaatctactcgactgacggcgggctcggacaaggccgnatagnnnnnnnnn

SEQ ID NO: 51494 - DNA, 484 bp, Homo sapiens
  misc_feature: GYAE6OF01ATTXK.11.61.F06.1.454.CMB.1.raw
  modified_base (218)..(218): a, c, t, g, unknown or other
  misc_feature (218)..(218): n is a, c, g, or t
  modified_base (344)..(344): a, c, t, g, unknown or other
  misc_feature (344)..(344): n is a, c, g, or t
  modified_base (466)..(484): a, c, t, g, unknown or other
  misc_feature (466)..(484): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagnggtggctggtcgcagtggatttgatctcgtggggccaggggacaagtggtaaccgtctcttcagccctccaccgaacgggccccagtccggtccttcccccgtggccgcccctgcctccgaggacnccaccctccgagacgcaacaggccggcccgtgggcctcggcccgttggtaccaaacggtaccttaccgttccgtattcctcctcgcttggacggccgggtctaggcgtaagggccgcatagnnnnnnnnnnnnnnnnnnn

SEQ ID NO: 51495 - DNA, 483 bp, Homo sapiens
  misc_feature: GYAE6OF01BEQ6G.11.61.F06.1.454.CMB.1.raw
  modified_base (218)..(218): a, c, t, g, unknown or other
  misc_feature (218)..(218): n is a, c, g, or t
  modified_base (464)..(483): a, c, t, g, unknown or other
  misc_feature (464)..(483): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccattcaccacttcgagagacaacgccaaagaacacggtatatctgcaaatgaacagtctgagaggcgaagacacggctgtttacttctgtgcaagnggtggctggtcgcatggattttgatctctgggggccaggggacaagtggtaaccgtctcttcagcctccaccgaagggcccatccggtccttcccccgtggccgccctgctccgaggacgccacctccgagacgccacacgtccggcccttggggcctcggcccgttggtaccaaacgggtaccttaccgtttcccgtattcctccgtcgcctggacggccgggctggacaacgggcgacagtagnnnnnnnnnnnnnnnnnnnn

SEQ ID NO: 51496 - DNA, 481 bp, Homo sapiens
  misc_feature: GYAE6OF01CM3AP.11.61.F06.1.454.CMB.1.raw
  modified_base (217)..(217): a, c, t, g, unknown or other
  misc_feature (217)..(217): n is a, c, g, or t
  modified_base (229)..(229): a, c, t, g, unknown or other
  misc_feature (229)..(229): n is a, c, g, or t
  modified_base (263)..(263): a, c, t, g, unknown or other
  misc_feature (263)..(263): n is a, c, g, or t
  modified_base (424)..(425): a, c, t, g, unknown or other
  misc_feature (424)..(425): n is a, c, g, or t
  modified_base (430)..(430): a, c, t, g, unknown or other
  misc_feature (430)..(430): n is a, c, g, or t
  modified_base (433)..(433): a, c, t, g, unknown or other
  misc_feature (433)..(433): n is a, c, g, or t
  modified_base (437)..(437): a, c, t, g, unknown or other
  misc_feature (437)..(437): n is a, c, g, or t
  modified_base (455)..(455): a, c, t, g, unknown or other
  misc_feature (455)..(455): n is a, c, g, or t
  modified_base (459)..(463): a, c, t, g, unknown or other
  misc_feature (459)..(463): n is a, c, g, or t
  modified_base (465)..(473): a, c, t, g, unknown or other
  misc_feature (465)..(473): n is a, c, g, or t
  modified_base (476)..(481): a, c, t, g, unknown or other
  misc_feature (476)..(481): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaaagaacacggtatatctgcaaatgaacagtctgagaggcaagacacggctgtttactctgtgcaagnggtggctggtcncatggatttgatctcgtggggccagggggacaanggtaaccgtctcttcagcctccaccgaagggcccatccggtcttccccctggccgccctgcctccaggacgccaacctccgagtacgcacgacgcggccctgggcctgcctggtacaaggtactactttcgatctctcgctggagcggctggacaaggcgnntaagnagngtancatcgatcgatcgatcangtcnnnnngnnnnnnnnngcnnnnnn

SEQ ID NO: 51497 - DNA, 585 bp, Homo sapiens
  misc_feature: GYAE6OF01EBIYW.11.61.F06.1.454.CMB.1.raw
  modified_base (222)..(222): a, c, t, g, unknown or other
  misc_feature (222)..(222): n is a, c, g, or t
  modified_base (536)..(536): a, c, t, g, unknown or other
  misc_feature (536)..(536): n is a, c, g, or t
  modified_base (542)..(547): a, c, t, g, unknown or other
  misc_feature (542)..(547): n is a, c, g, or t
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
  modified_base (556)..(557): a, c, t, g, unknown or other
  misc_feature (556)..(557): n is a, c, g, or t
  modified_base (561)..(563): a, c, t, g, unknown or other
  misc_feature (561)..(563): n is a, c, g, or t
  modified_base (565)..(567): a, c, t, g, unknown or other
  misc_feature (565)..(567): n is a, c, g, or t
  modified_base (569)..(574): a, c, t, g, unknown or other
  misc_feature (569)..(574): n is a, c, g, or t
  modified_base (576)..(576): a, c, t, g, unknown or other
  misc_feature (576)..(576): n is a, c, g, or t
  modified_base (578)..(578): a, c, t, g, unknown or other
  misc_feature (578)..(578): n is a, c, g, or t
  modified_base (580)..(581): a, c, t, g, unknown or other
  misc_feature (580)..(581): n is a, c, g, or t
  modified_base (583)..(585): a, c, t, g, unknown or other
  misc_feature (583)..(585): n is a, c, g, or t
tcagcgagagataccacgaccggtgctcgatttagctacgctctaagggaaggggcgtggtgtgggtctcacgtattgacaatgatgggagtgacacaatccacggcggattctgtgaggggccgtattcaccacttcgagagacaacgccaagaacacggtatatctgacaaatgaacatctgagaggcgaagacacggcttgtttacttctgtgacaagnggtggcgtggtcgcgagttgggtatttaggacttccgtcggtcgggggaccgaacgggggaacaaaggttacggtaacccgtttcgttacctttacaacgtacccctaccgaaaccgaaacggggtcccaacgtttccggtcccgtttcccccgtcgggtccgaccccgttggccctaccgaaggacgccaacctccggagaacacacgaacgcccggtaccgtaggctcgaccgtggtacgaaacggtctaccttacgtactaccgtctacgcctaggtacgggcgtagtacggacgacggtcgactagacgngtcatnnnnnnacncncgcnngcgnnncnnngnnnnnnancncnncnnn

SEQ ID NO: 51498 - DNA, 506 bp, Homo sapiens
  misc_feature: GYAE6OF01DUQGY.11.61.F06.1.454.CMB.1.raw
  modified_base (354)..(354): a, c, t, g, unknown or other
  misc_feature (354)..(354): n is a, c, g, or t
  modified_base (470)..(470): a, c, t, g, unknown or other
  misc_feature (470)..(470): n is a, c, g, or t
  modified_base (474)..(506): a, c, t, g, unknown or other
  misc_feature (474)..(506): n is a, c, g, or t
tcagcgagagataccacgaccggtgctcgatttagctacgctctaagggaaaggggctggtgtgggtctcacgtattgacaatgatggggagtgacacaatccacgcggattctgtgaggggccgattcaccacttcgagagacaacgccaagaacacggtatatctgcaaaatgaacagtctgagaggcgaaagacacggctgtttacttctgtgcaagaggtggctggtcgcatgggattttggattctcgtggggccgaaggggacaagtcggtaaaccgtctcttcagccctccaaccaagggcccagtcggtccttcccccgtggcccgtcccctgtcctccagggacnccacctccgacgagccaacacgccgggcccgtgggccttcgccgtggtacgaaaggaccttaacttccgtaatctactcgctggacggcgggctagggcaacgggcagaactaggncgannnnnnnnnnnnnnnnnnnnnnnnnnnnnnnnn

SEQ ID NO: 51499 - DNA, 542 bp, Homo sapiens
  misc_feature: GYAE6OF01EI6QY.11.61.F06.1.454.CMB.1.raw
  modified_base (507)..(507): a, c, t, g, unknown or other
  misc_feature (507)..(507): n is a, c, g, or t
  modified_base (511)..(542): a, c, t, g, unknown or other
  misc_feature (511)..(542): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttactctgtgcaagaggtggctggtcgcagtggatttgattcgtcgtggggccaggggacaagtcggtaaccgtctcttcagcccctaccaccgaagggcccatccggtcccttccccgtggccgtccctgcctccgaggtcgcctacctacccggagacgactaaccgacgtcccgggccccgttacggggcctccgggcccgttcggtaccgaaaccgggtacctttaacccgttaccgttacttccgttcctccgtcgttcgggacggcgggcgttcggacgaacgggccgtcaagttagcngacnnnnnnnnnnnnnnnnnnnnnnnnnnnnnnnn

SEQ ID NO: 51500 - DNA, 446 bp, Homo sapiens
  misc_feature: GYAE6OF01EIKAQ.11.61.F06.1.454.CMB.1.raw
  modified_base (435)..(435): a, c, t, g, unknown or other
  misc_feature (435)..(435): n is a, c, g, or t
  modified_base (438)..(446): a, c, t, g, unknown or other
  misc_feature (438)..(446): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggcttgttttacttctgtgcaaggaggtggctggtcgcagtggattttgattctcgtggggccaggggacaatggtaaccgtctcttcagcctccaccgaacggcccatccggtccttccccctggccgccctgcctccaggacgcacctccggagacgcacgacgccggccctgggctcgcctggtacacggacttacttccgtatctctcgctgacgcgggctggacgaggcgtcganagnnnnnnnnn

SEQ ID NO: 51501 - DNA, 427 bp, Homo sapiens
  misc_feature: GYAE6OF01BFPHZ.11.61.F06.1.454.CMB.1.raw
  modified_base (327)..(327): a, c, t, g, unknown or other
  misc_feature (327)..(327): n is a, c, g, or t
  modified_base (356)..(356): a, c, t, g, unknown or other
  misc_feature (356)..(356): n is a, c, g, or t
  modified_base (410)..(410): a, c, t, g, unknown or other
  misc_feature (410)..(410): n is a, c, g, or t
  modified_base (416)..(427): a, c, t, g, unknown or other
  misc_feature (416)..(427): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtggggccaggggacaagtggtaaaccgtctcttcagcctccaccaaggcccatcgtcttcccctggcgccctgctccaggncacctccgagagcacagccgccctgggcngcctggtacaaggacctacgttccgtatctctcgctgagcgggctggcaaggcncatagnnnnnnnnnnnn

SEQ ID NO: 51502 - DNA, 420 bp, Homo sapiens
  misc_feature: GYAE6OF01BKO6Q.11.61.F06.1.454.CMB.1.raw
  modified_base (404)..(404): a, c, t, g, unknown or other
  misc_feature (404)..(404): n is a, c, g, or t
  modified_base (410)..(420): a, c, t, g, unknown or other
  misc_feature (410)..(420): n is a, c, g, or t
tcagcgagagataccacgaccggtgctcgatttagctacgctctaagggaagggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtggggccagggggacaatggtaaccgtctcttcagcctccacaagggcccatcggtcttcccctggcgccctgctccaggacgcacctccgagagcacagcggccctggctgcctggcaaggactactccgtatctctcgctgagcgggctggcaaggcncatagnnnnnnnnnnn

SEQ ID NO: 51503 - DNA, 478 bp, Homo sapiens
  misc_feature: GYAE6OF01DRY2G.11.61.F06.1.454.CMB.1.raw
  modified_base (341)..(341): a, c, t, g, unknown or other
  misc_feature (341)..(341): n is a, c, g, or t
  modified_base (462)..(478): a, c, t, g, unknown or other
  misc_feature (462)..(478): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtggggccaggggacaagtggtaacccgtctcttcagcctccaccgaagggcccagtccggtccttcccccgtggcccgccctcgctccgaggacnccaccctccgagacgcacgacggccggcccgtgggcctcgcccgtggtaccaaggtaccttaccgttccgtatccttcgtcgctggacggcgggtcgtgggaccgaagggccgacagtagnnnnnnnnnnnnnnnnn

SEQ ID NO: 51504 - DNA, 522 bp, Homo sapiens
  misc_feature: GYAE6OF01CQKCW.11.61.F06.1.454.CMB.1.raw
  modified_base (322)..(322): a, c, t, g, unknown or other
  misc_feature (322)..(322): n is a, c, g, or t
  modified_base (481)..(481): a, c, t, g, unknown or other
  misc_feature (481)..(481): n is a, c, g, or t
  modified_base (485)..(486): a, c, t, g, unknown or other
  misc_feature (485)..(486): n is a, c, g, or t
  modified_base (490)..(492): a, c, t, g, unknown or other
  misc_feature (490)..(492): n is a, c, g, or t
  modified_base (494)..(501): a, c, t, g, unknown or other
  misc_feature (494)..(501): n is a, c, g, or t
  modified_base (503)..(522): a, c, t, g, unknown or other
  misc_feature (503)..(522): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaaagaacacggtatatctgacaaatgaacagtctgagaggcgaagacacggctgtttacttctgtgacaagaggtggctggtcgcatggatttgatctcgtggggccaggggacaatggtaaccgtctcttcacgcctccaccaagggcccagtccggtccttccccgtggccnccctgctccgaggcgccacctccggagacgccacgacgccggcccgtgggcctcgcccgtggtaccaaagggtaccttacgtttacccgtatccgttctaccgcgttggaacggccgggtaccgtgggaccgtaaacgggccgtacctaagttaacggngagnncgannnannnnnnnnannnnnnnnnnnnnnnnnnnn

SEQ ID NO: 51505 - DNA, 555 bp, Homo sapiens
  misc_feature: GYAE6OF01C5KKI.11.61.F06.1.454.CMB.1.raw
  modified_base (514)..(515): a, c, t, g, unknown or other
  misc_feature (514)..(515): n is a, c, g, or t
  modified_base (522)..(555): a, c, t, g, unknown or other
  misc_feature (522)..(555): n is a, c, g, or t
tcagcgagagataccacgaccggtgctcgatttagctacgctctaagggaaaggggctggtgtgggtctcacgttattgacaatgatgggagtgacacaatccacgcggattctgtgaggggccgattcaccattcgagagacaacgccaagaacacggtatatctgacaaatgaacagtctgagaggcgaaagacacggctgttttactctgtgcgaagaggtggctggtcgcagtggtatttgatcgtcggtgggaccgaggggaactaagtcggtaacccgtcttcttacacgtacccctaccgaccgaacggtccctaacgtccgttccctccccgtcgccctaccccgtcctacaacgacgccaccgtcggtcggggaccacgacggtcccggcccgttggcttcggccgttacggtacgaaacggtacccttaccggtttaccgtacttccgttccgtccggttcgacgggacggtcgggacgtcggacgtaacggcgtacaagtcgnngcagtgnnnnnnnnnnnnnnnnnnnnnnnnnnnnnnnnnn

SEQ ID NO: 51506 - DNA, 545 bp, Homo sapiens
  misc_feature: GYAE6OF01ETSSB.11.61.F06.1.454.CMB.1.raw
  modified_base (237)..(237): a, c, t, g, unknown or other
  misc_feature (237)..(237): n is a, c, g, or t
  modified_base (326)..(326): a, c, t, g, unknown or other
  misc_feature (326)..(326): n is a, c, g, or t
  modified_base (359)..(359): a, c, t, g, unknown or other
  misc_feature (359)..(359): n is a, c, g, or t
  modified_base (363)..(363): a, c, t, g, unknown or other
  misc_feature (363)..(363): n is a, c, g, or t
  modified_base (500)..(500): a, c, t, g, unknown or other
  misc_feature (500)..(500): n is a, c, g, or t
  modified_base (507)..(507): a, c, t, g, unknown or other
  misc_feature (507)..(507): n is a, c, g, or t
  modified_base (511)..(512): a, c, t, g, unknown or other
  misc_feature (511)..(512): n is a, c, g, or t
  modified_base (515)..(515): a, c, t, g, unknown or other
  misc_feature (515)..(515): n is a, c, g, or t
  modified_base (517)..(517): a, c, t, g, unknown or other
  misc_feature (517)..(517): n is a, c, g, or t
  modified_base (519)..(521): a, c, t, g, unknown or other
  misc_feature (519)..(521): n is a, c, g, or t
  modified_base (523)..(528): a, c, t, g, unknown or other
  misc_feature (523)..(528): n is a, c, g, or t
  modified_base (530)..(540): a, c, t, g, unknown or other
  misc_feature (530)..(540): n is a, c, g, or t
  modified_base (542)..(545): a, c, t, g, unknown or other
  misc_feature (542)..(545): n is a, c, g, or t
tcagcgagagataccacgaccggtgctcgatttagctacgctctaagggaaggggctggtgtgggtctcacgtattgacaatgatgggagtgacacaatccacgcggattctgtgaggggccattcaccacttcgagagacaacgccaaagaacacggtatatctgacaaaatgaaacagtctgagaggcgaaagacacggcttgttttaacttctgtgcaaggaggtggctggtcncagtggattttgatctcgtggggccaggggacaagtggtaaccgtctcttcagcctccaccgaacgggcccagtccggtccttccccgnggccgccctgctccaggctccaccgtccgagcncacncgccggcccgtgggcctcgtccgtggtaccaaacgggtaccttaaccgttcggtaacttccgtaccgttccggtacttcggaacgggccggggtaccgtcgggaaccgtaaacggggtccgaacgtaacgtacggangtcacgngcgnncgngngnnncnnnnnncnnnnnnnnnnnannnn

SEQ ID NO: 51507 - DNA, 576 bp, Homo sapiens
  misc_feature: GYAE6OF01EX8RO.11.61.F06.1.454.CMB.1.raw
  modified_base (177)..(177): a, c, t, g, unknown or other
  misc_feature (177)..(177): n is a, c, g, or t
  modified_base (521)..(521): a, c, t, g, unknown or other
  misc_feature (521)..(521): n is a, c, g, or t
  modified_base (533)..(533): a, c, t, g, unknown or other
  misc_feature (533)..(533): n is a, c, g, or t
  modified_base (537)..(540): a, c, t, g, unknown or other
  misc_feature (537)..(540): n is a, c, g, or t
  modified_base (543)..(543): a, c, t, g, unknown or other
  misc_feature (543)..(543): n is a, c, g, or t
  modified_base (547)..(576): a, c, t, g, unknown or other
  misc_feature (547)..(576): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgacaaatgaanagtctgaggaggcgaaagacgacggtcttgtttacttccgtgtagacaaggaggttggctaggtcgactatgggtaatttgactcgtcggtaggggccggaaggggtaacaaggttacggtaacccgttccttaccttacaaccggtccctaccgaaccgaacggggtcccctaacggtttccgggtacccctttccccccggtgggaccctcccgtacgccttaccgagggaccgtacctaccccgtaccgaaggtacgacaacgacggcccggacccgtgggacctcgccgtacggtacgaaacgtctaaccgttaccgtagtctcgtgccgtgacgcggtnagacagggccanacgnnnnagnatcnnnnnnnnnnnnnnnnnnnnnnnnnnnnnn

SEQ ID NO: 51508 - DNA, 633 bp, Homo sapiens
  misc_feature: GYAE6OF01A5TBX.11.61.F06.1.454.CMB.1.raw
  modified_base (597)..(597): a, c, t, g, unknown or other
  misc_feature (597)..(597): n is a, c, g, or t
  modified_base (599)..(599): a, c, t, g, unknown or other
  misc_feature (599)..(599): n is a, c, g, or t
  modified_base (601)..(607): a, c, t, g, unknown or other
  misc_feature (601)..(607): n is a, c, g, or t
  modified_base (609)..(633): a, c, t, g, unknown or other
  misc_feature (609)..(633): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaaagaacacggtatatctgacaaatcgaacagtctgagaggcgaaagacgacggcttgttttacttcgtgtgacgaaggaggttggcgtggtcgcagttgggtattttgacttcgtcggtcggggccgaggggaacaagttcggtaaccgtcttcttcgacgtccctacccgaaccgaaccggggcccctaacgttccggggttcccctttccccccgtcgggtccccgtcccccgtttcggccccgttaccggaaccgggtacgccccgtaaccccgtccgggaacgcgaccgaaccgcggggacccggccccggtcggggccctccgggccgttagggtaaccggaaccggttacccgttacccgtttccgtttacgttccgtccgtacggtcggacgggtaccggggcttacggggacccgaacgggtcgttaaccaagtgggtncngnnnnnnnannnnnnnnnnnnnnnnnnnnnnnnn

SEQ ID NO: 51509 - DNA, 416 bp, Homo sapiens
  misc_feature: GYAE6OF02HSG3Q.11.61.F06.1.454.CMB.1.raw
  modified_base (413)..(416): a, c, t, g, unknown or other
  misc_feature (413)..(416): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccagggggacaatggtaaccgtctcttcagcctccaccaagggcccatcggtcttccccctggcgccctgctccaggagcacctccgagagcacagcggccctgggctgcctggtcaaggactacttccgtatctctcgctgagcgggctggcaggcgcatagnnnn

SEQ ID NO: 51510 - DNA, 444 bp, Homo sapiens
  misc_feature: GYAE6OF02IQXH3.11.61.F06.1.454.CMB.1.raw
  modified_base (335)..(335): a, c, t, g, unknown or other
  misc_feature (335)..(335): n is a, c, g, or t
  modified_base (352)..(352): a, c, t, g, unknown or other
  misc_feature (352)..(352): n is a, c, g, or t
  modified_base (428)..(444): a, c, t, g, unknown or other
  misc_feature (428)..(444): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggattttgatctctggggccaggggacaagtggtaaccgtctcttcagcctccaccaagggcccatcggtcttcccccgtggccgccctgcctcccaggacncacctccgagacgcacngccgccctgggctgcctggtcaaggactacttccgtatctctcgctgacgcgggctcggcaagggcgcaagtcggnnnnnnnnnnnnnnnnn

SEQ ID NO: 51511 - DNA, 420 bp, Homo sapiens
  misc_feature: GYAE6OF02FY15X.11.61.F06.1.454.CMB.1.raw
  modified_base (415)..(420): a, c, t, g, unknown or other
  misc_feature (415)..(420): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccagggggacaatggtaaccgtctcttcagcctccaccaagggcccatcggtcttccccctggcgccctgctccaggagcacctccgagagcacagcggccctgggctgcctggtcaaggactacttccgtatctctcgctgagcgggctggcaaggcgcatagnnnnnn

SEQ ID NO: 51512 - DNA, 524 bp, Homo sapiens
  misc_feature: GYAE6OF02HI5P8.11.61.F06.1.454.CMB.1.raw
  modified_base (501)..(501): a, c, t, g, unknown or other
  misc_feature (501)..(501): n is a, c, g, or t
  modified_base (503)..(524): a, c, t, g, unknown or other
  misc_feature (503)..(524): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccagggggacaagtggtaaccgtctcttcagcctccaccgaacgggcccagtccggtccttcccccgtggccgccctcgcctccgagggcgccacccgtccggagacgccaacgacggcccggcccgtcggggcctcggcccgttgggtaccgaaacgggtacccttaccgtttacccgttacttccttccgtccgtccgttgggacgggtccggggtcgttcgggaccgtaaacggggccgactagtacgngnnnnnnnnnnnnnnnnnnnnnn

SEQ ID NO: 51513 - DNA, 416 bp, Homo sapiens
  misc_feature: GYAE6OF02GJMB0.11.61.F06.1.454.CMB.1.raw
  modified_base (413)..(416): a, c, t, g, unknown or other
  misc_feature (413)..(416): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaccgtctcttcagcctccaccaaggcccatcggtcttccccctggcgccctgctccaggagcacctccgagagcacagcggccctgggctgcctggtcaaggactacttccgtatctctcgctgagcgggctggcaaggcgcatagnnnn

SEQ ID NO: 51514 - DNA, 422 bp, Homo sapiens
  misc_feature: GYAE6OF02I3TDS.11.61.F06.1.454.CMB.1.raw
  modified_base (415)..(422): a, c, t, g, unknown or other
  misc_feature (415)..(422): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccagggggacaatggtaaccgtctcttcagcctccaccaagggcccatcggtcttcccctggcgccctgcctccaggacgcacctccgagagccacagcggccctgggctgcctggtcaaggactacttccgtatctctcgctgagcggctggcaggcgcatagnnnnnnnn

SEQ ID NO: 51515 - DNA, 415 bp, Homo sapiens
  misc_feature: GYAE6OF02IJHX8.11.61.F06.1.454.CMB.1.raw
  modified_base (409)..(415): a, c, t, g, unknown or other
  misc_feature (409)..(415): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaccgtctcttcagcctccaccaagggcccatcggtcttcccctggcgccctgctccaggagcacctccgagagcacagcggccctgggctgcctggtcaaggctacttccgatctctcgctgagcggctggcaaggcgcatagnnnnnnn

SEQ ID NO: 51516 - DNA, 416 bp, Homo sapiens
  misc_feature: GYAE6OF02H9N4M.11.61.F06.1.454.CMB.1.raw
  modified_base (384)..(384): a, c, t, g, unknown or other
  misc_feature (384)..(384): n is a, c, g, or t
  modified_base (413)..(416): a, c, t, g, unknown or other
  misc_feature (413)..(416): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctgggggccaggggacaatggtaaccgtctcttcagccctccaccaagggcccatcggtcttccccctggcgccctgctccaggagcacctccgagagcacagcggccctgggctgcctggtcaagactacttcgatctntcgctgagcgggctggcaaggcgcatagnnnn

SEQ ID NO: 51517 - DNA, 420 bp, Homo sapiens
  misc_feature: GYAE6OF02GTC7N.11.61.F06.1.454.CMB.1.raw
  modified_base (413)..(420): a, c, t, g, unknown or other
  misc_feature (413)..(420): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttactctgtgcaagaggtggctggtcgcatggatttgatctctggggccaggggacaatggtaaccgtctcttcagcctccaccaagggcccatcggtcttccccctggcgccctgctccaggacgcacctccgagagcacagcggccctgggctgcctggtcaaggctacttccgtatctctcgctgagcgggctggcaaggcgcatagnnnnnnnn

SEQ ID NO: 51518 - DNA, 418 bp, Homo sapiens
  misc_feature: GYAE6OF02HHOP2.11.61.F06.1.454.CMB.1.raw
  modified_base (413)..(418): a, c, t, g, unknown or other
  misc_feature (413)..(418): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctgggggccagggggacaatggtaaccgtctcttcagcctccaccaagggcccatcggtcttccccctggcgccctgctccaggagcacctccgagagcacagcggccctgggctgcctggtcaaggctacttccgtatctctcgctgagcggctggcaggcgcatagnnnnnn

SEQ ID NO: 51519 - DNA, 422 bp, Homo sapiens
  misc_feature: GYAE6OF02HACNH.11.61.F06.1.454.CMB.1.raw
  modified_base (414)..(422): a, c, t, g, unknown or other
  misc_feature (414)..(422): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccagggggacaatggtaaccgtctcttcagcctccaccaagggcccatcggtcttccccctggcgccctgctccaggacgcacctccgagagcacagcggcctggctgcctggtcaaggactacttccgtatctctcgctgagcgggctggcaaggcgcatagnnnnnnnnn

SEQ ID NO: 51520 - DNA, 420 bp, Homo sapiens
  misc_feature: GYAE6OF02I1YJK.11.61.F06.1.454.CMB.1.raw
  modified_base (328)..(328): a, c, t, g, unknown or other
  misc_feature (328)..(328): n is a, c, g, or t
  modified_base (413)..(420): a, c, t, g, unknown or other
  misc_feature (413)..(420): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtggggccagggggacaatggtaaccgtctcttcagcctccaccaagggcccatcggtcttcccctggcgccctgctccaggncacctccgagagcacagcggccctgggctgcctggtcaaggctacttccgtatctctcgctgagcgggctggcaaggcgcatagnnnnnnnn

SEQ ID NO: 51521 - DNA, 418 bp, Homo sapiens
  misc_feature: GYAE6OF02FYS5Q.11.61.F06.1.454.CMB.1.raw
  modified_base (411)..(418): a, c, t, g, unknown or other
  misc_feature (411)..(418): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccagggggacaatggtaaccgtctcttcagcctccaccaaggcccatcggtcttcccctggcgccctgctccagagcacctccgagagcacagcggccctgggctgcctggtcaaggactacttccgtatctctcgctgagcgggctggcaaggcgcatagnnnnnnnn

SEQ ID NO: 51522 - DNA, 422 bp, Homo sapiens
  misc_feature: GYAE6OF02HEDVE.11.61.F06.1.454.CMB.1.raw
  modified_base (272)..(272): a, c, t, g, unknown or other
  misc_feature (272)..(272): n is a, c, g, or t
  modified_base (409)..(409): a, c, t, g, unknown or other
  misc_feature (409)..(409): n is a, c, g, or t
  modified_base (414)..(422): a, c, t, g, unknown or other
  misc_feature (414)..(422): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaagtggtaaccgtntcttcagcctccaccaaggcccatcggtcttcccctggccgccctgctccaggacgcacctccgagagcacagccggcctgggctgcctggtcaaaggactacttcgtatctctcgctgagcgggctggcaaggcgnatagnnnnnnnnn

SEQ ID NO: 51523 - DNA, 422 bp, Homo sapiens
  misc_feature: GYAE6OF02IFY34.11.61.F06.1.454.CMB.1.raw
  modified_base (217)..(217): a, c, t, g, unknown or other
  misc_feature (217)..(217): n is a, c, g, or t
  modified_base (414)..(422): a, c, t, g, unknown or other
  misc_feature (414)..(422): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagnggtggctggtcgcatggattttgatctctggggccagggggacaatggtaaccgtctcttcagcctccaccaagggcccatcggtcttccccctggccgccctgctccaggagcacctccgagagcacagcggccctgggctgcctggtcaagctacttccgtatctctcgctgagcgggctggcaggcgcatacgnnnnnnnnn

SEQ ID NO: 51524 - DNA, 437 bp, Homo sapiens
  misc_feature: GYAE6OF02IYRMS.11.61.F06.1.454.CMB.1.raw
  modified_base (425)..(437): a, c, t, g, unknown or other
  misc_feature (425)..(437): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtggggccaggggacaatggtaaccgtctcttcagcctccaccaagggcccatcggtccttccccctggccgccctgctcccaggacgccacctccgagacgcacacgccggcccgtgggctgcctggtcaaggactacttccgtatcctctcgctgacgcgggctggcaaggcgcatagnnnnnnnnnnnnn

SEQ ID NO: 51525 - DNA, 415 bp, Homo sapiens
  misc_feature: GYAE6OF02HCLD1.11.61.F06.1.454.CMB.1.raw
  modified_base (411)..(415): a, c, t, g, unknown or other
  misc_feature (411)..(415): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctgggggccagggggacaatggtaaccgtctcttcagcctccaccaagggcccatcggtcttcccctggcgccctgctccaggagcacctccgagagcacagcggcctgggctgctggcaaggactacttccgtatctctcgctgagcgggctggcaggcgcatagnnnnn

SEQ ID NO: 51526 - DNA, 431 bp, Homo sapiens
  misc_feature: GYAE6OF02JGQVU.11.61.F06.1.454.CMB.1.raw
  modified_base (229)..(229): a, c, t, g, unknown or other
  misc_feature (229)..(229): n is a, c, g, or t
  modified_base (274)..(274): a, c, t, g, unknown or other
  misc_feature (274)..(274): n is a, c, g, or t
  modified_base (313)..(313): a, c, t, g, unknown or other
  misc_feature (313)..(313): n is a, c, g, or t
  modified_base (417)..(431): a, c, t, g, unknown or other
  misc_feature (417)..(431): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaaagaacacggtatatctgcaaatgaacagtctgagaggcgaagacacggctgtttacttctgtgcaagaggtgctggtcncatggattttggatctctggggccaggggacaagtggtaaccgtntcttcagcctccaccaagggcccatcggtccttcccccnggccgccctgcctccaggcgcacctccgagagcacagcgccctgggctgcctggtcaaggactctccgtatctctcgctgcgcggctggctaacggcgcatagnnnnnnnnnnnnnnn

SEQ ID NO: 51527 - DNA, 433 bp, Homo sapiens
  misc_feature: GYAE6OF02HJ1YR.11.61.F06.1.454.CMB.1.raw
  modified_base (421)..(433): a, c, t, g, unknown or other
  misc_feature (421)..(433): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtggggccagggggacaagtggtaaccgtctcttcagcctccaccaagggcccatccggtccttccccctggccgccctgcctccgaggagccacctccgagacgcacagcgccctggctgcctggtcaaggactacttccgttctctgctgacgcgggctggcaaggcgcatagnnnnnnnnnnnnn

SEQ ID NO: 51528 - DNA, 423 bp, Homo sapiens
  misc_feature: GYAE6OF02ICUF0.11.61.F06.1.454.CMB.1.raw
  modified_base (418)..(423): a, c, t, g, unknown or other
  misc_feature (418)..(423): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggattttgatctctggggccaggggacaatggtaaaccgtctcttcagcctccaccaaggccatcggtcttcccctggcgcctgctccaggacgcacctccgagacgcacaggccggccctgggctgccgtggtcaaggactacttccgtatctctcgctgaggcgggctggcagggcgcatagnnnnnn

SEQ ID NO: 51529 - DNA, 434 bp, Homo sapiens
  misc_feature: GYAE6OF02HAN5D.11.61.F06.1.454.CMB.1.raw
  modified_base (414)..(414): a, c, t, g, unknown or other
  misc_feature (414)..(414): n is a, c, g, or t
  modified_base (421)..(434): a, c, t, g, unknown or other
  misc_feature (421)..(434): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttactctgtgcaagaggtggctggtcgcatggatttgatctcgtggggccagggggacaatggtaaccgtctcttcagcctccaccaagggcccatcggtcttccccctggccgccctgcctccaggagcacctccgagagccacacgccggccctgggcctgcctggtcaaggctacttccgtatctctcgctgagcgggctggcaagggcncagtagnnnnnnnnnnnnnn

SEQ ID NO: 51530 - DNA, 428 bp, Homo sapiens
  misc_feature: GYAE6OF02H1EUQ.11.61.F06.1.454.CMB.1.raw
  modified_base (354)..(354): a, c, t, g, unknown or other
  misc_feature (354)..(354): n is a, c, g, or t
  modified_base (418)..(418): a, c, t, g, unknown or other
  misc_feature (418)..(418): n is a, c, g, or t
  modified_base (422)..(428): a, c, t, g, unknown or other
  misc_feature (422)..(428): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttactctgtgcaagaggtggctggtcgcatggatttgattctcgtggggccaggggacaagtggtaaccgtctcttcagcctccaccaacgggcccatcggtccttcccccgtggccgccctgcctccgaggacgccacctccgagagcacncgccggccctgggctgcctggtcaagactacttccgtatctctcgctgagcggctggacaggcncatnnnnnnn

SEQ ID NO: 51531 - DNA, 423 bp, Homo sapiens
  misc_feature: GYAE6OF02HU62U.11.61.F06.1.454.CMB.1.raw
  modified_base (414)..(414): a, c, t, g, unknown or other
  misc_feature (414)..(414): n is a, c, g, or t
  modified_base (420)..(423): a, c, t, g, unknown or other
  misc_feature (420)..(423): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtggggccagggggacaatggtaaccgtctcttcagcctccaccaagggcccatccggtcttccccctggccgccctgcctccaggacgcacctccgagagcacagccggccctgggcctcgcctggtcaaggactacttccgtatctctcgctgagcggctggcaggcncatagnnnn

SEQ ID NO: 51532 - DNA, 429 bp, Homo sapiens
  misc_feature: GYAE6OF02FUNUB.11.61.F06.1.454.CMB.1.raw
  modified_base (415)..(429): a, c, t, g, unknown or other
  misc_feature (415)..(429): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctgggggccagggggacaatggtaaccgtctcttcagcctccaccaagggcccatcggtcttccccctggcgccctgctccagagcacctcgagagcacagcggccctgggctgcctggtcaaggactacttccgtatctctcgctgagcgggctggcaagggcgcatagnnnnnnnnnnnnnnn

SEQ ID NO: 51533 - DNA, 420 bp, Homo sapiens
  misc_feature: GYAE6OF02GIMMP.11.61.F06.1.454.CMB.1.raw
  modified_base (341)..(341): a, c, t, g, unknown or other
  misc_feature (341)..(341): n is a, c, g, or t
  modified_base (409)..(409): a, c, t, g, unknown or other
  misc_feature (409)..(409): n is a, c, g, or t
  modified_base (414)..(420): a, c, t, g, unknown or other
  misc_feature (414)..(420): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtggggccagggggacaatggtaaccgtctcttcagcctccaccaagggcccatcggtcttccccctggccgccctgctccaggagcacctccganagcacagcggccctgggctgcctggtcaaggactacttccgtatctctcgctgagcggctggcaggcncatgnnnnnnn

SEQ ID NO: 51534 - DNA, 495 bp, Homo sapiens
  misc_feature: GYAE6OF02JKWP0.11.61.F06.1.454.CMB.1.raw
  modified_base (199)..(199): a, c, t, g, unknown or other
  misc_feature (199)..(199): n is a, c, g, or t
  modified_base (210)..(210): a, c, t, g, unknown or other
  misc_feature (210)..(210): n is a, c, g, or t
  modified_base (317)..(317): a, c, t, g, unknown or other
  misc_feature (317)..(317): n is a, c, g, or t
  modified_base (359)..(359): a, c, t, g, unknown or other
  misc_feature (359)..(359): n is a, c, g, or t
  modified_base (466)..(466): a, c, t, g, unknown or other
  misc_feature (466)..(466): n is a, c, g, or t
  modified_base (468)..(495): a, c, t, g, unknown or other
  misc_feature (468)..(495): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggntgtttacttcngtgacaagagggtggctggtcgcagtggatttgatctcgtggggccaggggacaagtggtaaccgtctcttcagcctccacgaaggcccagtccggtccttccccgnggccgccctgcctccctaggcgcacctccggagacgcaaccngcccggcctggggcctggacccgtggtaccaacgggtacctaccttccgtactccgttctaccgtcgtgaacggtccggggctacgggcaacgggtcgacagtacgncnnnnnnnnnnnnnnnnnnnnnnnnnnnn

SEQ ID NO: 51535 - DNA, 552 bp, Homo sapiens
  misc_feature: GYAE6OF02H8P9Q.11.61.F06.1.454.CMB.1.raw
  modified_base (517)..(517): a, c, t, g, unknown or other
  misc_feature (517)..(517): n is a, c, g, or t
  modified_base (519)..(552): a, c, t, g, unknown or other
  misc_feature (519)..(552): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggattttgatctcgtggggccaggggacaatggtaaccgtctcttcagcctccaccgaaggcccagtccggtcttcccccgtggccgccctgcctccgaggacgccacctccgagacgccacgacggccggcccgtggggcctacggccgttcgggtaccgaaaacgggtaccttaacccgtttcccggtaactttcccgttccttccgtccgttacggaacgggtcccggggtaccgttacggggaccgaaacggggtcccggaccgtaacggttaaggctgngnnnnnnnnnnnnnnnnnnnnnnnnnnnnnnnnnn

SEQ ID NO: 51536 - DNA, 435 bp, Homo sapiens
  misc_feature: GYAE6OF02IFWSI.11.61.F06.1.454.CMB.1.raw
  modified_base (218)..(218): a, c, t, g, unknown or other
  misc_feature (218)..(218): n is a, c, g, or t
  modified_base (317)..(317): a, c, t, g, unknown or other
  misc_feature (317)..(317): n is a, c, g, or t
  modified_base (330)..(330): a, c, t, g, unknown or other
  misc_feature (330)..(330): n is a, c, g, or t
  modified_base (405)..(405): a, c, t, g, unknown or other
  misc_feature (405)..(405): n is a, c, g, or t
  modified_base (413)..(413): a, c, t, g, unknown or other
  misc_feature (413)..(413): n is a, c, g, or t
  modified_base (415)..(435): a, c, t, g, unknown or other
  misc_feature (415)..(435): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagnggtggctggtcgcatggattttgatctcgtgggggccagggggacaatggtaaccgtctcttcagcctccaccaagggccatcggtcttccccctggcnccctgctccaggncacctcgagcgcacagcgccctggctgctggtcaagctacttccgtatctctcgctgagcggctggacagggcgntactagancnnnnnnnnnnnnnnnnnnnnn

SEQ ID NO: 51537 - DNA, 448 bp, Homo sapiens
  misc_feature: GYAE6OF02HB35F.11.61.F06.1.454.CMB.1.raw
  modified_base (435)..(435): a, c, t, g, unknown or other
  misc_feature (435)..(435): n is a, c, g, or t
  modified_base (440)..(448): a, c, t, g, unknown or other
  misc_feature (440)..(448): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctcgtggggccaggggacaagtggtaaccgtctcttcagcctccaccaacgggcccatccggtccttccccccgtggccgccccgtgcctcccgaggacgccaccctccgagacgcacgacgcgcccgtgggctcgccgtggtccaacggtactacgtccgtatctctcgctgacgcgggctgacgaaggcgnatagnnnnnnnnn

SEQ ID NO: 51538 - DNA, 505 bp, Homo sapiens
  misc_feature: GYAE6OF02GM5Y3.11.61.F06.1.454.CMB.1.raw
  modified_base (284)..(284): a, c, t, g, unknown or other
  misc_feature (284)..(284): n is a, c, g, or t
  modified_base (342)..(342): a, c, t, g, unknown or other
  misc_feature (342)..(342): n is a, c, g, or t
  modified_base (361)..(361): a, c, t, g, unknown or other
  misc_feature (361)..(361): n is a, c, g, or t
  modified_base (474)..(474): a, c, t, g, unknown or other
  misc_feature (474)..(474): n is a, c, g, or t
  modified_base (477)..(505): a, c, t, g, unknown or other
  misc_feature (477)..(505): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggcttgtttacttctgtgcaaggaggtggctggtcgcagtggatttgatctcgtggggccaggggacaagtcggtaacctctcttcanccctccacgaacggcccagtccggtccttccccctggcccgccctgcctccgaggacncctacctccgagacgcacncggccggtcccgtgggccttcgccgttaggtaccgaacggtacccttaccgttccgtacttcgtcctcgcgtggacggccgggtcgtggaccgaacgggccgacgagttaggncgnnnnnnnnnnnnnnnnnnnnnnnnnnnnn

SEQ ID NO: 51539 - DNA, 420 bp, Homo sapiens
  misc_feature: GYAE6OF02G33MF.11.61.F06.1.454.CMB.1.raw
  modified_base (411)..(420): a, c, t, g, unknown or other
  misc_feature (411)..(420): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccagggggacaatggtaaccgtctcttcagcctccaccaaggcccatcggtcttccccctggcgccctgctccaggagcacctccgagagcacagcggccctgggctgctggtcaaggactacttccgatctctcgctgagcgggctggcaaggcgcatagnnnnnnnnnn

SEQ ID NO: 51540 - DNA, 510 bp, Homo sapiens
  misc_feature: GYAE6OF02ISJGX.11.61.F06.1.454.CMB.1.raw
  modified_base (209)..(209): a, c, t, g, unknown or other
  misc_feature (209)..(209): n is a, c, g, or t
  modified_base (229)..(229): a, c, t, g, unknown or other
  misc_feature (229)..(229): n is a, c, g, or t
  modified_base (376)..(376): a, c, t, g, unknown or other
  misc_feature (376)..(376): n is a, c, g, or t
  modified_base (482)..(510): a, c, t, g, unknown or other
  misc_feature (482)..(510): n is a, c, g, or t
tcagcgagagataccacgaccggtgctcgatttagctacgctctaagggaaggggctggtgtgggtctcacgtattgacaatgatgggagtgacacaatccacgcggattctgtgaggggccgattcaccacttcgagagacaacgccaagaacacggtatatctgaaaatgaacagtctgagaggcgaagacacggctgtttacttcngtgcaagaggtggctggtcncatggattttgatctcgtggggccaggggaccaagtggtaacccgtctcgttcagccctccaccaagggccccaatccgggtcctttccccccgtggccgccctcgcttcccgaggacgcctacccgtccggaacgacgccgaaccnggcccggtcccggtacgggcttccgacccgttgggtaccgaaggtacctacgtttccgtactccttcgtcgctgacggcggcgtggcgaacggcgcagtagcagcnnnnnnnnnnnnnnnnnnnnnnnnnnnnn

SEQ ID NO: 51541 - DNA, 546 bp, Homo sapiens
  misc_feature: GYAE6OF02JOSGD.11.61.F06.1.454.CMB.1.raw
  modified_base (115)..(115): a, c, t, g, unknown or other
  misc_feature (115)..(115): n is a, c, g, or t
  modified_base (212)..(212): a, c, t, g, unknown or other
  misc_feature (212)..(212): n is a, c, g, or t
  modified_base (215)..(215): a, c, t, g, unknown or other
  misc_feature (215)..(215): n is a, c, g, or t
  modified_base (327)..(327): a, c, t, g, unknown or other
  misc_feature (327)..(327): n is a, c, g, or t
  modified_base (357)..(357): a, c, t, g, unknown or other
  misc_feature (357)..(357): n is a, c, g, or t
  modified_base (500)..(500): a, c, t, g, unknown or other
  misc_feature (500)..(500): n is a, c, g, or t
  modified_base (510)..(510): a, c, t, g, unknown or other
  misc_feature (510)..(510): n is a, c, g, or t
  modified_base (517)..(520): a, c, t, g, unknown or other
  misc_feature (517)..(520): n is a, c, g, or t
  modified_base (522)..(522): a, c, t, g, unknown or other
  misc_feature (522)..(522): n is a, c, g, or t
  modified_base (524)..(546): a, c, t, g, unknown or other
  misc_feature (524)..(546): n is a, c, g, or t
tcagcgagagataccacgaccggtgctcgatttagctacgctctaagggaaaggggcgtgggtgtgggtctcacgtattgacaatgatgggagtgacacaatccacgcggattcngtgaggggccgattcaccacttcgagagacaacgccaagaacacggtatatctgacaaatgaacagtctgagagcgaagacacggcttgtttactcngtncaagtaggtggctggtcgacatggtattttgatctcgtggggccgagggacagtacggtaaccgtcttacttcagccctaccaccgaacggcccagtccggtccttccccgngccgccctgcctcgaggctcaccgtcgacngccacgacgccggcctagggctcggtcccgtggtacccaaacgggtaccttaccgtttccgtactccgtccttccggacgttcggacgggtaccgggtccgttacgggaccggttaacgggccgaaccgttacgaaggtctancggatcgacnacgttcnnnngngnnnnnnnnnnnnnnnnnnnnnnn

SEQ ID NO: 51542 - DNA, 681 bp, Homo sapiens
  misc_feature: GYAE6OF02HV8NT.11.61.F06.1.454.CMB.1.raw
  modified_base (259)..(259): a, c, t, g, unknown or other
  misc_feature (259)..(259): n is a, c, g, or t
  modified_base (280)..(280): a, c, t, g, unknown or other
  misc_feature (280)..(280): n is a, c, g, or t
  modified_base (323)..(323): a, c, t, g, unknown or other
  misc_feature (323)..(323): n is a, c, g, or t
  modified_base (575)..(575): a, c, t, g, unknown or other
  misc_feature (575)..(575): n is a, c, g, or t
  modified_base (617)..(617): a, c, t, g, unknown or other
  misc_feature (617)..(617): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgctatggtatttgatctgtcccccgggggnaggggacaagtggtaaccgtntcttcagcctacaccgaagggcccagtccggtccttcccccgnggccgccctgcctccgaggacgccacctcggaagacgaccgaacgcggccggtccccgtagggggtcccttcgggacccgttacgggtaccgtaaaacgggtacccttttaaacccgtttacccggttaacgtttcccgttaacccgtcccggtaccgttacggggtaccgggtccggggtaccgtaacgggggtaaaccgaaaccgggggaccggtaacccgtaaagttaacgggtagaacgcgtagtacnctacgacgacgacgacgacgcgtacgacgtacgtacgtacgngtacgtacgtagagacgtacgtaaggtacgacgacgtacgtacgaccgtcgacgacgacgtacg

SEQ ID NO: 51543 - DNA, 540 bp, Homo sapiens
  misc_feature: GYAE6OF02GJ7EG.11.61.F06.1.454.CMB.1.raw
  modified_base (502)..(502): a, c, t, g, unknown or other
  misc_feature (502)..(502): n is a, c, g, or t
  modified_base (506)..(507): a, c, t, g, unknown or other
  misc_feature (506)..(507): n is a, c, g, or t
  modified_base (510)..(540): a, c, t, g, unknown or other
  misc_feature (510)..(540): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtgctggtcgcatggatttgatctcgtggggccaggggacaagtggtaaccgtctcttcacgcctccgaccgaacgggccctagtccggtcccttcccccgtcgggcccgtccccgtcggccttccgagggacgcctacccgtccggagacgaccacgacggcccgggtcccgtggggctacggtccgtgggtaccgaaacgggtaccttaccgtttccgtactccgttccgtcgtcgtcggacgggccgggtctcgggacgaagggtcccgactaagtaggntcgnngcnnnnnnnnnnnnnnnnnnnnnnnnnnnnnnn

SEQ ID NO: 51544 - DNA, 599 bp, Homo sapiens
  misc_feature: GYAE6OF02FG1L0.11.61.F06.1.454.CMB.1.raw
  modified_base (221)..(221): a, c, t, g, unknown or other
  misc_feature (221)..(221): n is a, c, g, or t
  modified_base (232)..(232): a, c, t, g, unknown or other
  misc_feature (232)..(232): n is a, c, g, or t
  modified_base (286)..(286): a, c, t, g, unknown or other
  misc_feature (286)..(286): n is a, c, g, or t
  modified_base (517)..(517): a, c, t, g, unknown or other
  misc_feature (517)..(517): n is a, c, g, or t
  modified_base (528)..(528): a, c, t, g, unknown or other
  misc_feature (528)..(528): n is a, c, g, or t
  modified_base (532)..(532): a, c, t, g, unknown or other
  misc_feature (532)..(532): n is a, c, g, or t
  modified_base (535)..(535): a, c, t, g, unknown or other
  misc_feature (535)..(535): n is a, c, g, or t
  modified_base (556)..(556): a, c, t, g, unknown or other
  misc_feature (556)..(556): n is a, c, g, or t
tcagcgagagataccacgaccggtgctcgatttagctacgctctaagggaaaggggctggtgtgggtctcacgtattgacaatgatgggagtgacacaatccacgcggattctgtgaggggccgattcaccacttcgagagacaacgccaagaacacggtatatctgacaaatgaacagtctgagaggcgaagacacggcttgtttacttctgtgcaaggngtggcgtgtcncagttggattttggactcgtcgtggggccagggacaagttcggtaaccgtcttnttacagtccctaccaccgtaagggcccctattccggtaccttcccccgtggccgcccgtgcctccgaggtacgacctccgtaccgtagacgctacgacggtccggccgtgggtctcggccgttggtacgaaccggtaaccttacgttcccggttactaccgtccgtacgttcgaggtaggcccgggttacggcggtaaccgaagggccgtaacgagttacgagctagctancttaagcctancgancancacacgactgtacactacganacgctacgtactctacgtacgacgcgactagcgtacgcgtacg

SEQ ID NO: 51545 - DNA, 855 bp, Homo sapiens
  misc_feature: GYAE6OF02HAE1E.11.61.F06.1.454.CMB.1.raw
  modified_base (748)..(748): a, c, t, g, unknown or other
  misc_feature (748)..(748): n is a, c, g, or t
  modified_base (755)..(755): a, c, t, g, unknown or other
  misc_feature (755)..(755): n is a, c, g, or t
  modified_base (787)..(787): a, c, t, g, unknown or other
  misc_feature (787)..(787): n is a, c, g, or t
  modified_base (851)..(851): a, c, t, g, unknown or other
  misc_feature (851)..(851): n is a, c, g, or t
tcagcgagagataccacgaccggtgctcgatttagctacgctctaagggaaaggggctggtgtgggtctcacgtattgacaatgatgggagtgacacaatccacgcggtattctgtgaggggccattcaccacttcgagagacaacgccaagaacacggtatatctgacaaatgaacagtctggagaggacgaagaccacggtcttacgttttacttcgtgtcgacgaaaggtagggttgggccgttagggtccggacctagttagggttacttttaggacttccgtttaccgggacgggggggacccggtaaggggggtaacctaaaggttaccgggttaaacccggttccttccgtttaccggaccggtcccctaccccgaaacccggtaaccgggggtaccccctaacgtttcccgggttccccttttaccccccggcgggggtaccccgtccccgtaccggtacccgtttacccggaacgggaccgtaccccgaacccggttaccccggggaagggaccgaccgtaaaccggaccgggtccccggggtccccggtacggggggtcccttcgggtacccggtttacgggttaaccgaaccggtttaacccgtttacccgtttaccccggttacgtttaccccgttccggttacggtacccggttacggtaaccggggtcccggggtccgggttaacggggaccggtaacgggtaccggtaaccgtaggttaacggtcgtagcgtntacgcgngtacgacgtacgtgcgtcgtcgtacgtactancgacgtacgtacgtacgtaccgctcgtacggtagtcgtcgtacggtcgcgaacggactacggtntacg

SEQ ID NO: 51546 - DNA, 123 bp, Homo sapiens
  misc_feature: GYAE6OF01BP9TN.48.66.F11.1.454.CMB.1.raw
  modified_base (123)..(123): a, c, t, g, unknown or other
  misc_feature (123)..(123): n is a, c, g, or t
tcagagtatacatacacgaccggtgctcgatttagtcacgcgagaagggaagggctggccctgacgtgtttctgttcccacctcctctatgtatactctgagcgggctggcaaggcgcatagn

SEQ ID NO: 51547 - DNA, 125 bp, Homo sapiens
  misc_feature: GYAE6OF01DA5PT.48.66.F11.1.454.CMB.1.raw
  modified_base (125)..(125): a, c, t, g, unknown or other
  misc_feature (125)..(125): n is a, c, g, or t
tcagagtatacatacacgaccggtgctcgatttagtcacgcgagaagggaaggggctggccctagcgtgttcctgttcccaccctcctctatgtatactctgagcgggctggcaaggcgcatagn

SEQ ID NO: 51548 - DNA, 125 bp, Homo sapiens
  misc_feature: GYAE6OF01D0G9R.48.66.F11.1.454.CMB.1.raw
tcagagtatacatacacgaccggtgctcgatttagtcacgcgagaagggaaaggggctggccctgacgtgtttctgttcccaccctcctctatgtatactctgagcgggctggcaaggcgcatag

SEQ ID NO: 51549 - DNA, 137 bp, Homo sapiens
  misc_feature: GYAE6OF01CPILP.48.66.F11.1.454.CMB.1.raw
  modified_base (125)..(137): a, c, t, g, unknown or other
  misc_feature (125)..(137): n is a, c, g, or t
tcagagtatacatacacgaccggtgctcgatttagtcacgcgagaagggaaggggctggccctgacgtgtttctgttcccgccctcctctatgtatactctgagcgggctggcaaggcgcatagnnnnnnnnnnnnn

SEQ ID NO: 51550 - DNA, 148 bp, Homo sapiens
  misc_feature: GYAE6OF02F8B22.48.66.F11.1.454.CMB.1.raw
  modified_base (127)..(148): a, c, t, g, unknown or other
  misc_feature (127)..(148): n is a, c, g, or t
tcagagtatacatacacgaccggtgctcgatttagtcacgcgagaagggaaggggtcgtggccctgacgtgtttctgttcccgcctcctctatgtactactctgagcgggctggcaaggcgcatagnnnnnnnnnnnnnnnnnnnnnn

SEQ ID NO: 51551 - DNA, 127 bp, Homo sapiens
  misc_feature: GYAE6OF02JBQ7M.48.66.F11.1.454.CMB.1.raw
  modified_base (124)..(127): a, c, t, g, unknown or other
  misc_feature (124)..(127): n is a, c, g, or t
tcagagtatacatacacgaccggtgctcgatttagtcacgcgagaagggaaggggctggccctgacgtgtttctgttcccacctcctctatgtatactctgagcgggctggcaaggcgcatagnnnn

SEQ ID NO: 51552 - DNA, 172 bp, Homo sapiens
  misc_feature: GYAE6OF01DUAR8.8.45.E01.1.454.CMB.1.raw
  modified_base (171)..(172): a, c, t, g, unknown or other
  misc_feature (171)..(172): n is a, c, g, or t
tcagctcgcgtgtccacgaccggtgctcgatttagtgagtcagtaagggaaagggatgagaacctatgaacattctgtaggggccactgtcttctccaaggctgcccccacggtcactctgttcccaccctcctcgacacgcgagctgagcgggctggcaaggcgcatagnn

SEQ ID NO: 51553 - DNA, 169 bp, Homo sapiens
  misc_feature: GYAE6OF01C7I72.8.45.E01.1.454.CMB.1.raw
  modified_base (169)..(169): a, c, t, g, unknown or other
  misc_feature (169)..(169): n is a, c, g, or t
tcagctcgcgtgtccacgaccggtgctcgatttagtgagtcagtaagggaaagggatgagaacctatgaacattctgtaggggccactgtcttctccaaggctgcccccacggtcactctgttcccacctcctcgacagcgagctgagcgggctggcaaggcgcatagn

SEQ ID NO: 51554 - DNA, 168 bp, Homo sapiens
  misc_feature: GYAE6OF02G1ZJU.8.45.E01.1.454.CMB.1.raw
  modified_base (168)..(168): a, c, t, g, unknown or other
  misc_feature (168)..(168): n is a, c, g, or t
tcagctcgcgtgtccacgaccggtgctcgatttagtgagtcagtaagggaagggatgagaacctatgaacattctgtagggccactgtcttctccaaggctgccccacggtcactctgttcccgccctcctcgacacgcgagctgagcgggctggcaaggcgcatagn

SEQ ID NO: 51555 - DNA, 170 bp, Homo sapiens
  misc_feature: GYAE6OF02ITVRS.8.45.E01.1.454.CMB.1.raw
  modified_base (170)..(170): a, c, t, g, unknown or other
  misc_feature (170)..(170): n is a, c, g, or t
tcagctcgcgtgtccacgaccggtgctcgatttagtgagtcagtaagggaaagggatgagaacctatgaacattctgtaggggccactgtcttctccaaggctgccccacggtcactctgttcccaccctcctcgacacgcgagctgagcgggctggcaaggcgcatagn

SEQ ID NO: 51556 - DNA, 171 bp, Homo sapiens
  misc_feature: GYAE6OF02F6XUK.8.45.E01.1.454.CMB.1.raw
  modified_base (170)..(171): a, c, t, g, unknown or other
  misc_feature (170)..(171): n is a, c, g, or t
tcagctcgcgtgtccacgaccggtgctcgatttagtgagtcagtaagggaaagggatgagaacctatgaacattctgtagggccactgtcttctccaaggctgcccccacggtcactctgttcccaccctcctcgacacgcgagctgagcgggctggcaaggcgcatagnn

SEQ ID NO: 51557 - DNA, 166 bp, Homo sapiens
  misc_feature: GYAE6OF02FGGSP.8.45.E01.1.454.CMB.1.raw
  modified_base (166)..(166): a, c, t, g, unknown or other
  misc_feature (166)..(166): n is a, c, g, or t
tcagctcgcgtgtccacgaccggtgctcgatttagtgagtcagtaagggaagggatgagaacctatgaacattctgtagggccactgtcttctccaaggctgccccacggtcactctgttcccaccctcctcgacagcgagctgagcggctggcaaggcgcatagn

SEQ ID NO: 51558 - DNA, 192 bp, Homo sapiens
  misc_feature: GYAE6OF02G07S0.8.45.E01.1.454.CMB.1.raw
  modified_base (171)..(192): a, c, t, g, unknown or other
  misc_feature (171)..(192): n is a, c, g, or t
tcagctcgcgtgtccacgaccggtgctcgatttagtgagtcagtaagggaaagggatgagaacctatgaacattctgtaggggccactgtcttctccaaggctgcccccacggtcactctgttcccaccctcctcgacacgcgagctgagcgggctggcaaggcgcatagnnnnnnnnnnnnnnnnnnnnnn

SEQ ID NO: 51559 - DNA, 171 bp, Homo sapiens
  misc_feature: GYAE6OF02I31A8.8.45.E01.1.454.CMB.1.raw
  modified_base (171)..(171): a, c, t, g, unknown or other
  misc_feature (171)..(171): n is a, c, g, or t
tcagctcgcgtgtccacgaccggtgctcgatttagtgagtcagtaagggaaagggatgagaacctatgaacattctgtaggggccactgtcttctccaaggctgcccccacggtcactctgttcccaccctcctcgacacgcgagctgagcgggctggcaaggcgcatagn

SEQ ID NO: 51560 - DNA, 171 bp, Homo sapiens
  misc_feature: GYAE6OF02IX5U8.8.45.E01.1.454.CMB.1.raw
  modified_base (171)..(171): a, c, t, g, unknown or other
  misc_feature (171)..(171): n is a, c, g, or t
tcagctcgcgtgtccacgaccggtgctcgatttagtgagtcagtaagggaaagggatgagaacctatgaacattctgtaggggccactgtcttctccaaggctgcccccacggtcactctgttcccgccctcctcgacacgcgagctgagcgggctggcaaggcgcatagn

SEQ ID NO: 51561 - DNA, 169 bp, Homo sapiens
  misc_feature: GYAE6OF02IFHEA.8.45.E01.1.454.CMB.1.raw
  modified_base (168)..(169): a, c, t, g, unknown or other
  misc_feature (168)..(169): n is a, c, g, or t
tcagctcgcgtgtccacgaccggtgctcgatttagtgagtcagtaagggaaagggatgagaacctatgaacattctgtagggccactgtcttctccaaggctgccccaggtcactctgttcccaccctcctcgacacgcgagctgagcgggctggcaaggcgcatagnn

SEQ ID NO: 51562 - DNA, 175 bp, Homo sapiens
  misc_feature: GYAE6OF02H66V8.8.45.E01.1.454.CMB.1.raw
  modified_base (169)..(175): a, c, t, g, unknown or other
  misc_feature (169)..(175): n is a, c, g, or t
tcagctcgcgtgtccacgaccggtgctcgatttagtgagtcagtaagggaaagggatgagaacctatgaacattctgtagggcactgtcttctccaaggctgcccccacggtcactctgttcccgccctcctcgacacgcgagctgagcgggctggcaaggcgcatagnnnnnnn

SEQ ID NO: 51563 - DNA, 172 bp, Homo sapiens; identical to SEQ ID NO: 51552
  misc_feature: GYAE6OF02FL398.8.45.E01.1.454.CMB.1.raw
  modified_base (171)..(172): a, c, t, g, unknown or other
  misc_feature (171)..(172): n is a, c, g, or t

SEQ ID NO: 51564 - DNA, 500 bp, Homo sapiens
  misc_feature: GYAE6OF01D2JOL.41.9.A09.1.454.CMB.1.raw
tcagtctatactatcacgaccggtgctcgatttagcgagacgcgcaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttggcagcagcgtagcctggttccagcagaaacctggccaggctcccaggctcctcatctatggtgcatccaccagggccactggtatcccagccaggttcagtggcagtgggtctgggacagagttcactctcacatcagcagcctgcagtctgaagtattttgctagtttatactgtcagcagtataatgactggcctccttcggccaagggacacgactggagtaattaaacgaacttggtggctaggccactactctgtcttcattcccg

SEQ ID NO: 51565 - DNA, 580 bp, Homo sapiens
  misc_feature: GYAE6OF02I9UU3.41.9.A09.1.454.CMB.1.raw
  modified_base (194)..(194): a, c, t, g, unknown or other
  misc_feature (194)..(194): n is a, c, g, or t
  modified_base (296)..(296): a, c, t, g, unknown or other
  misc_feature (296)..(296): n is a, c, g, or t
tcagtctatactatcacgaccggtgctcgatttagcgagacgcgcagggggagagctgctcagttaggacccagagggaaccatggaaaccccagcgcagcttctcttcctcctgctactctggctcccagataccaccggagaaattgtgttgacgcagtctccaggcaccctgtcttgtctccaggggaaanagccaccctctcctgcagggccagtcagagtgttggcagcagcgtagcctggtccagcaagaaacctggccaggcctccgaggcctcctcactctagtggtncatccaccgaggccagtggtactcccgagcctaggttcaggtcggctaggtgggtctggggacagtacgttcacgttcaccaccatcgagtcacggccctgctagtctaggtaagttactttgacttaagtttacttacgtagtacagtactaagtataatcgtacgtcggtaccctccgttacggaccgtaaagggccaacgtgtaggacttaacgttaaaccgagttcggtcggactacggaacctacggtacttccgttcgtacctttacgtacttacccg

SEQ ID NO: 51566 - DNA, 694 bp, Homo sapiens
  misc_feature: GYAE6OF02GZ6IG.41.9.A09.1.454.CMB.1.raw
  modified_base (339)..(339): a, c, t, g, unknown or other
  misc_feature (339)..(339): n is a, c, g, or t
  modified_base (393)..(393): a, c, t, g, unknown or other
  misc_feature (393)..(393): n is a, c, g, or t
  modified_base (434)..(434): a, c, t, g, unknown or other
  misc_feature (434)..(434): n is a, c, g, or t
tcagtctatactatcacgaccggtgctcgatttagcgagacgcgcaggggagagctgctcagttaggacccagagggaaccatggaaaccccagcgcagcttctcttcctcctgctactctggctcccagataccaccggagaaattgtgttgacgcagtctccaggcaccctgtctttgtctccgaaggggaaagagcccaccctctcctgccgagggccagtcagagtgttgacaccaccaccagtcttctagcctggtaccagcagaagcctggccaggcctccaggcctccacatactacggatgacatccagcaagccgctggcactcccgaanactacgggttacaggtggacgtaggtcgggtcgtagggacagtacgttcacctntcgagacatcgagtcggatggacgcgtaggaggtattccgnggtactagttttaaacttacgtacgtacgtacggtacgtagtttaagtttacggggtttacgttaccgttaacccgttacgttaccgggttaaccgggtttacccgggtaacccggtaaaaccgggggttaaaccggtaaacggggttaaacggggttaaaaaccgttaacccggtaaaaaaccggttaaccggtttaaaccggttaacgggtaaccgtttaacgggaacccgttaaacccggttacggtttaaccccgg

SEQ ID NO: 51567 - DNA, 505 bp, Homo sapiens
  misc_feature: GYAE6OF01BKWBV.16.78.H01.1.454.CMB.1.raw
  modified_base (495)..(505): a, c, t, g, unknown or other
  misc_feature (495)..(505): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccagggaagggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcgggggactacctcgacccctggggccagggaatactggtcaccgtctcctcagcctccaccaagggcccatcggtcttccccctggcaccctcctccaagagcacctctgggggcacagcggccctgggctgcctggtcaaggctacttccgagtagtacactgagcgggctggcaaggcgcatagnnnnnnnnnnn

SEQ ID NO: 51568 - DNA, 535 bp, Homo sapiens
  misc_feature: GYAE6OF01EC4NQ.16.78.H01.1.454.CMB.1.raw
  modified_base (524)..(525): a, c, t, g, unknown or other
  misc_feature (524)..(525): n is a, c, g, or t
  modified_base (527)..(527): a, c, t, g, unknown or other
  misc_feature (527)..(527): n is a, c, g, or t
  modified_base (529)..(532): a, c, t, g, unknown or other
  misc_feature (529)..(532): n is a, c, g, or t
  modified_base (534)..(535): a, c, t, g, unknown or other
  misc_feature (534)..(535): n is a, c, g, or t
tcagtgtactactccacgaccggtgctcgatttagtgtgagtagtttgggtttgggctcggaactctcctgtgcagcctctgggattcaccttgagaacttatagcatgaactgggtccgccaggctccagggaagggctggagtgggtctcgatccgattagtagtagtacgtagttacatatattacgcagactcagtgaaggccgattcaccatctccagagacaacgcccaggaacctcaactatattctagtcaaaatgaacagcctgagagccgacgacaccggctagtgtatttactgtgcgggagccgtaacgttcgggggactaccgtcgtacccctgggccagggaatactggtcaccgtctacctcagcctccgaccaacgggcccatacggtcttcccccctggccaccctcctccaagagcacctctggggcacagcggccctgggctgcctggtcaaggactacgtccgagtagtacacgtgagcgggactggcaacggcgcagtagagnncntnnnncnn

SEQ ID NO: 51569 - DNA, 130 bp, Homo sapiens
  misc_feature: GYAE6OF01EFP40.16.78.H01.1.454.CMB.1.raw
  modified_base (130)..(130): a, c, t, g, unknown or other
  misc_feature (130)..(130): n is a, c, g, or t
tcagtgtactactccacgaccggtgctcgatttagtgtgagtagtttgggtttgggcacagcggccctgggctgcctggtcaaggactacttccgagtagtacactgagcgggctggcaaggcgcatagn

SEQ ID NO: 51570 - DNA, 552 bp, Homo sapiens
  misc_feature: GYAE6OF01BIV49.16.78.H01.1.454.CMB.1.raw
  modified_base (541)..(552): a, c, t, g, unknown or other
  misc_feature (541)..(552): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacgtcggggactacctcgacccctggggccagggaactactggtcaccgtctcctcacgcctcccaccaacggcccatccggtccttccccctcggccaccctccctcccaacgacgccaccctcgtcgggggccaccgaggcccggcccgtcggggcctcggccctgggtccaaacgggtcctaccgttccgagtacgtaccacgtgacggcgggcctgggcaagggcgacgatgnnnnnnnnnnnn

SEQ ID NO: 51571 - DNA, 505 bp, Homo sapiens
  misc_feature: GYAE6OF01C7JKL.16.78.H01.1.454.CMB.1.raw
  modified_base (497)..(505): a, c, t, g, unknown or other
  misc_feature (497)..(505): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccaggggaaggggctggagtgggtctcatccatttagtagtagtagtagttacatatattacgcagactcagtgaagggccattcaccatctccagagacaacgcccagaactcactatatctgcaaatgaacagcctgagagccgacgacacggctgtgtattactgtgcgggagccgtaacttcgggggactacctcgacccctggggccagggaatactggtcaccgtctcctcagcctccaccaagggcccatcggtcttccccctggccaccctcctccaagagcacctctggggcacagcggccctggctgcctggtcaaggactacttccgagtagtacactgagcgggctggcaaggcgcatagnnnnnnnnn

SEQ ID NO: 51572 - DNA, 510 bp, Homo sapiens
  misc_feature: GYAE6OF01DVKR2.16.78.H01.1.454.CMB.1.raw
  modified_base (392)..(392): a, c, t, g, unknown or other
  misc_feature (392)..(392): n is a, c, g, or t
  modified_base (503)..(510): a, c, t, g, unknown or other
  misc_feature (503)..(510): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcgggggactacctcgacccctggggcccagggaatactggtcaccgtctcctcagcctcaccaaggcccatcggtcttcccccnggcaccctcctccaagacgcaccctctgggggcacgacgcgggccctgggcctgcctggtcaagggctaacttccgagtagtacactgagcgggctggcaaggcgcatagnnnnnnnn

SEQ ID NO: 51573 - DNA, 523 bp, Homo sapiens
  misc_feature: GYAE6OF01BVZ6D.16.78.H01.1.454.CMB.1.raw
  modified_base (511)..(523): a, c, t, g, unknown or other
  misc_feature (511)..(523): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccagggaagggctggagtgggtctcatccattagtagtagtagtagttacatatattacgcagactcagtgaagggccgattcaccatctccagagacaacgcccagaactcactatatctgcaaaatgaacagcctgagagccgacgacacggctgtgtattactgtgcgggagccgtaacgttcgggggactacctcgacccctggggccagggaatactggtcaccgtctcctcacgcctccaccaagggcccagtcggtcttccccctggccacccctcctccaagacgccacctcgtggggcacgacgccggccctgggctcgcctggcaaggactacttccggtagtacacgtgacgcgggctcggcaaggcgcgatacgnnnnnnnnnnnnn

SEQ ID NO: 51574 - DNA, 503 bp, Homo sapiens
  misc_feature: GYAE6OF01EDNBW.16.78.H01.1.454.CMB.1.raw
  modified_base (496)..(503): a, c, t, g, unknown or other
  misc_feature (496)..(503): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccagggaaggggctggagtgggtctcatccattagtagtagtagtagttacatatattacgcagactcagtgaagggccgattcatcatctccagagacaacgcccagaactcactatatctgcaaatgaacagcctgagagccgacgacacggctgtgtattactgtgcgggagccgtaactcgggggactacctcgacccctggggccagggaatactggtcaccgtctcctcagcctccaccaagggcccatcggtcttccccctggccaccctcctccaagagccacctctggggcacagcggcctgggctgcctggtcaaggactactcccgagtagtacactgagtcggctggcaaggcgcatagnnnnnnnn

SEQ ID NO: 51575 - DNA, 520 bp, Homo sapiens
  misc_feature: GYAE6OF01EN9D8.16.78.H01.1.454.CMB.1.raw
  modified_base (509)..(520): a, c, t, g, unknown or other
  misc_feature (509)..(520): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcgggggactacctcgacccctggggccagggaatactggtcaccgtctcctcacgcctccaccaacgggcccactccgggtcttccccctgggccacccctcctccaacgacgcaccctcgtcggggcacagccggccctgggctgcctggtcggactacttccgagtacgtacactgagcgggctggcaaggcgcagtgnnnnnnnnnnnn

SEQ ID NO: 51576 - DNA, 576 bp, Homo sapiens
  misc_feature: GYAE6OF01BQMGX.16.78.H01.1.454.CMB.1.raw
  modified_base (561)..(561): a, c, t, g, unknown or other
  misc_feature (561)..(561): n is a, c, g, or t
  modified_base (566)..(566): a, c, t, g, unknown or other
  misc_feature (566)..(566): n is a, c, g, or t
  modified_base (570)..(574): a, c, t, g, unknown or other
  misc_feature (570)..(574): n is a, c, g, or t
  modified_base (576)..(576): a, c, t, g, unknown or other
  misc_feature (576)..(576): n is a, c, g, or t
tcagtgtactactccacgaccggtgctcgatttagtgtgagtagtttgggtttgggctcaactctcctgtgcagcctctggattcaccttgagaacttatagcatgaactgggtcccgccaggctccaggggaaggggctggagtgggtctcatccattagtagtagtagtagttacatatattacgcagactcagtgaagggccattcaccatctccagagacaacgcccagaactcactatatctgacaaatgaacagcctgagagccgacgacacggctgtgtattactgtggcgggagccgtaacgttcggggactaccgtccgaccccgtggggccagggaatacgtggtccacgtcctcctcacgccctccaccgaacggcccatccggtccttcccccgtggcccaccctccctaccaagacgccaccgtcgtcggggccacgacggccggcccgtgggcctcgccgtggtaccgaacggtacctaccgttccggagttacgtaaccacgtggacggcgggtcgtcgggacgaacgggccgacgtacgtaggcngcgcngacnnnnngn

SEQ ID NO: 51577 - DNA, 575 bp, Homo sapiens
  misc_feature: GYAE6OF01DGMJ4.16.78.H01.1.454.CMB.1.raw
  modified_base (564)..(575): a, c, t, g, unknown or other
  misc_feature (564)..(575): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccaggggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacgtcggggactccgtcgaccccgtggggccaggaatacgtggtcaccgtctcctcacgcctccaccgaacgggcccagtccggtccttcccccgtcggccacccctccctacccaagacgccacccgtcgtcgggggccaccgacggcccgggcccgtcgggccgtcggcccgttcgggtacaacgggtaccgtaccttaccggacgttacgtaccacgtggacggcgggcgtcgggaccgacggccgacgaagtagnnnnnnnnnnnn

SEQ ID NO: 51578 - DNA, 514 bp, Homo sapiens
  misc_feature: GYAE6OF01BUL7A.16.78.H01.1.454.CMB.1.raw
  modified_base (504)..(514): a, c, t, g, unknown or other
  misc_feature (504)..(514): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcgggggactacctcgacccctggggccagggaatactggtcaccgtctcctcagcctccaccaagggcccatcggtcttccccctggcacccctcctccaagcgccacctctgggggccacgacgcggccctgggcctgcctggtcaaggctacttccgagtacgtacactgagcgggctggcaaggcgcgatagnnnnnnnnnnn

SEQ ID NO: 51579 - DNA, 556 bp, Homo sapiens
  misc_feature: GYAE6OF01CLR7I.16.78.H01.1.454.CMB.1.raw
  modified_base (425)..(425): a, c, t, g, unknown or other
  misc_feature (425)..(425): n is a, c, g, or t
  modified_base (553)..(554): a, c, t, g, unknown or other
  misc_feature (553)..(554): n is a, c, g, or t
  modified_base (556)..(556): a, c, t, g, unknown or other
  misc_feature (556)..(556): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccagggaaggggctggagtgggtctcatccattagtagtagtagtagttacatatattacgcagactcagtgaagggccattcaccatctccagagacaacgcccagaactcactatatctgcaaaatgaacagcctgagagccgacgacacggctgtgtattactgtgcccgagggtaggttttactatgatattactggttaacaaaaaggtactacttgactacgtgggcacgggaaccctggtcaccgtctcctcacgcctccaccgacgggcccatccggtccttccccctggccncccctgcctcccgaggacgccacctccgacgaaccacagccggccgtcgggcctcggcctggacaaggacctacttccgaagtacgtacacgtgacggcgggactcgggacaagggccgacagtagcnngn

SEQ ID NO: 51580 - DNA, 527 bp, Homo sapiens
  misc_feature: GYAE6OF01CHETG.16.78.H01.1.454.CMB.1.raw
  modified_base (518)..(527): a, c, t, g, unknown or other
  misc_feature (518)..(527): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccagggaaggggctggagtgggtctcatccattagtagtagtagtagttacatatattacgcagactcagtgaagggccgattcaccatctccagagacaacgcccagaactcactatatctgcaaaatgaacagcctgagagccgacgacacggctgtgtattacgtgtgcgggagccgtaacgttcgggggactacctcgacccctggggccagggaatacgtggtcaccgtctcctcacgcctccaccaacggcccatccggtcttccccctggccaccctcctccaagacgccacctcgtcggggcacgacgccgccctgggctgcctggtcaaggtctacgttcccgaagtacggttacacgtgacgcgggctggcaaggcgcagtagnnnnnnnnnn

SEQ ID NO: 51581 - DNA, 606 bp, Homo sapiens
  misc_feature: GYAE6OF01CMEGP.16.78.H01.1.454.CMB.1.raw
  modified_base (595)..(598): a, c, t, g, unknown or other
  misc_feature (595)..(598): n is a, c, g, or t
  modified_base (600)..(606): a, c, t, g, unknown or other
  misc_feature (600)..(606): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccaggggaaggggctggagtgggtctcatccattagtagtagtagtagttacatatattacgcagactcagtgaagggccattcacatctcagagacaacgcccagaactcactatatctgcaaaatgaacagcctgagagccgacgacacggctgtgtattactgtgcggagccgtaacgtcggggactcctcgaccccgtgggccagggatacgtggtccaccgtctctcacgccctaccaccgaagggcccctaacgtccgggttcccttccccccgtggccctacccctcccgtacccaagaccgccaacccgtccggtcgggggccaaccggacggcccgggcccgtggggccgtcggcccgtgggtaccgaaacggtaccgttaaccgttacccggaggttaaccgtaccgaccgttcggaacggccggggtcgtacgggaccgaaagggccgacgaagtagcgnnnngnnnnnnn

SEQ ID NO: 51582 - DNA, 543 bp, Homo sapiens
  misc_feature: GYAE6OF01CQ8D4.16.78.H01.1.454.CMB.1.raw
  modified_base (533)..(543): a, c, t, g, unknown or other
  misc_feature (533)..(543): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccagggaagggctggagtgggtctcatccattagtagtagtagtagttacatatattacgcagactcagtgaagggccgattcaccatctccagagacaacgcccagaactcactatatctgcaaaatgaacagcctgagagccgacgacacggctgtgtattactgtgcgggagccgtaacgttcgggggactacctcgacccctgggccaggaatactggtcaccgtctcctcacgcctccaccaacgggccccatccggtcccttccccgtcggccctaccctccctaccaacgacgccacctcgtcgggggcacgacgccggcccgtgggcctcgcctggtcaacgggaccttacgttccgagtacgtaccacgtcgagcgggcgtggacgaacggcgcagtagnnnnnnnnnnn

SEQ ID NO: 51583 - DNA, 523 bp, Homo sapiens
  misc_feature: GYAE6OF01CJD6M.16.78.H01.1.454.CMB.1.raw
  modified_base (511)..(512): a, c, t, g, unknown or other
  misc_feature (511)..(512): n is a, c, g, or t
  modified_base (514)..(523): a, c, t, g, unknown or other
  misc_feature (514)..(523): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcggggactacctcgacccctgggccagggatactggtcaccgtctcctcagcctccaccaagggcccatccggtcttccccctggccaccctcctccaagacgccaccctcgtggggcacgagccggccctgggcctgcctggtcaacgggactaccgttccgagtacgtacacgtgacgcgggctgggcaaggcgcagtagnngnnnnnnnnnn

SEQ ID NO: 51584 - DNA, 545 bp, Homo sapiens
  misc_feature: GYAE6OF01DWYS0.16.78.H01.1.454.CMB.1.raw
  modified_base (423)..(423): a, c, t, g, unknown or other
  misc_feature (423)..(423): n is a, c, g, or t
  modified_base (533)..(545): a, c, t, g, unknown or other
  misc_feature (533)..(545): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacgttcggggactacctcgcccctggggccagggaatactggtccaccgtctcctcacgcctccaccaacgggcccagtccggtccttcccccgtcggcctaccctccctcccaagacnccacctcgtcggggccacgacggccggcccgtcgggctgtcccgtcggtcggacttaccgttccggacgttagtacctacgtgcggcgggctggcgaaggcgcgagtagnnnnnnnnnnnnn

SEQ ID NO: 51585 - DNA, 503 bp, Homo sapiens
  misc_feature: GYAE6OF01BVRGM.16.78.H01.1.454.CMB.1.raw
  modified_base (495)..(503): a, c, t, g, unknown or other
  misc_feature (495)..(503): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcgggggactacctcgacccctggggccagggaatactggtcacgtctcctcagcctccaccaaggcccatcggtcttccccctggcaccctcctccaagacgcacctctggggcacagcggccctgggctgcctggtcaaggactacttccgagtagtacactgagcgggctggcaggcgcgatagnnnnnnnnn

SEQ ID NO: 51586 - DNA, 600 bp, Homo sapiens
  misc_feature: GYAE6OF01DBCUX.16.78.H01.1.454.CMB.1.raw
  modified_base (242)..(242): a, c, t, g, unknown or other
  misc_feature (242)..(242): n is a, c, g, or t
  modified_base (589)..(589): a, c, t, g, unknown or other
  misc_feature (589)..(589): n is a, c, g, or t
  modified_base (592)..(600): a, c, t, g, unknown or other
  misc_feature (592)..(600): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccaggggaagggctggagtgggtctcatccattagtagtagtagtagttacatatattacgcagactcagtgaagggccattcaccatctcagagacacgccaagactcactatatcngacaaatgaacagcctgagacgaccgacgacgacggctgtgtattactgtggcgggacgtaccgtaacgtcggggacctaccgtccggaccccgtggggaccagggaatacgtggtcaccgtctcctcgacgccctaccaaccgaacgggccctacgtccggttcccttcccccgtggccctacccctcctacccaacgacgccgtaccgtcggtcgggggaccacgtacggccggcccgtcgggcctcggtccgtcggtacgaacggtaccttaaccgttaccggagttacgtaccgacgtggtacgggcgggcgtcgggaccgaacgggtcgacgtaagtagcgncgnnnnnnnnn

SEQ ID NO: 51587 - DNA, 572 bp, Homo sapiens
  misc_feature: GYAE6OF01E0HL4.16.78.H01.1.454.CMB.1.raw
  modified_base (556)..(556): a, c, t, g, unknown or other
  misc_feature (556)..(556): n is a, c, g, or t
  modified_base (559)..(560): a, c, t, g, unknown or other
  misc_feature (559)..(560): n is a, c, g, or t
  modified_base (562)..(562): a, c, t, g, unknown or other
  misc_feature (562)..(562): n is a, c, g, or t
  modified_base (569)..(569): a, c, t, g, unknown or other
  misc_feature (569)..(569): n is a, c, g, or t
  modified_base (571)..(572): a, c, t, g, unknown or other
  misc_feature (571)..(572): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcgggggactacctcgacccctggggccagggaatacgtggtcaccgtctcctcacgcctccaccgaacggcccacgtccggtccttcccccgtggccacccctcctccaacgacgcaccctcgtcgggggcacgacgccggcccgtcgggctcggcccgtgggtaccgaacgggtactaccgttaccggacgtacgtaaccacgtggacggccggggcgtcgggaccgaagggccgacgtacgtaggntgnngntgcagcngnn

SEQ ID NO: 51588 - DNA, 600 bp, Homo sapiens
  misc_feature: GYAE6OF01EUH4B.16.78.H01.1.454.CMB.1.raw
  modified_base (258)..(258): a, c, t, g, unknown or other
  misc_feature (258)..(258): n is a, c, g, or t
  modified_base (594)..(595): a, c, t, g, unknown or other
  misc_feature (594)..(595): n is a, c, g, or t
  modified_base (597)..(600): a, c, t, g, unknown or other
  misc_feature (597)..(600): n is a, c, g, or t
tcagtgtactactccacgaccggtgctcgatttagtgtgagtagtttgggtttgggctcaactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaaacngcctgagagtcggaggacacggccatatattactgtgcgaaagatcctgacggcctactaccacctcagtcagctggttccgaccccgtggggccagggaaccctggtccaccgtcctcctcacgccctaccgaaccgaacgggccctacgtccggttcccttcccccgtcggccctacccctccctcccaacgacgaccacccgtcggtcgggggccacgacggccggcccgtcgggcctcgcccgtcggtaccgaacggtaccttaccgttaccgaggtacgtaccgacgtacggacggccgggtcgtcgggaccgaagggccgacgagtacgnncnnnn

SEQ ID NO: 51589 - DNA, 530 bp, Homo sapiens
  misc_feature: GYAE6OF01B47X5.16.78.H01.1.454.CMB.1.raw
  modified_base (117)..(117): a, c, t, g, unknown or other
  misc_feature (117)..(117): n is a, c, g, or t
  modified_base (365)..(365): a, c, t, g, unknown or other
  misc_feature (365)..(365): n is a, c, g, or t
  modified_base (367)..(367): a, c, t, g, unknown or other
  misc_feature (367)..(367): n is a, c, g, or t
  modified_base (397)..(397): a, c, t, g, unknown or other
  misc_feature (397)..(397): n is a, c, g, or t
  modified_base (401)..(401): a, c, t, g, unknown or other
  misc_feature (401)..(401): n is a, c, g, or t
  modified_base (407)..(407): a, c, t, g, unknown or other
  misc_feature (407)..(407): n is a, c, g, or t
  modified_base (416)..(416): a, c, t, g, unknown or other
  misc_feature (416)..(416): n is a, c, g, or t
  modified_base (428)..(428): a, c, t, g, unknown or other
  misc_feature (428)..(428): n is a, c, g, or t
  modified_base (499)..(499): a, c, t, g, unknown or other
  misc_feature (499)..(499): n is a, c, g, or t
  modified_base (510)..(511): a, c, t, g, unknown or other
  misc_feature (510)..(511): n is a, c, g, or t
  modified_base (514)..(514): a, c, t, g, unknown or other
  misc_feature (514)..(514): n is a, c, g, or t
  modified_base (521)..(521): a, c, t, g, unknown or other
  misc_feature (521)..(521): n is a, c, g, or t
  modified_base (523)..(524): a, c, t, g, unknown or other
  misc_feature (523)..(524): n is a, c, g, or t
  modified_base (528)..(528): a, c, t, g, unknown or other
  misc_feature (528)..(528): n is a, c, g, or t
  modified_base (530)..(530): a, c, t, g, unknown or other
  misc_feature (530)..(530): n is a, c, g, or t
tcagtgtactactccacgaccggtgctcgatttagtgtgagtagtttgggtttgggctcaactctcctgtgcagcctctggattcaccttgagaacttatagcatgaactgggtccnccaggctccagggaagggctggagtgggtctcatccattagtagtagtagtagttacatatattacgcagactcagtgaagggccgattcaccatctccagagacaacgccagactcactatatctgcaaatgaacagcctagagagccgacgacacggctgtgtattactgtggcgggacgccggtaacgttcggggacctaccgtccgaccccgtggggccagggaatacgtggtccacgtctccncncgcctccaccgaggcccatccgtcctcccngccncctccncacgcgacncctcgcgggacncgacgcggccgtggctcgctggacaacgactcgtacgtagtacgtacacgtgacggcggtctggacacggngacgtagtagnngtnacgtgancnngtcngn

SEQ ID NO: 51590 - DNA, 624 bp, Homo sapiens
  misc_feature: GYAE6OF01DK0AD.16.78.H01.1.454.CMB.1.raw
  modified_base (610)..(610): a, c, t, g, unknown or other
  misc_feature (610)..(610): n is a, c, g, or t
  modified_base (614)..(615): a, c, t, g, unknown or other
  misc_feature (614)..(615): n is a, c, g, or t
  modified_base (617)..(618): a, c, t, g, unknown or other
  misc_feature (617)..(618): n is a, c, g, or t
  modified_base (620)..(624): a, c, t, g, unknown or other
  misc_feature (620)..(624): n is a, c, g, or t
tcagtgtactactccacgaccggtgctcgatttagtgtgagtagtttgggtttgggctcaactctcctgtgcagcctctggattcaccttgagaacttatagcatgaactgggtcccgccaggctccaggggaaggggctgggagtgggtctcatccattagtagtagtagtagttacatatattacgcagactcagtgaagggccattcacatctccagacgacaaccgcccaagacctcactatatctgacaaatgaacagcctgagacgccgacgacgacggctgtgtattacgtggtcggcggggacgtacccggttaacggttccgggggtacctacccgtcccgtaccccggtacgggggccaagggtaactaccgtggtcctaccgttcctccgtcgacgcccgtacccgaaccgacgggccctacgttcccggtcccttcccccgtcggccctacccctcctacccgaagccgtcctaccggtcggcggggccacgacggccggtccgtcgggtcctcggccgtcggtacgaacgtactaccgttacggacgtacgtactacggtcgacgggcgggcgtcggacgaccggcgacgtagtagnagcnncnngnnnnn

SEQ ID NO: 51591 - DNA, 588 bp, Homo sapiens
  misc_feature: GYAE6OF01DADQM.16.78.H01.1.454.CMB.1.raw
  modified_base (572)..(572): a, c, t, g, unknown or other
  misc_feature (572)..(572): n is a, c, g, or t
  modified_base (583)..(588): a, c, t, g, unknown or other
  misc_feature (583)..(588): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccaggggaaggggctggagtgggtctcatccattagtagtagtagtagttacatatattacgcagactcagtgaagggccgattcaccatctccagagacaacgcccagaactcactatatctgcaaatgaaacagcctgagagccgacgacacggctgtgtattactgtgcgggagccgtaacgttcggggactacctcggacccctggggccagggaatacgtggtcaccgtctcctcacgcctccaccaagggccccagtccggtccttccccccgtggccacccctcctcccaagacgcaccctcgtcgggggccacgaggcccggcccgtgggcctcgccctcgggtaccaaacgggtaccttaaccgtttcccgacggttacgtaccgaacgtggacggtccggggcgttacgggaccgaaagggccgacgaacgttaggcncacgcagacgnnnnnn

SEQ ID NO: 51592 - DNA, 821 bp, Homo sapiens
  misc_feature: GYAE6OF01ACY1P.16.78.H01.1.454.CMB.1.raw
tcagtgtactactccacgaccggtgctcgatttagtgtgagtagtttgggtttggctcaactctcctgtgcagcctctggattcaccttgagaacttatagcatgaactgggtccgccaggctccagggaagggctggagtggtctcatccattagtagtagtagtagttacatatattacgcagactcagtgaggccattcacatctcagagacaacgccagaactcactatactctgacaaatcgaacagctagagacgccgacgacgacggtctcgtgtacttacgtgtcggcggtacgtccgtaacggttcggggaccttacccgtccggtaccccgtggggtacccgtaacggggtaacttaccggtcggttacccgtacccgtttccgtacccgtcgaccggtccctacccgtaacccgaacgggtccctaacggttccggttaccccgtttcccccgtgggtacccctaccccgttcccgtacccgtaaacggtaccgtaccgtaacccggttcccggtaacgggggtaccctaacggtaaccgggtccccggttacccgggttccggggtacccgttaccgggtaccccggtttccgggttaaccgtaaaccgggttaaccccgtttaacccggtttaaccccgggtaacgggttttaaacccggtaacccggttaacccgtttacggggtaacccgggtacccggggtacccgttaccgggtaaccgggtaaaccgggtccgtaaccgtaacggttacggtaccgtcggtacgtaccgtacggtccgtagttaccaggtccgtaacggtcgg

SEQ ID NO: 51593 - DNA, 555 bp, Homo sapiens
  misc_feature: GYAE6OF01B6YIN.16.78.H01.1.454.CMB.1.raw
  modified_base (229)..(229): a, c, t, g, unknown or other
  misc_feature (229)..(229): n is a, c, g, or t
  modified_base (319)..(319): a, c, t, g, unknown or other
  misc_feature (319)..(319): n is a, c, g, or t
  modified_base (429)..(429): a, c, t, g, unknown or other
  misc_feature (429)..(429): n is a, c, g, or t
  modified_base (508)..(508): a, c, t, g, unknown or other
  misc_feature (508)..(508): n is a, c, g, or t
  modified_base (524)..(524): a, c, t, g, unknown or other
  misc_feature (524)..(524): n is a, c, g, or t
  modified_base (544)..(555): a, c, t, g, unknown or other
  misc_feature (544)..(555): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccagggaagggctggagtgggtctcatccattagtagtagtagtagttacatatattacgcagactcagtgaaggccattcacatctccagagacaacgcccaanaactcactatatctgacaaaatgaacacgcctagagacgccgacgacgacggctgtgtattactgtgcggagccgtacgtcgggactccncgacccgtgggccaggaatacgtggtccaccgtctcctcacgccctaccaccgaacggcccacgtcccgtccttcccccgtggccctaccctccctaccaagaccgtccncccttcggacggggaccacgacggcccgtcccgtgggcctcgtccgtcggtacgacgtacttccgtccgagtacgtacncgtagacggcgggtcncgggacacggcgacagtagnnnnnnnnnnnn

SEQ ID NO: 51594 - DNA, 777 bp, Homo sapiens
  misc_feature: GYAE6OF01EMZ9R.16.78.H01.1.454.CMB.1.raw
  modified_base (191)..(191): a, c, t, g, unknown or other
  misc_feature (191)..(191): n is a, c, g, or t
  modified_base (197)..(197): a, c, t, g, unknown or other
  misc_feature (197)..(197): n is a, c, g, or t
  modified_base (760)..(760): a, c, t, g, unknown or other
  misc_feature (760)..(760): n is a, c, g, or t
  modified_base (767)..(767): a, c, t, g, unknown or other
  misc_feature (767)..(767): n is a, c, g, or t
  modified_base (769)..(772): a, c, t, g, unknown or other
  misc_feature (769)..(772): n is a, c, g, or t
  modified_base (774)..(774): a, c, t, g, unknown or other
  misc_feature (774)..(774): n is a, c, g, or t
  modified_base (776)..(777): a, c, t, g, unknown or other
  misc_feature (776)..(777): n is a, c, g, or t
tcagtgtactactccacgaccggtgctcgatttagtgtgagtagtttgggtttgggctcaactctcctgtgcagcctctggattcaccttgagaacttatagcatgaacgtgggtcccgccaggcctccgaggggaagggctggaggtgggtctcatccattagtagtagtagtagttacatatattacgnagactnagtgaagggccattccaccatcctccgagacaaccaaccgcccaagaacctcaactatagtctagaacctaaaagtcgaaacacgtaccgtaggaacggacggacccggaaccggaaccgacggtcgttggttacgttaacgtttacgtggtcggggtacggggaaccggtacccgggttaacggggttccgggggtaacccttacccggtaccccggtaccccgggtagggaccgtaacgggtaactaccgttcgggtacctacccgtctaccgtcaccgtccctacccgaccgaacggccctacgtccccggttccctccccggtcgacccctacccctacccgtacccgtaaccgaccgtcccgtaacccggttcgggtaccgggggacctaaccggacccgggtcccggtcccggtaccgggtcccgtccggtcccggttacggtaccggtaaccgttaccgttaacccgttaccggtaacggttaaccgtaccgtaacgttacgggaccgggttaccgggtcggtaccggacgggaacggaccggtactaccggtagngacgcgngnnnncngnn

SEQ ID NO: 51595 - DNA, 690 bp, Homo sapiens
  misc_feature: GYAE6OF01CT1TF.16.78.H01.1.454.CMB.1.raw
  modified_base (198)..(198): a, c, t, g, unknown or other
  misc_feature (198)..(198): n is a, c, g, or t
  modified_base (677)..(677): a, c, t, g, unknown or other
  misc_feature (677)..(677): n is a, c, g, or t
  modified_base (687)..(687): a, c, t, g, unknown or other
  misc_feature (687)..(687): n is a, c, g, or t
tcagtgtactactccacgaccggtgctcgatttagtgtgagtagtttgggtttgggctcaactctcctgtgcagcctctggattcaccttgagaactttatagcatgaactggggtccgccaggctccgaggggaaggggctgggaggtgggtctcatccattagtagtagtagtagttacatatattacgcagactnaggtgaagggccattcaccatctccagacgacaacgccctaagaactcactatatcgtagacaaaatgaaacagcctagaacgaactggaacgacgacggtctattaattacttacgtggtacggacgggaagggcggggggtccggtagggactccgtcccgtacccggacggggccaagtcggacccgtccgggtcggggaccgaaggggtaccttcccgtcggtcctaacccgttctccctacgaccgcccgtaccaacgaaccgggccctagtcccggttaccccttccccggtacggcccgtacccgtgtcccgtaccggacggacacccgtacccgtacggacgacgaccgaaccgtacgggccccgaccggtcggcccgttcggacccgtttaggaacctaacggtccttacgtaccggtaagtaccgacgtaccgtagacgggtccggtcggtacggacgaacggccgtanaacgtgagcngac

SEQ ID NO: 51596 - DNA, 832 bp, Homo sapiens
  misc_feature: GYAE6OF01BRFFM.16.78.H01.1.454.CMB.1.raw
  modified_base (288)..(288): a, c, t, g, unknown or other
  misc_feature (288)..(288): n is a, c, g, or t
  modified_base (817)..(817): a, c, t, g, unknown or other
  misc_feature (817)..(817): n is a, c, g, or t
  modified_base (819)..(821): a, c, t, g, unknown or other
  misc_feature (819)..(821): n is a, c, g, or t
  modified_base (825)..(827): a, c, t, g, unknown or other
  misc_feature (825)..(827): n is a, c, g, or t
  modified_base (829)..(830): a, c, t, g, unknown or other
  misc_feature (829)..(830): n is a, c, g, or t
  modified_base (832)..(832): a, c, t, g, unknown or other
  misc_feature (832)..(832): n is a, c, g, or t
tcagtgtactactccacgaccggtgctcgatttagtgtgagtagtttgggtttgggctcaactctcctgtgcagcctctggattcaccttgagaacttatagcatgaacgtgggtcccgccgaggctaccgaggggaagggctgggagtggtctcactcctattagtagtagtagttagttacatatattacgcagactcgagtggaacgggccgtattccaaccattcctccgaggaacgaaccaaccgcccaagaactcactatatcgtagacaaagtacgaaacncgtaccgtaggacgacgacccggaacgacgaccggtacgtggttacgttacgtttacggtggtacgggtcgggtaaccggtacccggttaaccggggttccggggaaccctttacccggtccccgggtaccccgggtacggggacccgtaaaggggttaaccgttaccggttccgggtacccgttacccgttccgtacccgtaccgacccgtacccctaccccggaaaacccggaaccggtcccctacccggtttccccgggtttacccccgtttaccccggcccggtaccccctacccccgttacccgtaacccgaacggtacccgcccggttaacccgttcgggggaccggggaccaaccggacccggccccggggttcccggtcggggtccgttcccggccgggttaaccgggtaacgaaccggtttaccgtaccccggtttaacgtaaccgggttaccgtaaccgtcggttacgggccgggacgggccggtaacgggaccggtaggacccggttagacgtacggncnnngcgnnngnngn

SEQ ID NO: 51597 - DNA, 620 bp, Homo sapiens
  misc_feature: GYAE6OF01B25HH.16.78.H01.1.454.CMB.1.raw
  modified_base (264)..(264): a, c, t, g, unknown or other
  misc_feature (264)..(264): n is a, c, g, or t
  modified_base (289)..(289): a, c, t, g, unknown or other
  misc_feature (289)..(289): n is a, c, g, or t
tcagtgtactactccacgaccggtgctcgatttagtgtgagtagtttgggtttgggggagagaggagccttagccctggattccaaggcctatccacttggtgatcagcactgagcaccgaggattcaccatggaactggggctccgctgggttttccttgttgcttattttagaaggtgtccagtgtgaggtgcagctggtggagtcgtgggggaggcctggtcaagccgtggggggtccctgagactctcctgtgcagcctntggattcaccttgagtaacttatancatagactcgggtccgcaggctccgagggaggggctgggagtgggtctcatctattagtagtagtagtagtacatatattacgcagctcagtgacgggcatcaccatctcagagaccaacgcccagacctacactatactctcgacaatagaacgtacgaccgttaggaacgacggacccgaaccgaccgtacggacgttggtagttacgttagtggtacgggtacgggacggtacccgggttaaccgggttcccgggggtaacccttaccccggtacccgggtaaccccggtcggggtacccggaagggtaaccgttacggttacccggg

SEQ ID NO: 51598 - DNA, 647 bp, Homo sapiens
  misc_feature: GYAE6OF01COD1Q.16.78.H01.1.454.CMB.1.raw
  modified_base (631)..(631): a, c, t, g, unknown or other
  misc_feature (631)..(631): n is a, c, g, or t
  modified_base (635)..(635): a, c, t, g, unknown or other
  misc_feature (635)..(635): n is a, c, g, or t
  modified_base (642)..(643): a, c, t, g, unknown or other
  misc_feature (642)..(643): n is a, c, g, or t
  modified_base (645)..(647): a, c, t, g, unknown or other
  misc_feature (645)..(647): n is a, c, g, or t
tcagtgtactactccacgaccggtgctcgatttagtgtgagtagtttgggtttgggcgtcaactctcctgtgcagcctctggattcaccttgagaacttatagcatgaactgggtccgccaggctccagggaagggctggagtgggtctcatccattagtagtagtagtagttacatatattacgcagactcagtgaaggccgattcaccatcctccagagacaacgcccagaactcactatatctgcaaatgaacacgccgtagagacgccgacgacacgctcgtgtatctagtggcggacgccgttaacggtccggggactaccgtccgacccgtcgggaccgaggaagtcgtacggtccgtaaccgttcctccgtcgacgtacccgtaccgaccgaaccgggcccctacggttcccggttccccgtttcccccggttacgcccgtaccccttacctacccgaacggtaccgacctacccggtacggttcgggggccaacggtaccggccggtccccggtgggcccgtcgtcccgtcgggtaactaccggtacgttaccgtacgtacgttacggtacacgttggaaccggcgggtaccgacggactaacgggcgtaacgtcgtagtacngacngtcgcgnncnnn

SEQ ID NO: 51599 - DNA, 810 bp, Homo sapiens
  misc_feature: GYAE6OF01CMCAA.16.78.H01.1.454.CMB.1.raw
  modified_base (314)..(314): a, c, t, g, unknown or other
  misc_feature (314)..(314): n is a, c, g, or t
  modified_base (337)..(337): a, c, t, g, unknown or other
  misc_feature (337)..(337): n is a, c, g, or t
tcagtgtactactccacgaccggtgctcgatttagtgtgagtagtttgggtttggggagagaggagccttagccctggattccaaggcctatccacttggtgatcagcactgagcaccgaggattcaccatggaacgtgggctccgtcttgggtttttccttgttgtcttattttagaaggtgtccagtgtgagtgcagtcgtggtggagtcggtggggagtccgtggtcaacggtccgttcgggggtccctgagtaccttcgtcctgtagccacgtcctgtggtacttcctaccgttagtaacgtaactttanagctagtacgtacgtcggtcccncgacggtctacggaaggggaggtcgtggaggtcggtctacgacttacgtaagttacggtaagttaacggtagtttaacgttacgaatttacgttaacgttaacgactaaaggtacccgtagtaaggttacggaaacgggtccctaactttccgaaccttactaccgtaccgtaagaaccgaaccgaaacccggaccccgtaaacgtaacccttaacctaacgttaacgtaacgttaccgttaacgtaactaaacgttaacgaacgtaacggtaccctaacggtaacggaccggtaaccggaaccgtaccggtaccggtacggttacggttaacggttcctttacggtacggtacgggtaccggggtaaccgttacccggggttaaacgggttccccgggggttaacctacccggttaccccgggtaccccgggttacgggaccggtaaacggttacgttaacccggtcccggg

SEQ ID NO: 51600 - DNA, 663 bp, Homo sapiens
  misc_feature: GYAE6OF01CV6RI.16.78.H01.1.454.CMB.1.raw
  modified_base (117)..(117): a, c, t, g, unknown or other
  misc_feature (117)..(117): n is a, c, g, or t
  modified_base (646)..(646): a, c, t, g, unknown or other
  misc_feature (646)..(646): n is a, c, g, or t
  modified_base (648)..(648): a, c, t, g, unknown or other
  misc_feature (648)..(648): n is a, c, g, or t
  modified_base (656)..(656): a, c, t, g, unknown or other
  misc_feature (656)..(656): n is a, c, g, or t
  modified_base (658)..(660): a, c, t, g, unknown or other
  misc_feature (658)..(660): n is a, c, g, or t
  modified_base (662)..(663): a, c, t, g, unknown or other
  misc_feature (662)..(663): n is a, c, g, or t
tcagtgtactactccacgaccggtgctcgatttagtgtgagtagtttgggtttgggctcaactctcctgtgcagcctctggattcaccttgagaacttatagcatgaactgggtccnccaggctccgagggaagggctggagtgggtctcatccattagtagtagtagtagttacatatattacgcagactcgagtggaacgggccagttccaccgatcctccagacgaacaaccggcccagaacctcactatactcgtgacaaatgaacacgcctagagacgacccgacgacgaccggtcttagtgttacttacgtggtcggcgggacgtacccggttaacggtaccgggggtacctacccgtccgaccccggtggggacccgtagggtaacctacgtcggtcctaccgttcctccctacgaccgcccctacccgaaccgaccgggtacccctacggttcccggtacccctttcccccgaggtaccccctaccccttcccgtaaccgaacgtacgtccccgtaccgtaccggtcggggactaaccgcggtcccgaccggtcggcctcgtccgtcggacaacgtcttaacccgtcgacgtacgtaccgagtcgaggccgggtactaggaccgagcgtacaacggtncngctgactnannngnn

SEQ ID NO: 51601 - DNA, 130 bp, Homo sapiens; identical to SEQ ID NO: 51569
  misc_feature: GYAE6OF02IHORL.16.78.H01.1.454.CMB.1.raw
  modified_base (130)..(130): a, c, t, g, unknown or other
  misc_feature (130)..(130): n is a, c, g, or t

SEQ ID NO: 51602 - DNA, 129 bp, Homo sapiens
  misc_feature: GYAE6OF02GNQJM.16.78.H01.1.454.CMB.1.raw
tcagtgtactactccacgaccggtgctcgatttagtgtgagtagtttgggtttgggcacagcggccctgggctgcctggtcaaggactacttccgagtagtacactgagcgggctggcaaggcgcatag

SEQ ID NO: 51603 - DNA, 131 bp, Homo sapiens
  misc_feature: GYAE6OF02JBR5E.16.78.H01.1.454.CMB.1.raw
  modified_base (130)..(131): a, c, t, g, unknown or other
  misc_feature (130)..(131): n is a, c, g, or t
tcagtgtactactccacgaccggtgctcgatttagtgtgagtagtttgggtttgggcacagcggccctgggctgcctggtcaaggactacttccgagtagtacactgagcgggctggcaaggcgcatagnn

SEQ ID NO: 51604 - DNA, 130 bp, Homo sapiens; identical to SEQ ID NO: 51569
  misc_feature: GYAE6OF02IM3US.16.78.H01.1.454.CMB.1.raw
  modified_base (130)..(130): a, c, t, g, unknown or other
  misc_feature (130)..(130): n is a, c, g, or t

SEQ ID NO: 51605 - DNA, 503 bp, Homo sapiens
  misc_feature: GYAE6OF02FJMC8.16.78.H01.1.454.CMB.1.raw
  modified_base (495)..(503): a, c, t, g, unknown or other
  misc_feature (495)..(503): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccagggaaggggctggagtgggtctcatccattagtagtagtagtagttacatatattacgcagactcagtgaagggccgattcaccatctccagagacaacgcccagaactcactatatctgcaaaatgaacagcctgagagccgacgacacggctgtgtattactgtgcgggagccgtaacttcgggggactacctcgacccctggggccagggaatactggtcaccgtctcctcagcctccaccaagggcccatccggtcttccccctggcaccctcctccaagagcacctctggggcacagcgccctgggctgcctggtcaaggactacttccgagtagtacactgagcggctggcaggcgcatagnnnnnnnnn

SEQ ID NO: 51606 - DNA, 505 bp, Homo sapiens
  misc_feature: GYAE6OF02II2WF.16.78.H01.1.454.CMB.1.raw
  modified_base (495)..(505): a, c, t, g, unknown or other
  misc_feature (495)..(505): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccagggaagggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgtggggagccgtaacttcgggggactacctcgacccctggggccagggaatactggtcaccgtctcctcagcctccaccaagggcccatcggtcttccccctggcaccctcctccaagagcacctctgggggcacagcggcctgggctgcctggtcaaggactacttccgagtagtacactgagcggctggcaggcgcgatagnnnnnnnnnnn

SEQ ID NO: 51607 - DNA, 578 bp, Homo sapiens
  misc_feature: GYAE6OF02GE3WW.16.78.H01.1.454.CMB.1.raw
  modified_base (553)..(553): a, c, t, g, unknown or other
  misc_feature (553)..(553): n is a, c, g, or t
  modified_base (556)..(556): a, c, t, g, unknown or other
  misc_feature (556)..(556): n is a, c, g, or t
  modified_base (559)..(559): a, c, t, g, unknown or other
  misc_feature (559)..(559): n is a, c, g, or t
  modified_base (563)..(563): a, c, t, g, unknown or other
  misc_feature (563)..(563): n is a, c, g, or t
  modified_base (569)..(569): a, c, t, g, unknown or other
  misc_feature (569)..(569): n is a, c, g, or t
  modified_base (574)..(574): a, c, t, g, unknown or other
  misc_feature (574)..(574): n is a, c, g, or t
tcagtgtactactccacgaccggtgctcgatttagtgtgagtagtttgggtttgggctcgaactcgtcctgtgcagcctctggattcgaccttgagaacttatagcatgaactgggtccgccaggctccagggaagggctggaggtgggtctcgatccgattagtagtagtagtagttacatatattacgcagactcagtgaaggccgattcaccatctccagagacaacgcccagaactcactatatctgcaaatgaacagcctgagagccgacgacacggctgtgtattacctgtgcgggagccgtaacgttcgggggactaccgtcgacccgtggggccagggatacgtggtcaccgtctcctcagcctccaccgaacgggccacgtaccggtccttcccccgtcggccaccctcctacccaacgacgcacctcgtcgggggtcacgacggccggcccgtacgggcgttcgccgtggtcaaggaccttacgttaccgagtaacgtactacgtagacggccggcgtcggcgaacgggtcgacgtagtaggngcncgngcgngtcgcngtcgntacg

SEQ ID NO: 51608 - DNA, 563 bp, Homo sapiens
  misc_feature: GYAE6OF02H2F8H.16.78.H01.1.454.CMB.1.raw
tcagtgtactactccacgaccggtgctcgatttagtgtgagtagtttgggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctggggggaggcctgggtcaagcctgggggggtccctgagactctcctgtgcagcctctggatttcaccttgagaacttatagcatgaactgggtccgccaggcctaccgagggaaggggctgggagtgggtctcatccattagtagtagtagtagtacatatattacgcagactcagtgaagggccattcaccatctcagagacacgccagaactcactatatctagacaaatgaacacgctgagacgccgacgacacgctgtagtattacgtgtacggcgggaggtccgtaacggttcggggtaacctacccgtaccgaccccggtcggggacccgaagggtactacgttaccgg

SEQ ID NO: 51609 - DNA, 133 bp, Homo sapiens
  misc_feature: GYAE6OF02H1NZT.16.78.H01.1.454.CMB.1.raw
  modified_base (130)..(133): a, c, t, g, unknown or other
  misc_feature (130)..(133): n is a, c, g, or t
tcagtgtactactccacgaccggtgctcgatttagtgtgagtagtttgggtttgggcacagcggccctgggctgcctggtcaaggactacttccgagtagtacactgagcgggctggcaaggcgcatagnnnn

SEQ ID NO: 51610 - DNA, 531 bp, Homo sapiens
  misc_feature: GYAE6OF02IDKAU.16.78.H01.1.454.CMB.1.raw
  modified_base (521)..(531): a, c, t, g, unknown or other
  misc_feature (521)..(531): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccagggaaggggctggagtgggtctcatccattagtagtagtagtagttacatatattacgcagactcagtgaagggccgattcaccatctccagagacaacgcccagaactcactatatctgcaaaatgaacagcctgagagccgacgacacggctgtgtattactgtgcggggagccgtaacgttcgggggactacctcgacccctggggccagggaatactggtcaccgtctcctcacgcctccaccaagggccccatccggtccttcccccctggcccaccctccctcccaagacgcaccctctgggggcacgagccggcccgtggctgccttcggcaaggtactacttccggagtacgtacactgagcgggctcggcgagggcgcgaatagnnnnnnnnnnn

SEQ ID NO: 51611 - DNA, 515 bp, Homo sapiens
  misc_feature: GYAE6OF02GJKVO.16.78.H01.1.454.CMB.1.raw
  modified_base (360)..(360): a, c, t, g, unknown or other
  misc_feature (360)..(360): n is a, c, g, or t
  modified_base (473)..(473): a, c, t, g, unknown or other
  misc_feature (473)..(473): n is a, c, g, or t
  modified_base (503)..(503): a, c, t, g, unknown or other
  misc_feature (503)..(503): n is a, c, g, or t
  modified_base (505)..(505): a, c, t, g, unknown or other
  misc_feature (505)..(505): n is a, c, g, or t
  modified_base (508)..(515): a, c, t, g, unknown or other
  misc_feature (508)..(515): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccagggaaggggctggagtgggtctcatccattagtagtagtagtagttacatatattacgcagactcagtgaagggccgattcaccatctcagagacaacgcccagaactcactatatctgcaaatgaacagcctgagagccgacgacacggctgtgtattactgtgcgggagccgtaactcgggggactacctcgacccctggggccagggaatactggtcaccgtctcctcancctccaccaagggcccatcgtcttccccctggccaccctcctccaagacgcacctctgggggcacgagccgcctgggctgcctggtcaaggactacttccgagtacgtacacngagcggcgtagcgacggcgtacgaatacgncngannnnnnnn

SEQ ID NO: 51612 - DNA, 521 bp, Homo sapiens
  misc_feature: GYAE6OF02F3LTN.16.78.H01.1.454.CMB.1.raw
  modified_base (507)..(507): a, c, t, g, unknown or other
  misc_feature (507)..(507): n is a, c, g, or t
  modified_base (510)..(521): a, c, t, g, unknown or other
  misc_feature (510)..(521): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcgggggactacctcgacccctggggccagggaatactggtcaccgtctcctcagcctccaccaagggcccatcggtccttccccctggccaccctcctccaacgacgccacctctgggggccacgacgccggcccgtgggctcgcctggtcaaggactacgttccgagtacgtacactgagcgggctgggcaggcgcgnagnnnnnnnnnnnn

SEQ ID NO: 51613 - DNA, 611 bp, Homo sapiens
  misc_feature: GYAE6OF02F5NRX.16.78.H01.1.454.CMB.1.raw
  modified_base (597)..(597): a, c, t, g, unknown or other
  misc_feature (597)..(597): n is a, c, g, or t
  modified_base (602)..(602): a, c, t, g, unknown or other
  misc_feature (602)..(602): n is a, c, g, or t
  modified_base (605)..(611): a, c, t, g, unknown or other
  misc_feature (605)..(611): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccaggggaaggggctggagtgggtctcatccattagtagtagtagtagttacatatattacgcagactcagtgaagggccgattcaccatctccagagacaacgcccagaactcactatatctgacaaatgaacagcctgagagccgacgacacggctgtgtattactgtggcgggagccgtaacgttcgggggactaccgtccgaccccgtggggccagggaatacgtggtcaccgtctcctcacgcctccaccgaacgggccccagttccggtcccttcccccgtcgggccctacccctccctacccaaacggacgccacccgttcgtcggggggccaaccgacggcccgggcccgttcggggcctcggcccgtgggtccgaaacgggtaccttaccgttccggaacgttaacgtaaccacgttcggaacggccggggctcggggaccgaacggggccgacgtaagtacgngcgangcnnnnnnn

SEQ ID NO: 51614 - DNA, 623 bp, Homo sapiens
  misc_feature: GYAE6OF02G1ORO.16.78.H01.1.454.CMB.1.raw
  modified_base (607)..(607): a, c, t, g, unknown or other
  misc_feature (607)..(607): n is a, c, g, or t
  modified_base (618)..(619): a, c, t, g, unknown or other
  misc_feature (618)..(619): n is a, c, g, or t
  modified_base (621)..(623): a, c, t, g, unknown or other
  misc_feature (621)..(623): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtggcggagccgtaacgttcgggggactacctcgacccctggggccagggaatacgtggtcaccgtctcctcagcctccaccaagggcccagtccggtccttcccccgtggccacccctcctaccaacgacgccaccctccgtcgggggccaccgacggcccgggcccgttggggccttcggcccgttgggtaccgaaacgggtaccttaaccgtttccccgggaacggttaacggttaacccgtaaccgttggaacggggtccggggtccgttcgggggaccgaacgggggccggaccgtaaaggttaacggacgngacgtgcgcgnncnnn

SEQ ID NO: 51615 - DNA, 644 bp, Homo sapiens
  misc_feature: GYAE6OF02J3KZJ.16.78.H01.1.454.CMB.1.raw
  modified_base (382)..(382): a, c, t, g, unknown or other
  misc_feature (382)..(382): n is a, c, g, or t
  modified_base (627)..(627): a, c, t, g, unknown or other
  misc_feature (627)..(627): n is a, c, g, or t
  modified_base (633)..(633): a, c, t, g, unknown or other
  misc_feature (633)..(633): n is a, c, g, or t
  modified_base (635)..(635): a, c, t, g, unknown or other
  misc_feature (635)..(635): n is a, c, g, or t
  modified_base (638)..(640): a, c, t, g, unknown or other
  misc_feature (638)..(640): n is a, c, g, or t
  modified_base (642)..(642): a, c, t, g, unknown or other
  misc_feature (642)..(642): n is a, c, g, or t
  modified_base (644)..(644): a, c, t, g, unknown or other
  misc_feature (644)..(644): n is a, c, g, or t
tcagtgtactactccacgaccggtgctcgatttagtgtgagtagtttgggtttgggcgtcaactctcctgtgcagcctctggattcaccttgagaacttatagcatgaactgggtccgccaggctccagggaaggggctggagtgggtctcatccattagtagtagtagtagttacatatattacgcagactcagtgaagggccattcaccatctccagacgacacgccctagaactcactatactctgacaaatgaacacgcctgagacgccgaacgacgacggctgtgttacttacgtgtggcggagtccgtaacgttcggggacctaccgtccggacccgtggggacccgagggactacgtcggttccaccgttctccncgacgtcctacccaaccgaacgggtccccacggttcccggtccctttacccccgcggaccctaccccgtccctaccgtaacgtaccgacccgtacccgtccggtcgggggcctaccggacggcccgggtcccgtcgggtccgtccggtcccgtacggtaccgaacggtaccgttaccgttaccggacgttaacgtaccgacgtcggacggtccggcgtacggaccgtacggcgacgtacgtacgntcagcncncgnnncngn

SEQ ID NO: 51616 - DNA, 600 bp, Homo sapiens
  misc_feature: GYAE6OF02JIH6Y.16.78.H01.1.454.CMB.1.raw
  modified_base (378)..(378): a, c, t, g, unknown or other
  misc_feature (378)..(378): n is a, c, g, or t
  modified_base (425)..(425): a, c, t, g, unknown or other
  misc_feature (425)..(425): n is a, c, g, or t
  modified_base (458)..(458): a, c, t, g, unknown or other
  misc_feature (458)..(458): n is a, c, g, or t
  modified_base (499)..(499): a, c, t, g, unknown or other
  misc_feature (499)..(499): n is a, c, g, or t
tcagtgtactactccacgaccggtgctcgatttagtgtgagtagtttgggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctggagactctcctgtgcagcctctggattcaccttgagaacttatagcatgaactgggtccgccgaggcctccgagggaggggctgggagtgggtctcgagtcctattagtagtagtagtagttacatatattacgnagtactcagtgaagggccgattcaccatcctaccagagaaccaaccnccaagaactcactatatctagacaaatgaaacncgctagaagcgaccgacgacgcggtactggtagtattacgnggtcggacgggtacggtaccgtttaaccgggttcccggggaaccttcccgtacccgggtaaccccggtggggacccggtaacgggtacgtaacccggtcgg

SEQ ID NO: 51617 - DNA, 520 bp, Homo sapiens
  misc_feature: GYAE6OF02GWHMA.16.78.H01.1.454.CMB.1.raw
  modified_base (509)..(520): a, c, t, g, unknown or other
  misc_feature (509)..(520): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccagggaaggggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcggggactacctcgaccccgtggggccagggaatactggtcaccgtctcctcagcctccaccaagggcccatcggtccttccccctggccaccctccctcccaagacgccaccctcgtcgggggcacaggccggccctgggcctgcctggtcaaggctacgttccgagtagtacactgagcggcgtcggcaggcgcatagnnnnnnnnnnnn

SEQ ID NO: 51618 - DNA, 577 bp, Homo sapiens
  misc_feature: GYAE6OF02GO4FO.16.78.H01.1.454.CMB.1.raw
  modified_base (556)..(556): a, c, t, g, unknown or other
  misc_feature (556)..(556): n is a, c, g, or t
  modified_base (560)..(560): a, c, t, g, unknown or other
  misc_feature (560)..(560): n is a, c, g, or t
  modified_base (568)..(568): a, c, t, g, unknown or other
  misc_feature (568)..(568): n is a, c, g, or t
  modified_base (571)..(573): a, c, t, g, unknown or other
  misc_feature (571)..(573): n is a, c, g, or t
  modified_base (575)..(575): a, c, t, g, unknown or other
  misc_feature (575)..(575): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccagggaaggggctggagtgggtctcatccattagtagtagtagtagttacatatattacgcagactcagtgaagggccgattcaccatctccagagacaacgcccagaactcactatatctgacaaatgaacagcctgagagccgacgacacggctgtgtattactgtgcgggagccgtaacgtcggggactaccgtcgaccccgtgggccagggactacgtggtccaccgtctcctcacgccctaccaccgaacgggcccagtccggtccttcccccgtcggcctaccccgtcctaccgaacgcgcctacccgtcggtcggggccaacgcgccggtcccgtgggcctcgccgtggtcaacggcttaccgttccgagttacgtaccacgtgacggcggtacgtcggaccgacgggccgtacgagttacgcngtcngtcgtcgntcnnncncg

SEQ ID NO: 51619 - DNA, 614 bp, Homo sapiens
  misc_feature: GYAE6OF02IQEIZ.16.78.H01.1.454.CMB.1.raw
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
  modified_base (601)..(601): a, c, t, g, unknown or other
  misc_feature (601)..(601): n is a, c, g, or t
  modified_base (606)..(606): a, c, t, g, unknown or other
  misc_feature (606)..(606): n is a, c, g, or t
  modified_base (609)..(611): a, c, t, g, unknown or other
  misc_feature (609)..(611): n is a, c, g, or t
  modified_base (613)..(613): a, c, t, g, unknown or other
  misc_feature (613)..(613): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccagggagggctggagtgggtctcatccattagtagtagtagtagttacatatattacgcagactcagtgaaggccgattcacactctcagagacaacgcccanaactcactatattcngactaaatgaacacgaccagagacgaccgacgacgacggctgtagtattactgtcggcggagccgttaacgtcgggactaccgtccgtacccggtgggccgagggtaacgtacgtcggtacgtacccgtctccgtccgacgcctacccacgaacggcctacgtccgtcctccccgtcggacctcccctcctacccgtaagacgccccgtaacgtcggtcgggaccacgacggtcccggccggttacggctccggaccgtacggtacaacgggtaccgttaccgttaccgacgttaacgtacgtacgtacgtcgggcggtaggtaccgtaccgaacgggcctacgacggtacgtgacgntgcgncgnnngnc

SEQ ID NO: 51620 - DNA, 529 bp, Homo sapiens
  misc_feature: GYAE6OF02IGLXG.16.78.H01.1.454.CMB.1.raw
  modified_base (521)..(529): a, c, t, g, unknown or other
  misc_feature (521)..(529): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccagggaaggggctggagtgggtctcatccattagtagtagtagtagttacatatattacgcagactcagtgaagggccgattcaccatctccagagacaacgcccagaactcactatatctgacaaatgaacaagcctgagagccgacgacacggctgtgtattactgtggcgggagccggtaacttcgggggactaccgtccgaccccgtggggccagggaatacgtggtcacgtctctcagcctcacaacggccatcggtccttccccgtcggcaccctcctccaagacgcacctcgtcggggcacaggcgcccgtgggctgccctggtcgactacgtccgagtacgactacgtgacgcgggcgtgggacgaggtaccgacgacgtagctgcannnnnnnnn

SEQ ID NO: 51621 - DNA, 693 bp, Homo sapiens
  misc_feature: GYAE6OF02FX1OA.16.78.H01.1.454.CMB.1.raw
  modified_base (397)..(397): a, c, t, g, unknown or other
  misc_feature (397)..(397): n is a, c, g, or t
  modified_base (669)..(669): a, c, t, g, unknown or other
  misc_feature (669)..(669): n is a, c, g, or t
  modified_base (685)..(685): a, c, t, g, unknown or other
  misc_feature (685)..(685): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccagggaaggggctggagtgggtctcatcattagtagtagtagtagttacatatattacgcagtactcagtgaagggccgattcaccatcctccagacgacaaccgcccacgaacctcactatactctcgacaaatgaaacagcctgagacgcccgacgaccacggctgtgttacttacgtgtggcgggtagtaccggtaacgtttcggggggaccttacccgtccgacccccgtgggggacccgaagggaactacgtcggtccacccgttcncccgtcacgccctcccaacccgaacgggcccacgtccggtccctttcccccgtggccctacccgttccctaccaacggacgacccacccgttcggtcgggggaccaccgtacggcccgggtccccggtcgggtcctccggtcccgtacgggttaccgaaacgggttacccttaacccgggttaccggtaacggttaaccgtaaccgtaacgttcggaacggtccggggtcttacgggaccgaacgggtccggtaccgtaaggttacgacgcncgtcacggtcacggtnacgctgac

SEQ ID NO: 51622 - DNA, 601 bp, Homo sapiens
  misc_feature: GYAE6OF02HETZX.16.78.H01.1.454.CMB.1.raw
  modified_base (412)..(412): a, c, t, g, unknown or other
  misc_feature (412)..(412): n is a, c, g, or t
  modified_base (591)..(591): a, c, t, g, unknown or other
  misc_feature (591)..(591): n is a, c, g, or t
  modified_base (593)..(601): a, c, t, g, unknown or other
  misc_feature (593)..(601): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccagggaaggggctggagtgggtctcatccattagtagtagtagtagttacatatattacgcagactcagtgaagggccattcaccatctccagagacaacgcccagaactcactatatctgacaaatgaacagcctgagagccgacgacacggctgtgtattactggtgcgggagccgtaacgttcggggactacctccgacccgtggggccagggtaactcgtggcaccgtcctcctcacgcctaccaccgaacgggcccatccggtcccttcccccgtcggcccnccccgtacctacccgaagacgccaccctcggtcggggaccacgtaccggcccgggtcccgtcgggcctcggtccgtcggtacgaacgggtaccttacccggtccgtaacggttacgtaaccgtacggcgtaacgggccgggtccgttcgggacgaacggtcgggactacggtagacgcngnnnnnnnnn

SEQ ID NO: 51623 - DNA, 597 bp, Homo sapiens
  misc_feature: GYAE6OF02GTUMA.16.78.H01.1.454.CMB.1.raw
  modified_base (432)..(432): a, c, t, g, unknown or other
  misc_feature (432)..(432): n is a, c, g, or t
  modified_base (458)..(458): a, c, t, g, unknown or other
  misc_feature (458)..(458): n is a, c, g, or t
  modified_base (587)..(587): a, c, t, g, unknown or other
  misc_feature (587)..(587): n is a, c, g, or t
  modified_base (590)..(593): a, c, t, g, unknown or other
  misc_feature (590)..(593): n is a, c, g, or t
  modified_base (595)..(597): a, c, t, g, unknown or other
  misc_feature (595)..(597): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccagggaagggctggagtgggtctcatccattagtagtagtagtagttacatatattacgcagactccgtgaagggccgtttcaccatctccagagacaattccaagaacacgctgtatttgacaaatgaacagtctagagagtcgaggacacggccatatattctgtgcgaagcgggaattgggtggcggtgactgcttattacggacttacgtgggggaccaacggggtaaccctcgggttcacccgttctcccgtcacgtccctaccaccgtaacgggccctacgttccggtccctttcccccgnggccctacccctccctaccaacggcnccacctccgtacggggccacgacggccggacccgtcggccgtcgtccgtacgggtacaacgggtaccttaccgttccgacgtaacgtacacgtgaacggcggtcgtcggacgacggccgacgacgtcgntgnnnncnnn

SEQ ID NO: 51624 - DNA, 698 bp, Homo sapiens
  misc_feature: GYAE6OF02HGIA0.16.78.H01.1.454.CMB.1.raw
  modified_base (681)..(681): a, c, t, g, unknown or other
  misc_feature (681)..(681): n is a, c, g, or t
  modified_base (687)..(688): a, c, t, g, unknown or other
  misc_feature (687)..(688): n is a, c, g, or t
  modified_base (692)..(692): a, c, t, g, unknown or other
  misc_feature (692)..(692): n is a, c, g, or t
  modified_base (694)..(698): a, c, t, g, unknown or other
  misc_feature (694)..(698): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccagggaagggctggagtgggtctcatccattagtagtagtagtagttacatatattacgcagactcagtgaagggccattcaccatctccagagacaacgcccagaactcactatatctgcaaatgaacacgcctaggagacgaccgacgaccacggtctgttgttacttacgtggtggacgggacgtaccggttaacggttccggggacctacccgtccgaccccgtcggggaccgaagggtaactaccggtcggtcctaccggttccctccctacgaccgtacccgtacccaacccggaaccgggtccccgtacgtttcccgggttacccctttccccccggtcggccccgtacccccgttcccgtaacccgaacggacccgtaccctaacccgttcgggcgggggtaccaccggtacggcccggtacccggtcgggtccgtccgtccgttcgggtaccgaacggtaccgttaaccgttaccgtacggttaaccgtaccgtacgtcgggaacggtccgggacgtacgggacgtaccgggcgacgtaacgtacgngcgtcnncgangnnnnn

SEQ ID NO: 51625 - DNA, 587 bp, Homo sapiens
  misc_feature: GYAE6OF02H1UJI.16.78.H01.1.454.CMB.1.raw
  modified_base (574)..(574): a, c, t, g, unknown or other
  misc_feature (574)..(574): n is a, c, g, or t
  modified_base (576)..(577): a, c, t, g, unknown or other
  misc_feature (576)..(577): n is a, c, g, or t
  modified_base (580)..(587): a, c, t, g, unknown or other
  misc_feature (580)..(587): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccagggaagggctggagtgggtctcatccattagtagtagtagtagttacatatattacgcagactcagtgaaggccattcaccatctcagagacaacgccagaactcactatatctgacaaatcgaacagcctgagacgccgacgacacggctgtgtatactgtgcggacgccgtacgttcggggactaccgtcgacccgtgggaccgaggactcgtggtcaccgtctcctcacgccctacgaccgaacggccccacgtccggtcccttcccccgtcggccctaccctccctccgaacgacgccctaacccgtcgtcgggggacaccgacggcccggtcccgtcgggtcctcggtcccgtcggtaccggaacggtaccttaccgttaccggtaaccgttacgtaccgacgttggacggacgggcgtacgggacgacggcgcgaagtagncnncgnnnnnnnn

SEQ ID NO: 51626 - DNA, 795 bp, Homo sapiens
  misc_feature: GYAE6OF02GAZSR.16.78.H01.1.454.CMB.1.raw
tcagtgtactactccacgaccggtgctcgatttagtgtgagtagtttgggtttgggggagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggccgtggtcaaggccgtggggggtccctggacgactctcctgtgcagcctctggtattccacctttggaagaaactttatagaccagtgaaacgttcggggtacccaccgacggccgtaccggaaggggaacggggccgtgggtaacggtcggggttacctacgtacgttacctaagtttaaggtaaggttaagttaacgttaaggtttaacaagttaacttaagtttaaccgaccgtaaaggaccttacgaaggttacggaaacggggtccctaatttcccgaacctacgtaccctaccaacggaacgtaaccccaaaccgtacccaaacgttaaacctaccaaacttaacttacgttaacgtacggaaacctaaaagttacgaaaccgacgtcccgttaagaaacggacgtacccgaagaaccgtaaccgtcgttagttacggtaacttacggtgtaccggggacggtaaccggttaccggttaaacccgggttccgggggtaactttacccccggaacccggttaccccgggacggggtaacccgaagggggttaaaccttccggttaaccccggg

SEQ ID NO: 51627 - DNA, 655 bp, Homo sapiens
  misc_feature: GYAE6OF02IS1HS.16.78.H01.1.454.CMB.1.raw
  modified_base (181)..(181): a, c, t, g, unknown or other
  misc_feature (181)..(181): n is a, c, g, or t
  modified_base (630)..(630): a, c, t, g, unknown or other
  misc_feature (630)..(630): n is a, c, g, or t
  modified_base (635)..(635): a, c, t, g, unknown or other
  misc_feature (635)..(635): n is a, c, g, or t
  modified_base (639)..(639): a, c, t, g, unknown or other
  misc_feature (639)..(639): n is a, c, g, or t
  modified_base (645)..(645): a, c, t, g, unknown or other
  misc_feature (645)..(645): n is a, c, g, or t
  modified_base (650)..(650): a, c, t, g, unknown or other
  misc_feature (650)..(650): n is a, c, g, or t
  modified_base (652)..(652): a, c, t, g, unknown or other
  misc_feature (652)..(652): n is a, c, g, or t
  modified_base (654)..(654): a, c, t, g, unknown or other
  misc_feature (654)..(654): n is a, c, g, or t
tcagtgtactactccacgaccggtgctcgatttagtgtgagtagtttgggtttgggctcaactctcctgtgcagcctctggattcaccttgagaacttatagcatgaactgggtccgccaggctccagggagggctggagtggtctcatccattagtagtagtagtagtacatatattcgnagactcagtgaagggcctatcacatctccagacgacacgccaagactcactatatctagacctaatacgaacacgccgtaggagtacgccgaacgacgtacggcttcgtagttattagtcggtcggaggtcgtaaccgttacggttccggggtaacctccgccgtacccggtgggaccgaggtactcgtcggtcctaccgtcctcctacgacgtcccgtaccaaccggaccggtacctacgtacccggttcccttccccgcggtaccccttacccgtacccgtaccgtaacgtacgtacccgtaccgtcgggtacgggtaccgaccgaccggaccggtaccggtacggccttcggcccgttcgacgtaaccggtacttaccgttaccgtaacgtacgtactacgtacggaccggtcggccggtacgacgacggtacgtccgtagtccgngaccngcgngtacgngacgngngnc

SEQ ID NO: 51628 - DNA, 603 bp, Homo sapiens
  misc_feature: GYAE6OF01BWLHM.39.11.A11.1.454.CMB.1.raw
  modified_base (299)..(299): a, c, t, g, unknown or other
  misc_feature (299)..(299): n is a, c, g, or t
tcagtcgcactagtcacgaccggtgctcgatttagctacgactgcagggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcctggtaccagcaatatccaggcacacgcccccaaatcatctatttangaggtcagtaactcggcctcgtagggtttctaagtcgcttctcgtgcctactaagtctgacaacgaccggcctccctcgacctatccgttcgtcgggccttaccgagggtctacgggaacgggaccgagggtccttaggtaactttacgttacgtcgacctaggtccttacgtagttttacgactaaattcgagttgaacggttctttaagttcgttacgttacgggaaaggttcgggaaccgtaagggttccacgtttccggttaccgtaggttaccgaacgtaccccgaaacggtaaccccc

SEQ ID NO: 51629 - DNA, 493 bp, Homo sapiens
  misc_feature: GYAE6OF01C5E6D.39.11.A11.1.454.CMB.1.raw
  modified_base (320)..(320): a, c, t, g, unknown or other
  misc_feature (320)..(320): n is a, c, g, or t
  modified_base (490)..(490): a, c, t, g, unknown or other
  misc_feature (490)..(490): n is a, c, g, or t
tcagtcgcactagtcacgaccggtgctcgatttagctacgactgcaggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccagcagtgacgttggtgtacaactatgtctcctggtaccaacaacaccccggcaaagcccccgaagtcatgatttatgacgtcactaatcggccctcagggtntctaatcgcttctctggctccaagtctggcaacacggcctccctgaccatctctgggcctccaggctgaggacgaggctgattattactgcagctcatttgcaatcagtgaggtcttatgtcttggagtgggacctaaggtcatcgtctaggcagcccaggcccacccgntcg

SEQ ID NO: 51630 - DNA, 556 bp, Homo sapiens
  misc_feature: GYAE6OF01DDFK7.39.11.A11.1.454.CMB.1.raw
  modified_base (223)..(223): a, c, t, g, unknown or other
  misc_feature (223)..(223): n is a, c, g, or t
  modified_base (305)..(305): a, c, t, g, unknown or other
  misc_feature (305)..(305): n is a, c, g, or t
  modified_base (332)..(332): a, c, t, g, unknown or other
  misc_feature (332)..(332): n is a, c, g, or t
  modified_base (430)..(430): a, c, t, g, unknown or other
  misc_feature (430)..(430): n is a, c, g, or t
  modified_base (454)..(454): a, c, t, g, unknown or other
  misc_feature (454)..(454): n is a, c, g, or t
  modified_base (552)..(552): a, c, t, g, unknown or other
  misc_feature (552)..(552): n is a, c, g, or t
tcagtcgcactagtcacgaccggtgctcgatttagctacgactgcaggggggggtctcaggaggcagcgctctcaggacatctccaccatggcctgggctctgctgctcctcaccctcctcactcagggcacgagggtcctgggcccagtctgccctgactcagcctgcctccgtgtctgggtctccgtggacagtcgctcaccatctcctgcactggaaccngcagtgacgttggtgttaacaactatgtctctaggtaaccaacaaccacccggacaaaccgcccccgaagtcatgtatttancgactcaactactccggcctgagggtntactaatcgtcttctcgtggctaccgaagtcgtggaccaacgaccgtccctaccctgaccctatcctcgtcggcctccgaggtctaggaaggacgagngtagtaatttactactgctagctntatttgactaatcgagtgagtcttagtcgttcgttacggaagtcggaacgttaggctacgtcgtacgtaggcctaacgaccccaaggccccaacccgntccg

SEQ ID NO: 51631 - DNA, 685 bp, Homo sapiens
  misc_feature: GYAE6OF01CNS66.39.11.A11.1.454.CMB.1.raw
  modified_base (125)..(125): a, c, t, g, unknown or other
  misc_feature (125)..(125): n is a, c, g, or t
  modified_base (143)..(143): a, c, t, g, unknown or other
  misc_feature (143)..(143): n is a, c, g, or t
  modified_base (163)..(163): a, c, t, g, unknown or other
  misc_feature (163)..(163): n is a, c, g, or t
  modified_base (203)..(203): a, c, t, g, unknown or other
  misc_feature (203)..(203): n is a, c, g, or t
  modified_base (222)..(222): a, c, t, g, unknown or other
  misc_feature (222)..(222): n is a, c, g, or t
tcagtcgcactagtcacgaccggtgctcgatttagctacgactgcagggggggtctcaggaggcagcgctctcaggacatctccaccatggcctgggctctgctgctcctcacctcctcactcgnggcactggtcgcgggccnggtctaggcctcgactacgngcctgcctcgtgtctgggctcctggacagtcgcctcactntcgtcctgcactggaaccngtctagtgacggttggtagttactaagttacgtcgtcgtacgtacggtaaccaaccgtaaccgacccggaacgaaccggtacccgaatcgagtgtacttagacgtactactacgtacgtccggtaccgtagtacgggtctacgtaacgtcgtccttacgcgtacggctaccggtagtccgtacggaacaaccggtcccggtacccttaccggaactaacccgtacttccgtaccggtcggtccctaccggagtaccgtacggacggtacgtggtacgtacgtacgttacgtacgtacgtacgtacgtactacgtacttactacgtaacgtaacgtaacgtaacttacgttacgttacggttacggtacggtacggtacgtacggtaccggtaccgtaccggtaccggtacggtaccgtaccgtaccgtacggtaccgtacccgtacccgtcccgtccgtaccg

SEQ ID NO: 51632 - DNA, 542 bp, Homo sapiens
  misc_feature: GYAE6OF01DNTZK.39.11.A11.1.454.CMB.1.raw
  modified_base (327)..(327): a, c, t, g, unknown or other
  misc_feature (327)..(327): n is a, c, g, or t
  modified_base (362)..(362): a, c, t, g, unknown or other
  misc_feature (362)..(362): n is a, c, g, or t
  modified_base (419)..(419): a, c, t, g, unknown or other
  misc_feature (419)..(419): n is a, c, g, or t
tcagtcgcactagtcacgaccggtgctcgatttagctacgactgcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccagcagtgacgttggtgttaacactatgtctctggtaccaacaacacccggacaaacgcccccgaagtcatgtatttatgacgtcactaatccggccctcgaggggtntactaatcgcttctctggctccaagtctggcaacncggccctcctgaccatctcgtcgggctccgaggctaggaggacgagctgattatacngcagtctctatttgactaatcgtagtgagtcttagtcgttacgttacgggaagtcgggaaccgtaaggtctaagttccggtaccgtaggtacacggaccccaaggccccaaacccgtgtaccg

SEQ ID NO: 51633 - DNA, 541 bp, Homo sapiens
  misc_feature: GYAE6OF01BSLY2.39.11.A11.1.454.CMB.1.raw
  modified_base (291)..(291): a, c, t, g, unknown or other
  misc_feature (291)..(291): n is a, c, g, or t
  modified_base (315)..(315): a, c, t, g, unknown or other
  misc_feature (315)..(315): n is a, c, g, or t
  modified_base (328)..(328): a, c, t, g, unknown or other
  misc_feature (328)..(328): n is a, c, g, or t
tcagtcgcactagtcacgaccggtgctcgatttagctacgactgcagggggggtctcaggaggcagcgctctcaggacatctccaccatggcctgggctctgctcctcctcagcctcctcactcagggcacaggatcctgggctcagtctgccctgactcagcctcgctcagtgtccggtctcctggacagtcagtcaccatctcctgcactggaaccagcagtgatgttggtgttataactatgtctctgtaccaacacacccagcaaacgccccaaactcatcatttangactcactaatccgcctgagggtntctaatcgcttcnctgctcagtctgacacgcggcctcctgacctatctcgtgggccctccgaggtctaggacggtacgaggtcctagtatttattactgacagtcctctaattacttacaagctaagttaacttactgtttcccgtttgggaccggtacggtaacccaggtccgtacggtacccgttccgtaggttacccacggtaccccgaaggtccgtccccgg

SEQ ID NO: 51634 - DNA, 499 bp, Homo sapiens
  misc_feature: GYAE6OF01ELA4B.39.11.A11.1.454.CMB.1.raw
  modified_base (299)..(299): a, c, t, g, unknown or other
  misc_feature (299)..(299): n is a, c, g, or t
  modified_base (415)..(415): a, c, t, g, unknown or other
  misc_feature (415)..(415): n is a, c, g, or t
tcagtcgcactagtcacgaccggtgctcgatttagctacgactgcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccagcagtgacgttggtggttacaactatgtctcctggtaccaacaacaccccggcaaacgcccccgaagtcatgatttangacgtcactaatcggccctcagggtgtctaatcgcttctctggctccaagtctggcaacacggcctcctgaccatctctgggctcaggctgagacgagctgattatactgcagctnatattcaagcagtaatactgttcctttcggcggaggtaccaagcgtcgaccgtctggtcagcccaaggctcgcccctgtctacc

SEQ ID NO: 51635 - DNA, 663 bp, Homo sapiens
  misc_feature: GYAE6OF01BHAY5.39.11.A11.1.454.CMB.1.raw
  modified_base (221)..(221): a, c, t, g, unknown or other
  misc_feature (221)..(221): n is a, c, g, or t
tcagtcgcactagtcacgaccggtgctcgatttagctacgactgcagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatcctcctgcactggaaccngcagtgacgttggtgttacactatgtctcctgtaccaacaaccaccccggcaaacgcccccgaagtcactgtaatttatacgacgtactactaacgtccgccctgaggggtcgtactaacgtcgtccttcgtctcgggtctaccgaagtcgtcggacaaccgtaccgccctaccgtcgacctactcgtctcggcctccgacggctaggacggacgaggtcgtagtacgtttattaccgtgacctagccttactaacgttaattaccgtaacgtacgtaacgttaaacgttaccgttacggtttcccgttttaccggggacgggtaacgggtaacccgaaacggttcccggttacggtaccccggttacgtacccgggtaccgtacccgtaccggtaaccggtccgtaccccgtccccccggtccggttacccgttacccccg

SEQ ID NO: 51636 - DNA, 806 bp, Homo sapiens
  misc_feature: GYAE6OF01AD74D.39.11.A11.1.454.CMB.1.raw
tcagtcgcactagtcacgaccggtgctcgatttagctacgactgcgaggggggggtctcaggaggcagcgctctcaggacatctccaccatggcctgggctctgctgctcctcaccctcctcactcagggcacgagggtcctgggcccagtctggcctgacacacgcctcgccctcgtgtctgacgactcctggacagtcgatccaccatcctcctgccacgtacggaaccagctaggtggtacggtttggtagtactttaataatttacgtcgttccttccgttcggttaccaaacgacgacctacgttcgaacggccaaccggtacccgaaccccgttaaaactttacttttaaacttttaggtcggtacggtttccgtttccggtccggtcccgttacggttacggggtttccttacgttccgtccgtttaccgtcccggtctaccgtaacgtccgtacgaccaaccgcccggtccctccgtacgacctacttcctacgtacgtaccgtaccgacgggtccgtagggaacgggaccggtacggttaccgttaagttaacctttaagtttacgttccgacgtacgttaccttacgttaacgttaacgttacggtaagttaaccgttaacgttaacggtttacggttaaccgtaccggttacgggtacgggttccggttaccggggttaccggggtaccggggtaaacgggttaacccgttacggttaccccggtaacccggtttaccggtaacggacccgtaacccgggacccggttaaccgggttccccgttaccccccgggg

SEQ ID NO: 51637 - DNA, 592 bp, Homo sapiens
  misc_feature: GYAE6OF01EOF7M.39.11.A11.1.454.CMB.1.raw
  modified_base (326)..(326): a, c, t, g, unknown or other
  misc_feature (326)..(326): n is a, c, g, or t
tcagtcgcactagtcacgaccggtgctcgatttagctacgactgcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccagcagtgacgttggtgttacaactatgtctcctggtaccaacaaccacccggacaaacgcccccgaagtcatgatttatgacgtcactagtccggcctcgagggtntactaatcgcttctctggctcagtctggacaacgaccggcctccctagaccatcctcgtcggcctccgaggtcgtaggacggacgacggtcgtagtactttattacgtgactagtcctactaattacttacgaagtactaagttaacttacgttcgtttaccggttttacgggacgggtaacgggaacctaaggtcgtacggtacccggtactacggtaccgacgaccccgtaaggtcctacccggcccccgttggtaccctaccg

SEQ ID NO: 51638 - DNA, 727 bp, Homo sapiens
  misc_feature: GYAE6OF01EO94M.39.11.A11.1.454.CMB.1.raw
  modified_base (208)..(208): a, c, t, g, unknown or other
  misc_feature (208)..(208): n is a, c, g, or t
  modified_base (221)..(221): a, c, t, g, unknown or other
  misc_feature (221)..(221): n is a, c, g, or t
tcagtcgcactagtcacgaccggtgctcgatttagctacgactgcgaagggaagggggagaggctgctctaagttaggacccagaggggaaccatggaaaccccagcgcagcttctcttccgtcctgctacctctggctcccagactaccaccggagaatttgtgttgacgcaagtctccaggcaccctgtcttcgtcgtccaggggntagcgcctacctntctgacagggccagtcagtcgtgttagcacctccttagccgtggtaaccagcagtaactttcgggccctaggcctcccgaggtcctaccgtcgacttcgtttcgactttcccacttcccgacgtctacggggtcccaacggtggccaacgttccccgaagtaccgcggttaccgaggtcggaccctagggtcgggttacctcggggactaacggtaccgttactaaccgttcctacctacctacgttccgacgtaccgacgggtacgtcgggacgtaccgtaggtaacgtacgttttcggacgtagtacgtttaagttagttacggtactacgtacgtaagttaaggtcggtaacgtcccgttacccccgtaaggtccggtttaccgggacccgtaacgggtaaccctaggttacggtacgggtaaaattccggtaaaacgtacttagggtaccggtacgtacggtacccgtaaccgtacgttaccgttacgtccgttcgtaaccg

SEQ ID NO: 51639 - DNA, 642 bp, Homo sapiens
  misc_feature: GYAE6OF01DMHPH.39.11.A11.1.454.CMB.1.raw
  modified_base (215)..(215): a, c, t, g, unknown or other
  misc_feature (215)..(215): n is a, c, g, or t
  modified_base (247)..(247): a, c, t, g, unknown or other
  misc_feature (247)..(247): n is a, c, g, or t
  modified_base (265)..(265): a, c, t, g, unknown or other
  misc_feature (265)..(265): n is a, c, g, or t
  modified_base (628)..(628): a, c, t, g, unknown or other
  misc_feature (628)..(628): n is a, c, g, or t
  modified_base (633)..(633): a, c, t, g, unknown or other
  misc_feature (633)..(633): n is a, c, g, or t
  modified_base (636)..(636): a, c, t, g, unknown or other
  misc_feature (636)..(636): n is a, c, g, or t
  modified_base (638)..(638): a, c, t, g, unknown or other
  misc_feature (638)..(638): n is a, c, g, or t
tcagtcgcactagtcacgaccggtgctcgatttagctacgactgcaggcctctggaggcaaccttcaactaggttatgtcatcacttgggtgcgacaggcccctggaccaagggctttgagttgggtgggagggatcatctctatggtttggaacacccatggttggtacacaagttacgcacagaacgttccagggcagagtcacgattaccgnggacaatctacgagctacagcctacatcggcnctagagtatctgagatcngaggacacggccgtctagtttctggtgcggagtggacgcggtatctacttaaggtacgcgcggcactacgtcgggccagggacctggtccaccgtctcctcgacgcctcccgaccgaacgggccctacgtccggtacccttccccgtaggccccacccgttccgtaccaacgactccgtaaccccgttcggtacggggaccacgaccggcccgggtacccgtcggggcccttacgggcccgtttacgggtaccgaaacgggtaccttaaccgttccctaaccgtacggttccgtacccgtaccgtagggtacggccgggtccgtacgggacgtaacgggtcggaccgtaacggttcgcgtacngtacncgncngcac

SEQ ID NO: 51640 - DNA, 693 bp, Homo sapiens
  misc_feature: GYAE6OF01A58UZ.39.11.A11.1.454.CMB.1.raw
  modified_base (196)..(196): a, c, t, g, unknown or other
  misc_feature (196)..(196): n is a, c, g, or t
  modified_base (231)..(231): a, c, t, g, unknown or other
  misc_feature (231)..(231): n is a, c, g, or t
  modified_base (257)..(257): a, c, t, g, unknown or other
  misc_feature (257)..(257): n is a, c, g, or t
  modified_base (291)..(291): a, c, t, g, unknown or other
  misc_feature (291)..(291): n is a, c, g, or t
  modified_base (562)..(562): a, c, t, g, unknown or other
  misc_feature (562)..(562): n is a, c, g, or t
tcagtcgcactagtcacgaccggtgctcgatttagctacgactgcagggggggtcgtcgaggaggcgagcgctctcaggacatctccaccatggcctgggctctgctgctcctcaccctctcactcagggcacagggtcctgggcccagtctcgccctagactcgaggctgcctcgtgtctgggtctcgtaggacngttcgatccaccgattctcctgcaagtggaacccnggcaggtgtaccggtttgggggttangtactagtcgtctccgtggtaccagtactattanccgaggtcaaccgacggacccctaaagcactactacgttttagacgtacggtacgtagtaacgtccggtacctacggttaagggtttcctaaacgttcgttctacgttcgtcgggtactacaacggttctacggactaaacggtcgcccttaccgacggtacctactccgttccgtcgggtcctacccggtacggtctacgggtacggacggacggtctaacgtactttacttacgtagaccgtaagtcttacgtcgtttacgacgttaanaccggtagtacgacgttcgttacgtacgtttccggttacgggtaagggttaccgggtaaccgttaacggttctaacgttccggtttaaccgtacggttaacccgaccggccccggttaaaagtcccccccg

SEQ ID NO: 51641 - DNA, 572 bp, Homo sapiens
  misc_feature: GYAE6OF01DJCMV.39.11.A11.1.454.CMB.1.raw
  modified_base (324)..(324): a, c, t, g, unknown or other
  misc_feature (324)..(324): n is a, c, g, or t
  modified_base (334)..(334): a, c, t, g, unknown or other
  misc_feature (334)..(334): n is a, c, g, or t
tcagtcgcactagtcacgaccggtgctcgatttagctacgactgcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatcctcctgcactggaaccagcagtgacgttggtgtacactatgtctctggtaccaacaacacccggacaaacgcccccgaagtcatcgtattatgacgtcactaatcggccctgaggggtntactaatcgnttctctggtctcaagtctggaccaacgcgcctacctgaaccatctcgtacgggctccgagcgtaggaggacggagtctgtaatttatacgtgcagctacgattatacgaatacgtaagttaattacttcggttccgtttcgggaaccggtacggacccgtaagccgtacggtacccgtacgtacggtaccgacggaccccgtaaggtcccgtaccgtccccccgttggtacctccccg

SEQ ID NO: 51642 - DNA, 608 bp, Homo sapiens
  misc_feature: GYAE6OF01EWTCJ.39.11.A11.1.454.CMB.1.raw
  modified_base (279)..(279): a, c, t, g, unknown or other
  misc_feature (279)..(279): n is a, c, g, or t
  modified_base (288)..(288): a, c, t, g, unknown or other
  misc_feature (288)..(288): n is a, c, g, or t
  modified_base (599)..(599): a, c, t, g, unknown or other
  misc_feature (599)..(599): n is a, c, g, or t
  modified_base (602)..(608): a, c, t, g, unknown or other
  misc_feature (602)..(608): n is a, c, g, or t
tcagtcgcactagtcacgaccggtgctcgatttagctacgactgcagggcctctggaggcaccttcaatagttatgtcatcacttgggtgcgacaggcccctggacaagggcttgagtgggtgggagggatcatctctatgtttggaacacccatgtttggtacaccaagttacgcacagaagttccagggcagagtcacgattaccgcggacgaatctacgagcacagcctacatggcgctgagagtctgagatctgaggacacggccgtctatttcngtgcgaagnaacggcggtacgtagtacgtacgtaggtacggcggcggacggtacgtacgggaccggtacggaccgtaccgttcgtaccgtccgtaccgtcctaccgaccgtaccgtacccaaccgaccggtaccgtcccgtccgttcccgtcccgtccgccctaccctaccgtaccgacgaccgtaccggtccgtcggacgtaccgggaccgccggccgtcggcccgtcggtccgtacggtacgtacgtaccgtaccgtaccgtacgtaccgtacgtacgtacgtcggacgtcggcgacggcgtacggacgacgcgcganagnnnnnnn

SEQ ID NO: 51643 - DNA, 617 bp, Homo sapiens
  misc_feature: GYAE6OF01A9SNM.39.11.A11.1.454.CMB.1.raw
  modified_base (296)..(296): a, c, t, g, unknown or other
  misc_feature (296)..(296): n is a, c, g, or t
  modified_base (323)..(323): a, c, t, g, unknown or other
  misc_feature (323)..(323): n is a, c, g, or t
tcagtcgcactagtcacgaccggtgctcgatttagctacgactgcagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccagcagtgacgttggtggttacaactatgtctcctggtaccaacaacacccggcaaacgccccgaagtcatgatttangacgtcactaatcggccctcgagggtntactaatcgcttctctggctcaagtctggcaacacgcctccgtgaccatctctcgggcctccgaggctaggaggacgaggctgtattattaactcgcagtctacgtattacttacgaaagctaagttaacttacgttcggttacccgtttttacggggaccgggtaacgggtaacccgtaaggtacccgtacggtaaccccgggttacccgttaacgggttaccctaacgggacccccgtaaacggggccccgttaacccggtccccccccgttccggggtccccttaacccgg

SEQ ID NO: 51644 - DNA, 621 bp, Homo sapiens
  misc_feature: GYAE6OF01E2AHI.39.11.A11.1.454.CMB.1.raw
  modified_base (486)..(486): a, c, t, g, unknown or other
  misc_feature (486)..(486): n is a, c, g, or t
tcagtcgcactagtcacgaccggtgctcgatttagctacgactgcaggggggggtctcgaggaagggcagcgctctcaggacatctccaccatggcctgggctctgctgctcctcaccctcctcactcagggcacgagggtcctgggcccagtctgccctgactcagcctgcctccgtgtctgggtctccgtggacagtcgctcaccatcctcctgcactggaaccagcagtgacgttggtgtacaactatgtctcctaggtaccaacaaccaccccggacaaaccgcccccgaaagtccatgtatttagtcgacgtcaactaacgtccggccctcggaggggttctacttaacgtccgtcctttcgtccgtggtccttaccaaggtcgtcgggaccaacgacccggtccctccccgtacgaccctacgttcctcgtcgggtcctccgaggtcgtggaagggacgaggtacctagtatttactacncgacacgtctactaattactaccgaagactaaagttaacttcgtaccgtttaccgttcgggacggacggtaaccagtcgtacgtacccgtcgtagtccgacgaccgtacgcctcccggtcccctggtccctaccg

SEQ ID NO: 51645 - DNA, 600 bp, Homo sapiens
  misc_feature: GYAE6OF01D73M5.39.11.A11.1.454.CMB.1.raw
  modified_base (224)..(224): a, c, t, g, unknown or other
  misc_feature (224)..(224): n is a, c, g, or t
  modified_base (271)..(271): a, c, t, g, unknown or other
  misc_feature (271)..(271): n is a, c, g, or t
  modified_base (295)..(295): a, c, t, g, unknown or other
  misc_feature (295)..(295): n is a, c, g, or t
  modified_base (319)..(319): a, c, t, g, unknown or other
  misc_feature (319)..(319): n is a, c, g, or t
tcagtcgcactagtcacgaccggtgctcgatttagctacgactgcaggggggggtctcaggaggcagcgctctcaggacatctccaccatggcctgggctctgctgctcctcaccctcctcactcagggcacgagggtcctgggcccagtctgcccctgactcagcctgcctccgtgtctgggtctcctggacagtcgctcaccatctcctgcacgtggaaccngcagtgtacgttggtgtacatatgtctctagtaccaacaccacccgnaacgccccaagtccatgtatttangtactcactactcgcctgagggtntactatcgcttcgtctcggtctcagtcgtacggacaacgtaccgtccctaccgtacgacctacgtccgtcgtcggcctccgaggtcgtggacggacgtacggtcgtagtatttaactacgttcgactacgtctactaattacgtactaagtactaagttaacttacgttcgtttacgtttccggacggtacggtacctaagtccgtacggttacccgtacggtacgtaccgacggtaccccgtaggttcccgccccgttacccccgttgtcccgttacccg

SEQ ID NO: 51646 - DNA, 627 bp, Homo sapiens
  misc_feature: GYAE6OF01CLK2X.39.11.A11.1.454.CMB.1.raw
  modified_base (209)..(209): a, c, t, g, unknown or other
  misc_feature (209)..(209): n is a, c, g, or t
  modified_base (296)..(296): a, c, t, g, unknown or other
  misc_feature (296)..(296): n is a, c, g, or t
  modified_base (610)..(610): a, c, t, g, unknown or other
  misc_feature (610)..(610): n is a, c, g, or t
  modified_base (619)..(620): a, c, t, g, unknown or other
  misc_feature (619)..(620): n is a, c, g, or t
  modified_base (622)..(622): a, c, t, g, unknown or other
  misc_feature (622)..(622): n is a, c, g, or t
  modified_base (624)..(624): a, c, t, g, unknown or other
  misc_feature (624)..(624): n is a, c, g, or t
  modified_base (626)..(626): a, c, t, g, unknown or other
  misc_feature (626)..(626): n is a, c, g, or t
tcagtcgcactagtcacgaccggtgctcgatttagctacgactgcagggcctctggaggcaccttcaatagttatgtcatcacttgggtgcgacaggcccctggacaagggcttgagtgggtgggagggatcatctctatgtttggaacacccatgtttggtacaccaagttacgcacagaagttccagggcagagtcacgattaccgnggacgaatctacgagcacagcctacatggcgctgagagtctgagatctgagacacggccgtctattctgtgcgagaggacgcggtancactaagtagcgcgggcactacgtggggccagggaaccctgggtccaccgtactccctacacgccctccaaccgaacgggccccaagtccggtacctttcccccgtaggcccaccccgtccctacccgaacgacgaccctaacccgtcgtacgggggtaccaccgacgggcccgggtcccgtcggggccgtcggccccgttagggtaccgaaacgggtaaccttaacccgtttcccgaaccgttacgtacggaccgtaacgtcggaacggccgggtacgtacgggtaccgaacgggccgtaccgaagttacggnagacgcacnncngngng

SEQ ID NO: 51647 - DNA, 663 bp, Homo sapiens
  misc_feature: GYAE6OF01AYI8R.39.11.A11.1.454.CMB.1.raw
  modified_base (235)..(235): a, c, t, g, unknown or other
  misc_feature (235)..(235): n is a, c, g, or t
  modified_base (271)..(271): a, c, t, g, unknown or other
  misc_feature (271)..(271): n is a, c, g, or t
  modified_base (294)..(294): a, c, t, g, unknown or other
  misc_feature (294)..(294): n is a, c, g, or t
  modified_base (312)..(312): a, c, t, g, unknown or other
  misc_feature (312)..(312): n is a, c, g, or t
  modified_base (342)..(342): a, c, t, g, unknown or other
  misc_feature (342)..(342): n is a, c, g, or t
tcagtcgcactagtcacgaccggtgctcgatttagctacgactgcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccagcagtgacgttggngttacactatgtctcctggtaccaacacacccgganaaacgccccaaatcatcatttangagtcagtaactcgcctnagggtttctaatcgcttctctgctcagtcngcacacgccctcctgaccatctcgtggcctccgaggtctggacggacgacgggtctaggtactttaactttaccgcgtacctacggtacctttacttaacgttttcgaaccttaaacgttccgtaaggttacgggtaaggtttcccgttttaaggtaccggtttaccggtttaaccggggtaagggttaccgggggtaaacccttaacggggtacccttaacggtttacccggttacccgtttaaacggggttacccaaacccgggttacccccgaaacgggtacccccctaaacccccgtaggttttacccgtaaccccg

SEQ ID NO: 51648 - DNA, 734 bp, Homo sapiens
  misc_feature: GYAE6OF01D6WSG.39.11.A11.1.454.CMB.1.raw
tcagtcgcactagtcacgaccggtgctcgatttagctacgactgcaggggggggtctcaggaggcagcgctctcaggacatctccaccatggcctgggctctgctgctcctcaccctcctcactcagggcacagggtcctgggcccagtctcgccctgactcaggctgcctccgtgtcgtggtctctaggacagtcgatcacctatctcctgcacgtaggaccagcagtgtacggttggggtatgactatgtctctcggtaccagctaatactccacggaccacaccgaccccctaaactctacttctaatttacgtgtacggttactaagtaacgtcccggtccctaggttacgggtttctaacgtccgtacttcgtcgtcggtacctaccgtaacgtcgtacggacctaaccgtcccggtcccttacccgtacgacctacttccctcgtcggtcctccgtacggtcgtacggacgggaccggtagttacgtacggttaactttacgtttaccgtcgtctaacgtccgttaacgttacgtttaccgtaacttaaccgttacgttaccggttaaggtacggttaccgttttaaggtaccggtttacggtttaccggggtaaaacggttaccgggtaaaccggttaaccggtccgttaaaccgttaccccgggttaccgttaacccgggtaccgtaacccccgggtaacccggaaaccccggtaaaccccccccg

SEQ ID NO: 51649 - DNA, 545 bp, Homo sapiens
  misc_feature: GYAE6OF01BTO29.39.11.A11.1.454.CMB.1.raw
  modified_base (195)..(195): a, c, t, g, unknown or other
  misc_feature (195)..(195): n is a, c, g, or t
  modified_base (372)..(372): a, c, t, g, unknown or other
  misc_feature (372)..(372): n is a, c, g, or t
  modified_base (377)..(377): a, c, t, g, unknown or other
  misc_feature (377)..(377): n is a, c, g, or t
  modified_base (441)..(441): a, c, t, g, unknown or other
  misc_feature (441)..(441): n is a, c, g, or t
  modified_base (454)..(454): a, c, t, g, unknown or other
  misc_feature (454)..(454): n is a, c, g, or t
  modified_base (456)..(456): a, c, t, g, unknown or other
  misc_feature (456)..(456): n is a, c, g, or t
  modified_base (459)..(460): a, c, t, g, unknown or other
  misc_feature (459)..(460): n is a, c, g, or t
  modified_base (465)..(465): a, c, t, g, unknown or other
  misc_feature (465)..(465): n is a, c, g, or t
  modified_base (470)..(470): a, c, t, g, unknown or other
  misc_feature (470)..(470): n is a, c, g, or t
  modified_base (532)..(532): a, c, t, g, unknown or other
  misc_feature (532)..(532): n is a, c, g, or t
tcagtcgcactagtcacgaccggtgctcgatttagctacgactgcaggggggggtctcaggaggcagcgctctcaggacatctccacatggcctggctctgctgctcctcaccctcctcactcagggcacgacgggtcctgggcccagtctgccctgactcagcctcgcctccgtgtcgtgggtctccgtggacngtcgctcacctactctcctgcacgtgaaccagctagtgtacggttggtacgtaacacgtatcgtacttccgtggtaaccagacatactccaggccacaccgacccaatcactacttatttagaggtacgtactaagttaacgtccgtaccgtggtaaggtttactacgtccgtcttntccgngtccctacgagtctcggaccaacgtccgcctccagcactctcgtacgctcgcgcgtagagacgnggtctatactctntncanncatanaacgngacagcactctacttgtaggtgtacgtacgggcgaaacggacagccttacggaacctcgtanaccgacgtaccgg

SEQ ID NO: 51650 - DNA, 695 bp, Homo sapiens
  misc_feature: GYAE6OF01DNR1D.39.11.A11.1.454.CMB.1.raw
tcagtcgcactagtcacgaccggtgctcgatttagctacgactgcaggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggtatgactatgtctcctggtaccagcaatatccaggccacacgaccccaaatcatctatttatgaggtacagtaactccggtaccctcgtagggtttactaacgtcgtctttctcgtcggtcctaccgtaacgtcgtcggacctaacgaccggtcccttaccctcgaccctacttccgtacggttcgggccttaccgacggtacgtacgggaacgggacggtacggtccttagtacgttttattacgttcgaccgtacgtaccttcgtaacgttttcgaccttaaacttcggtaaggttcgggtaacgttcgtttacggttacggttacccggtttaacggggtaacgggttaccgggggtaaacccgttaacgggttacgttaacccggttacccgggttcccggtttaaacgggtccgaaacccggttaccccggaaacccggtaaaccccccccg

SEQ ID NO: 51651 - DNA, 684 bp, Homo sapiens
  misc_feature: GYAE6OF01DAZKW.39.11.A11.1.454.CMB.1.raw
  modified_base (203)..(203): a, c, t, g, unknown or other
  misc_feature (203)..(203): n is a, c, g, or t
  modified_base (222)..(222): a, c, t, g, unknown or other
  misc_feature (222)..(222): n is a, c, g, or t
  modified_base (248)..(248): a, c, t, g, unknown or other
  misc_feature (248)..(248): n is a, c, g, or t
tcagtcgcactagtcacgaccggtgctcgatttagctacgactgcagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaaccntcctcctgcactggaaccngcagtgacgttggtagttaacaactntgtcctcgtaggtaaccaacaccaccccggacaaaccgccccgtaagtccattcgtatttagacgaaccgtcaacttaacgtccggacccttggagggttctactaacgtccgtctttcgtcgtcggtcctaccgtaagtccgtcggacctaaaccgtcccggtccccttacccgtacggaaccctcttccgtccggtcgggtaccttccccgaggtcctacgggacggaccggtaggtcttaggttaatttcgtttaacgcgacctagtcctacgtaattaacttacgaacgtacgtaaagttaaccttctttcgggttaccgtttccggggaacggtacgtaacccgtaagtcccgttacggtacccggttacgttacggccgaaccgtaccccgtaaggtcccctcccggtacccccgttcgtccttacccgg

SEQ ID NO: 51652 - DNA, 623 bp, Homo sapiens
  misc_feature: GYAE6OF01A3KVG.39.11.A11.1.454.CMB.1.raw
  modified_base (242)..(242): a, c, t, g, unknown or other
  misc_feature (242)..(242): n is a, c, g, or t
tcagtcgcactagtcacgaccggtgctcgatttagctacgactgcaggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttangactatcgtctctggtaccagcaatactccaggccacaccgacccccaaatcactactatttatagtacgtactagtaactccggtacccttacgtacgggtttactaagtcgtcttctcgtcgctacgaagtcgtagaccaacgaccggtccctcccgtacgacctacttccgtcgtacgggtccctaccgtaggtcgtacgggaacggacggacggtacgtagtaactttattaaccgttgaccgtacgtctagttacttagacctaattcgaaggttgtacgttacttaggtcgttacggttacgggaagggttaccggaacgtacggtacctacgttccgtacgtacggtacaccggtacccgaacccggtaacccc

SEQ ID NO: 51653 - DNA, 541 bp, Homo sapiens
  misc_feature: GYAE6OF01B3OYG.39.11.A11.1.454.CMB.1.raw
  modified_base (525)..(525): a, c, t, g, unknown or other
  misc_feature (525)..(525): n is a, c, g, or t
  modified_base (531)..(532): a, c, t, g, unknown or other
  misc_feature (531)..(532): n is a, c, g, or t
  modified_base (535)..(541): a, c, t, g, unknown or other
  misc_feature (535)..(541): n is a, c, g, or t
tcagtcgcactagtcacgaccggtgctcgatttagctacgactgcagggcctctggaggcaccttcaatagttatgtcatcacttgggtgcgacaggcccctggacaagggcttgagtgggtgggagggatcatctctatgtttggaacacccatgtttggtacaccaagttacgcacagaagttccagggcagagtcacgattaccgcggacgaatctacgagcacagcctacatggcgctgagaagtctgagatctgaggacacggccgtctatttctgtgcgagaggacgcgggtatcacttaagtagcgcgggcgactacgtggggccagggaaccctggtccaccggtctcctcacgccctccaccaacggggcccagtccggtccttccccccgtagggcccacccctccctccaacgacgccacctcgtcggggcacgacggccggcccgtgggcctcgccgtggtcgaaggcctacttcccactagtcgcgacgtgacgcgggcgtggcgaaggcgnagtagnncgnnnnnnn

SEQ ID NO: 51654 - DNA, 748 bp, Homo sapiens
  misc_feature: GYAE6OF01AI6ZY.39.11.A11.1.454.CMB.1.raw
  modified_base (223)..(223): a, c, t, g, unknown or other
  misc_feature (223)..(223): n is a, c, g, or t
tcagtcgcactagtcacgaccggtgctcgatttagctacgactgcaggggggggtctcaggaggcagcgctctcaggacatctccaccatggcctgggctctgctgctcctcaccctctcactcagggcacgagggtcctgggcccagtctcgccctgactcagcctgcctcgtgtctggtctcgtgacagtcgctcaccatcctctgacacgtacggaaccngcagtcggtacggttggtagttaacaattagtcgtcctccgtaggtaacccaaaccgaaccgaccccggacaaaccggcccccgaagtctagtagtaatttacgcgtaacgtactaacgttaacgtccggaccgtaggaggggttcttaacgtaatccgttcttctcgtacggtcctacgtacgtcgtacgacctaaccgacccggtccctaccgtacgaccgtacgttccgtcggtacgggtaccctccggtaacggtccgggtaacggtaacccggggtaacggtacgggttacttacggttaaacttttacggttaccgtggtaccgacgtacttaccgtaaatttaccgtaacgaacgttaactaaacgtttaacgttccgttaccgggtttaccggtttacggggaccgggtaacggtaccgtacgtccggttaaccgtaccggttaccggttaacgacccgttaaccggaccccgtacgggtcccgttaccccggcccccggttgtacccgttaccccg

SEQ ID NO: 51655 - DNA, 583 bp, Homo sapiens
  misc_feature: GYAE6OF01BY6LL.39.11.A11.1.454.CMB.1.raw
  modified_base (192)..(192): a, c, t, g, unknown or other
  misc_feature (192)..(192): n is a, c, g, or t
  modified_base (221)..(221): a, c, t, g, unknown or other
  misc_feature (221)..(221): n is a, c, g, or t
  modified_base (295)..(295): a, c, t, g, unknown or other
  misc_feature (295)..(295): n is a, c, g, or t
tcagtcgcactagtcacgaccggtgctcgatttagctacgactgcaggggggggtctcaggaggcagcgctctcaggacatctccaccatggcctgggctctgctgctcctcaccctctcactcagggcacgagggtcctgggcccagtctgccctgactcagcctgcctccgtgtctgggtctcctggacngtcgctcaccatctcctgcactggaaccngcagtgacggttggtgttaacactatgtctcctgtaccaacacacccgcaaacgcccccaaactcatcatttangaggtcagtaactcgccctcgtagggtttcaatcgacttctcgtgcctcacgtctcggacaacgaccggtccctcccgtcgaccctatcctacgtcgggtctcccgaggtcgtaggacggtacgacggtctacgtattattacgtcgctagcctctagtttcgactaactcgagtagagtcgtttagtcgttacgttacggaaggtcgggtaaccgtaaggtccgtagtcccgtcgttacgggtccaaccggcccgtaaccggacccctaacccctcgtccgtaaccg

SEQ ID NO: 51656 - DNA, 713 bp, Homo sapiens
  misc_feature: GYAE6OF01B6GEP.39.11.A11.1.454.CMB.1.raw
  modified_base (194)..(194): a, c, t, g, unknown or other
  misc_feature (194)..(194): n is a, c, g, or t
  modified_base (225)..(225): a, c, t, g, unknown or other
  misc_feature (225)..(225): n is a, c, g, or t
  modified_base (307)..(307): a, c, t, g, unknown or other
  misc_feature (307)..(307): n is a, c, g, or t
  modified_base (361)..(361): a, c, t, g, unknown or other
  misc_feature (361)..(361): n is a, c, g, or t
tcagtcgcactagtcacgaccggtgctcgatttagctacgactgcagggggggggtctcaggaggcagcgctctcaggacatctccaccatggcctgggctctgctgctcctcaccctctcactcagggcacagggtcctgggcccagtctgccctgactcagcctgccttccgtgtcgtgggtctcctggacngtcgctcaccatctcctgcacgtcggaaccngcaggtgacgttggtcgttaacactatgtctctaggtaccaacaaccacccggacaaccgccccgaagtcactagatttacncgacgtcaacttaacgccggtacctcgaggggtctactaacttcgaccttcgtntcggactaccgtaacgtcgtaggaccaaacgtccggtaccccttccgtacgtaaccctagttcccgttcggtccgggtaccctaccggacggtaccgttaggaacgggtacgggtaacggtaccgttacgttaattttaacgttaccgtcgaccgtacgtacttactaacgttacgttaacgtaacgtacgtaaacgtttaacgttaaccttacgggtttcccgttttaccggggaccgggtaacgggaacccgtaaggtccgtacggtacccggttaccggttaacggtaccgtaacccggtacccggtaacggtcccgtacccgttcccccggttccggtccgtaccccg

SEQ ID NO: 51657 - DNA, 874 bp, Homo sapiens
  misc_feature: GYAE6OF01C2XGT.39.11.A11.1.454.CMB.1.raw
tcagtcgcactagtcacgaccggtgctcgatttagctacgactgcgaggggggggtctcaggaggcagcgctctcgaggacatctccaccatggcctgggctctgctgcctcctcaccctctcactcgaggcacgagggtcctgggcccagtctcgccctgactcacgcctcgccctcgtgttcgtcgggtccttccgtggacgtcgtccgcctcgaccatcctccgtgccaccgtacggaaccagctaggtcggtacgttaggttacggttaactaacttagtcgttcctaccgtaccgtaaccaaccaacccgacccggaaccaacccggaccccggtaagtaccagttacgtaacgtttacgacggtaccgtacgtaaccgttaacgtcccggaccgttcggacggggttacgtaccttaacgtcgtacctttcgttccggtacgtacccgtaccgtaacgttcgtacggaaccgtaacccgaccggttaccccttaccccgtacgttacctaccgttccgttacggtccggacccgttaccgaacggttccggaaggtaacggaaccggtaggtacgttaacgtaacgtttttaacgtccgtaggtacccttaggtaccgttactaacgttttaacgtaaccgtaaacgttaaccggttaaacgtttaaaccggttacccgttttaacgggtttacccggttaccgggggtaaacgggtaacccggtaaacggtaaacccggttcccggttaccggttaaaccccggggttacctaaaccccggggttacccgaacccggggaccccttaaacccggggttcccccttacccggggttaaccccccgttcgggtaccccgtttaccccgg

SEQ ID NO: 51658 - DNA, 807 bp, Homo sapiens
  misc_feature: GYAE6OF01B0D7J.39.11.A11.1.454.CMB.1.raw
  modified_base (222)..(222): a, c, t, g, unknown or other
  misc_feature (222)..(222): n is a, c, g, or t
  modified_base (276)..(276): a, c, t, g, unknown or other
  misc_feature (276)..(276): n is a, c, g, or t
tcagtcgcactagtcacgaccggtgctcgatttagctacgactgcaggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactcggaaccngcagtgacgttggtgtcttaataattatcgttcctccgttcggttaccaaacgngtctacgttcgacggcaccggcccgtaccccgaaactttacctttaaagttttacgtacggtacggtttccgttttaccggtccggtacccgttacggttacggggttttcctacggttccgttcctttaccgtcccgggtacctaccgtaacggttccgttacggacccaaaccgtacccggtccccttccccgtacgtaacccgtactttcccgtacgttaaccgtacccgttacccgaacggggtccgttaacgggaaccgggtaacgggtaccgggtaccgttaacggttaaccctttaagttttacgttacggaccgtaacggtccttaacgtaaacgtttaacgttaaccgttaaggtaaacgttacgttaagttacgggttactaccccggtacgttacgggtaccgttacgggggttaccgggacggggtaacggtaacccgttaagggttacccggtaacccggttaccggttaacggtacccggaacccggtacccggtaacgggtccccgtacccccggg

SEQ ID NO: 51659 - DNA, 594 bp, Homo sapiens
  misc_feature: GYAE6OF01AOZ88.39.11.A11.1.454.CMB.1.raw
  modified_base (193)..(193): a, c, t, g, unknown or other
  misc_feature (193)..(193): n is a, c, g, or t
  modified_base (297)..(297): a, c, t, g, unknown or other
  misc_feature (297)..(297): n is a, c, g, or t
  modified_base (338)..(338): a, c, t, g, unknown or other
  misc_feature (338)..(338): n is a, c, g, or t
  modified_base (373)..(373): a, c, t, g, unknown or other
  misc_feature (373)..(373): n is a, c, g, or t
tcagtcgcactagtcacgaccggtgctcgatttagctacgactgcaggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacngtcgctcaccatcctcctgcactggaaccagcagtgacgttggtgttacaactatgtctcctgtacaacaacacccggacaacgccccgaagtcatgtatttangacgtcactaatccggcctgagggtctctaatcgtcttctntcgctaccagtctggcaacgccgcctcctgacctntctctcggctcgaggtctggacggacgaggtactgtacttacttacgtgcacgtctactattactacaacgtactaacgttaacttaccgttcgttccggtttaccggacgggtacggtaacctacggtccgttccgggtaacccgtccggttaacgggcccgtaaccggacccgtaacgggtcccgtacccggtccccccgtcgggtacccttaccccgg

SEQ ID NO: 51660 - DNA, 712 bp, Homo sapiens
  misc_feature: GYAE6OF01B7W7G.39.11.A11.1.454.CMB.1.raw
  modified_base (196)..(196): a, c, t, g, unknown or other
  misc_feature (196)..(196): n is a, c, g, or t
tcagtcgcactagtcacgaccggtgctcgatttagctacgactgcaggggggggtctcaggaggcagcgctctcaggacatctccaccatggcctgggctctgctgctcctccaccctcctcactcagggcacgacgggtcctcgggcccagtctcgccctgactcagcctgcctccgtgtctggtctcgtggacngtccgctcaccatcctcctgacacgtcggaaccagctagtgtacggtttggtacgttaactacttatcgtctcgtacggtaacccaaccgaaccgaccccggaaccaaaccgaccccccgtaagtcctaattcgtaatttacgtacgtaaccgtactaactaaccgtcccggtacccgtaggtacgggttactaccgtaacgtcgtcctttcgtcgtcggtacctaccgttaacgtcgtacgacctaaccgaccgtccctccgtacgaccttactccgtcgtccggtacctcgacggtcggtaacgggtaaccggacggtacggtacgtttacgttaactttaacgtccgtacgtacacgttactaagttactacgttaacacggtaacttaacgtaacttcgttacggttccgttacgggacggaccgaccgtaagtacctccggtaacccgttacgaccgtaccggaccgtaacccggtacgttcccgtcccgtacccgtcccgtcttccccgg

SEQ ID NO: 51661 - DNA, 751 bp, Homo sapiens
  misc_feature: GYAE6OF01C47IM.39.11.A11.1.454.CMB.1.raw
tcagtcgcactagtcacgaccggtgctcgatttagctacgactgcgagggggggggtctcaggaggcagcgctctcaggacatctccaccatggcctgggctctgctgctcctccaccctcctcactcgagggcacgagggtcctggcccagtctcgcctgactcacgcctgcctcgtgtcgtcggtctcgtggacagtcgctaccacctactcctccgtcgactacgtacggaaccagctaggtggtacggttgggttacgttaactaacgttagttcgttccgttccgtaacgtaaaccaaccaacccgaccccggtaaccgaaacccggtccccgaacgtctaagttacgttaacttacgacgtaccgtactaacgtaacgtccggacccgttcgggtagggttctaccttacgtcgttcttcgttcgtcgtacctcgtaacgttcgcgacctacgtaccgtcccctcgtacgacctacgtccgtcggtccggtaccaccggacggtacggtacggaacgggacgtacggttacgtagttaaccgtttagtaacgccgactacgtacgtactaacttactaacgaacgttagttaaccaacgtttccgtttaccgttaccgggttacgggaaccggtaacggtaaccgtacggtaccgtaccgggtacccgttacgggtacgaacccgtaccggacccggtacgttaccccggtaccccggttacccccgtgggttacccttacccgg

SEQ ID NO: 51662 - DNA, 658 bp, Homo sapiens
  misc_feature: GYAE6OF01BMCXM.39.11.A11.1.454.CMB.1.raw
  modified_base (191)..(191): a, c, t, g, unknown or other
  misc_feature (191)..(191): n is a, c, g, or t
  modified_base (202)..(202): a, c, t, g, unknown or other
  misc_feature (202)..(202): n is a, c, g, or t
  modified_base (220)..(220): a, c, t, g, unknown or other
  misc_feature (220)..(220): n is a, c, g, or t
  modified_base (325)..(325): a, c, t, g, unknown or other
  misc_feature (325)..(325): n is a, c, g, or t
  modified_base (383)..(383): a, c, t, g, unknown or other
  misc_feature (383)..(383): n is a, c, g, or t
tcagtcgcactagtcacgaccggtgctcgatttagctacgactgcaggggggggtctcaggaggcagcgctctcaggacatctccaccatggcctgggctctgctgctcctcaccctctcactcagggcacagggtcctgggcccagtctgccctgactcagcctgcctccgtgtctgggtctcctggacngtcgctcaccntctcctgcactggaaccngcagtgacgttggtgtacactatgtctcctggtaccaacaacaccccggacaaacgcccccgaagtcatgatttatgactcaactaagtccggccctcgagggtntctaatcgcttcgtctcgtcctacctaagtccgtggactaaccgaccggtccctcccncgtaccctattccgtcgtcgggcctccgacggtctggaacgggacgacggtcgtagtactttacgttactcgtacgacgtcctacgtaattacgttaccgaacggtacgttaagttaacgttaccgttcggtttacccgttttaccgggaacggggttacgggaaacccgtaacgggtcgtaccgggttaccccgttaccggttacgggtacccgaacggtaccccgtaaacgggtcccgtacccggtccccccggttcggtcccgttaaccccg

SEQ ID NO: 51663 - DNA, 686 bp, Homo sapiens
  misc_feature: GYAE6OF01CT7PO.39.11.A11.1.454.CMB.1.raw
  modified_base (222)..(222): a, c, t, g, unknown or other
  misc_feature (222)..(222): n is a, c, g, or t
  modified_base (290)..(290): a, c, t, g, unknown or other
  misc_feature (290)..(290): n is a, c, g, or t
tcagtcgcactagtcacgaccggtgctcgatttagctacgactgcagggggggtctcaggaggcagcgctctcaggacatctccaccatggcctgggctctgctgctcctcacctcctcactcagggcacagggtcctgggcccagtctgccctgactcagcctgcctcgtgtctgggtctccgtggacagtcgctcaccatctcctagcacgtcggaaccngcagtggacggtttggtacgttaacaactatcgttctccgtacggtaaccaaccaaccgaccccgganaaaccgaccccgtaagtccagttagtatttactacgtaccgtactaacttaaccgtccggacccttaggaacggggttctacgtaactccggtccttcgtacgtcggtccctactacggtacgtacggactaaaccgccggtccctaccgtacgtaccctagtaccgttccgtcggggtcctaaccggacggtcgtaacggacgggtaacgacgggttactaacgtaactttacgttaacgcgtaactacgacttacctaatttaacctacgaaactactaaaggttaccttaacgtttccggtttaccggtttacgggacggtaacggacctaggtaccgtacgtacgttccgagtaccacgtacccgtacgtcccaccgtccctcgcttacccg

SEQ ID NO: 51664 - DNA, 643 bp, Homo sapiens
  misc_feature: GYAE6OF01A6PDG.39.11.A11.1.454.CMB.1.raw
  modified_base (193)..(193): a, c, t, g, unknown or other
  misc_feature (193)..(193): n is a, c, g, or t
  modified_base (204)..(204): a, c, t, g, unknown or other
  misc_feature (204)..(204): n is a, c, g, or t
  modified_base (225)..(225): a, c, t, g, unknown or other
  misc_feature (225)..(225): n is a, c, g, or t
  modified_base (491)..(491): a, c, t, g, unknown or other
  misc_feature (491)..(491): n is a, c, g, or t
tcagtcgcactagtcacgaccggtgctcgatttagctacgactgcgaggggggggtctcaggaggcagcgctctcaggacatctccaccatggcctgggctctgctgctcctcaccctctcactcagggcacgagggtcctgggcccagtctgccctgactcagcctgcctcgtgtctgggtctccgtggacngtcgctcaccntctcctgctacgtcggaaccngcagtcgtacggttggtagttacaactagtcgtctccgtaggtaaccaacgaaccgaccccggataaaccggcccccgtaagtcagttaggtatttacgcgaccgtctaactacgtccggcccgttaggaggggttctacgtagtccgtcgttacgtcgtcgtcctaccgagtcgcggaccaacgtccggtcctccgtagacctactcgtcgtcggtcctacgtcggtcgtaggacggacggtacgtctagttacttacgttacgngtacgtcgtctaatacttctacgaagtcgtaagttacgttcgttacggtttacggtcgggacggaacggaccgtacgtccgtaccggtacccgtcggttcgacccgtacgtacccgtacggtcccgtacccgccccgttggtaccctcccgg

SEQ ID NO: 51665 - DNA, 645 bp, Homo sapiens
  misc_feature: GYAE6OF01E26PZ.39.11.A11.1.454.CMB.1.raw
  modified_base (201)..(201): a, c, t, g, unknown or other
  misc_feature (201)..(201): n is a, c, g, or t
tcagtcgcactagtcacgaccggtgctcgatttagctacgactgcagggggggggtctcaggaggcagcgctctcaggacatctccaccatggcctgggctctgctgcctcctcaccctcctcactcgagggcacgagggtcctgggcccagtctcgccctgactcagcctgcctccgtgtcgtggtctcgtggacagtcnctcaccatctctgcacgtggaaccagcaggtcgtacggtttggtacgttaacaactattcgtccttccgtacggtaacccaaaccgaacccgaccccggaacaaacccggacccccgaagtcattagtatttagcgtactcaactacgtccgcccgtaggtaggggtcttacgtacttcgtccttctcgtcgtacctacgacgtcgtacgacaacccgaccggtccctccgacacctactcgtcgcggtctccgaggcctaggaggaccgagttctagttattactcgtcgacgtctctataacttctaagactagttaacgttaactacgtttcggttaccggtttagggacggtaaccgggtaccacggtccgtcggttaccgaccggttgacccgaccgtacccgacggttcccgacccgtccccggtcgtccgttacccg

SEQ ID NO: 51666 - DNA, 664 bp, Homo sapiens
  misc_feature: GYAE6OF01A50OH.39.11.A11.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (220)..(220): a, c, t, g, unknown or other
  misc_feature (220)..(220): n is a, c, g, or t
  modified_base (463)..(463): a, c, t, g, unknown or other
  misc_feature (463)..(463): n is a, c, g, or t
  modified_base (497)..(497): a, c, t, g, unknown or other
  misc_feature (497)..(497): n is a, c, g, or t
  modified_base (505)..(505): a, c, t, g, unknown or other
  misc_feature (505)..(505): n is a, c, g, or t
tcagtcgcactagtcacgaccggtgctcgatttagctacgactgcgaggggggggtctcagggaggcagcgctctcaggacatctccaccatggcctgggctctgctgcctcctccacccctcctcactcgagggcacgacgggtccgtcgggcccagtctcgccctgactcacgcctcgcctcgtgtcgtcggtctcgtgacngtcgctcacntctctncacgacgaaccagcgagtgtacggttggtaggttacaacttgtcgtctccgtacgaaccaaccaccgacccggacaaccgccccgtaagtcatacgtattacgcgtaactctaactaccggtccgtaccgtggtacgggttctacgtactccgtcttcgtacgtcgcctaccgtagtcgtacggaccgaaccgtccgtccctccgtacctactcgttcgtcgtcgccgtcgagcgtagacggngtgtacgttagtacttacgtacgcgactgtactntacgttanaacggactaacgtaacgttacttcgggtttccgttaccgggtacgggacggaaccggtacctacggttccgacccgggttaccgtaccggttacggacccgtacccgggtaccctacgggttcccccggtacccgtccccggttccgttaccgtccccg

SEQ ID NO: 51667 - DNA, 631 bp, Homo sapiens
  misc_feature: GYAE6OF01EPLRL.39.11.A11.1.454.CMB.1.raw
  modified_base (275)..(275): a, c, t, g, unknown or other
  misc_feature (275)..(275): n is a, c, g, or t
  modified_base (620)..(620): a, c, t, g, unknown or other
  misc_feature (620)..(620): n is a, c, g, or t
  modified_base (624)..(624): a, c, t, g, unknown or other
  misc_feature (624)..(624): n is a, c, g, or t
  modified_base (626)..(627): a, c, t, g, unknown or other
  misc_feature (626)..(627): n is a, c, g, or t
  modified_base (629)..(629): a, c, t, g, unknown or other
  misc_feature (629)..(629): n is a, c, g, or t
  modified_base (631)..(631): a, c, t, g, unknown or other
  misc_feature (631)..(631): n is a, c, g, or t
tcagtcgcactagtcacgaccggtgctcgatttagctacgactgcagggcctctggaggcaccttcaatagttatgtcatcacttgggtgcgacaggcccctggacaagggcttgagtgggtgggagggatcatctctatgtttggaacacccatgtttggtacaccaagttacgcacagaagttccagggcagagtcacgattaccgcggacgaatctacgagcacagcctacagtggcgctgagaagtctagagatctgaggacacggccgtntattctgtgcgagaggacggcgggtatcgagttaagtagcggcgggcgacgtacgtcggggaccgagggaacccctggtccgaccgtctcccgtacgacgtccctacccgaaccgaacgggccctacgtccggtcccttcccccgtcggccctaccccgtccctacccgaacgacgaccctacccgtcggtaccggggccaaccgacgggcccgggtccccgtcgggtccgtcggtccgttacggtaccgaacgggtaccttaccgttacccgacgttacggtcgaccgtacgtaggacgggtccgggtcgtcgggaccggaagggcccgtaagacgtagctgcncagngnngngn

SEQ ID NO: 51668 - DNA, 643 bp, Homo sapiens
  misc_feature: GYAE6OF01BUP6Z.39.11.A11.1.454.CMB.1.raw
  modified_base (225)..(225): a, c, t, g, unknown or other
  misc_feature (225)..(225): n is a, c, g, or t
  modified_base (475)..(475): a, c, t, g, unknown or other
  misc_feature (475)..(475): n is a, c, g, or t
tcagtcgcactagtcacgaccggtgctcgatttagctacgactgcgaggggggggtctcaggaggcagcgctctcaggacatctccaccatggcctgggctctgctgctcctcaccctcctcactcgaggcacgagggtcctggcccagtctcgccctgactcagcctcgcctcgtgtctgggtctccgtggactgtcgctcactatcctctgcactcggaaccngcagtgtacgttggtacgttaacaactatcgtctccgtacggtaaccaaccaaccgacccgacaaaccgtacccccgaagtcacgtagtactttagcgtacgtactaacgtacgtccggccctggacgggtctacgtaactcgtcgttctcgtcggacctacgtagtcgtcgacaacgtacccgtccctccacgaccacttcgtcgtcgctcgacgtcgaggacggacgagtctatacgtttactccgtncgtacgtactcttaatacttaacggactaacgttaacggttaacttacgtttacgttcccggtttaacggggacggtaacccggtacctaacggtccgttaccgtacggttaccgtacggtcccgaacgacccgtaacggtcccacccggtacccttcggtacctccg

SEQ ID NO: 51669 - DNA, 599 bp, Homo sapiens
  misc_feature: GYAE6OF01DA7EP.39.11.A11.1.454.CMB.1.raw
  modified_base (226)..(226): a, c, t, g, unknown or other
  misc_feature (226)..(226): n is a, c, g, or t
  modified_base (233)..(233): a, c, t, g, unknown or other
  misc_feature (233)..(233): n is a, c, g, or t
  modified_base (240)..(240): a, c, t, g, unknown or other
  misc_feature (240)..(240): n is a, c, g, or t
  modified_base (254)..(254): a, c, t, g, unknown or other
  misc_feature (254)..(254): n is a, c, g, or t
  modified_base (357)..(357): a, c, t, g, unknown or other
  misc_feature (357)..(357): n is a, c, g, or t
  modified_base (421)..(421): a, c, t, g, unknown or other
  misc_feature (421)..(421): n is a, c, g, or t
  modified_base (480)..(480): a, c, t, g, unknown or other
  misc_feature (480)..(480): n is a, c, g, or t
  modified_base (586)..(586): a, c, t, g, unknown or other
  misc_feature (586)..(586): n is a, c, g, or t
  modified_base (594)..(597): a, c, t, g, unknown or other
  misc_feature (594)..(597): n is a, c, g, or t
  modified_base (599)..(599): a, c, t, g, unknown or other
  misc_feature (599)..(599): n is a, c, g, or t
tcagtcgcactagtcacgaccggtgctcgatttagctacgactgcagggcctctggaggcaccttcaatagttatgtcatcacttgggtgcgacaggcccctggacaagggcttgagtgggtgggagggatcatctctatgtttggaacacccattgtttggtacaccaagttacgcacagaagttccagggcagagtcagattaccgcggacgaatctagagcanagcctanagtggcnctgagagtctgagntctgatgacgacggccgtctatttctgtgcgaggagacggcgggtatcacttaaggtgcggcgggcgacgtacggtcggggccgacgggaaccctcggtaccncccggttacctccgtcacgccctcccaaccgacggcccagtcccggttccctccccctggcccnccccttccctaccgaacgacgccgtaccgtcggtcggggccacgacggcccggtcccgnggtccgtcgtcccgtgggtacgaacggtaccttaccgttaccgtacgtgtacgaccgtacgtggacggccgggcgttagggaccgacggggtccacggtacgtggnacgcacgnnnngn

SEQ ID NO: 51670 - DNA, 770 bp, Homo sapiens
  misc_feature: GYAE6OF01C7XTX.39.11.A11.1.454.CMB.1.raw
  modified_base (194)..(194): a, c, t, g, unknown or other
  misc_feature (194)..(194): n is a, c, g, or t
  modified_base (228)..(228): a, c, t, g, unknown or other
  misc_feature (228)..(228): n is a, c, g, or t
tcagtcgcactagtcacgaccggtgctcgatttagctacgactgcaggggggggtctcaggaggcagcgctctcaggacatctccaccatggcctgggctctgctgctcctcaccctcctcactcagggcacgagggtcctgggcccagtctgccctgactcagcctgcctccgtgtctgggtctccgtggacngtccgctcaccatcctcctgccacgtggaaaccngcaggtcgtacggtttgggtacgttaaacaacgttatcgttcctccgttacggtaacccaaaccaacccgacccggaccaaaaccggccccccgaagtccacgttagtaactttacgtacgaccgtactaactaacgtccggacccttcggagggtactacttaactcgtcttcgtcgtcggtcctaccgtaagtccgtacggaacctaacccggccgtcccctaccccgtacgaaccctacgttccgtcggttcgggtacccttacccgggtagggtacctagggtaaaccgggacgggaacggttccgttaagttaaacttttaacgtaccgttacggaccgtacggtacccttagttactttaacgttaaccgaacgtaccgtaagttaaccgttacgttttcccgggtttaccgttttcggggaaccggtaaccgggaaccgtaacggtcccggtaccggtacccgttaccgttaacgggaccctaaccgaccccggtaagtccccgtcccggttaccccctgggttcccttaccccg

SEQ ID NO: 51671 - DNA, 776 bp, Homo sapiens
  misc_feature: GYAE6OF01B7R75.39.11.A11.1.454.CMB.1.raw
  modified_base (224)..(224): a, c, t, g, unknown or other
  misc_feature (224)..(224): n is a, c, g, or t
tcagtcgcactagtcacgaccggtgctcgatttagctacgactgcaggggggggtctcaggaggcagcgctctcaggacatctccaccatggcctgggctctgctgctcctcaccctctcactcagggcacgacgggtcctgggcccagtctcgccctgactcagcctgcctcgtgtctgggtcctctggactgtcgctcacatcctcctgcacgtcggaaccngctagtcgtacgttggtacgttaactatagtcgtctccgtacgtaaccaaccgaaccgaccccggaacgaaacccggacccccgtaagtacctagtacgttatttacgtacgtacgtacctaaccgttacgtacccggtcccgtagggtacgggtcgttaccttaacgtcccgtactttccgtccgtcggtacccgttaccgtaacgtcgtaccggtaaccgaacccgacccggtcccctaccggtccgtaacccgttacgttcccgtacggtccgggtcccgttaccggacgggttacgtacgggaaccgggtacggtacgggttaactacgggtttaacttttacgttacggtcggaccctaaggttaccttaactaacgttaaccggtttaacgaaacggtacgttaacgttaaacgtttcccggttaacggtttcccggttacggggaacggtaaccggtaaccgtaacgtccgtaccggttacccggtaccgtcggtaccgccgtaaccggaccgtccgttcccgtccccggtaccgtcgttacccg

SEQ ID NO: 51672 - DNA, 1040 bp, Homo sapiens
  misc_feature: GYAE6OF01CTUNF.39.11.A11.1.454.CMB.1.raw
  modified_base (229)..(229): a, c, t, g, unknown or other
  misc_feature (229)..(229): n is a, c, g, or t
  modified_base (507)..(507): a, c, t, g, unknown or other
  misc_feature (507)..(507): n is a, c, g, or t
  modified_base (520)..(520): a, c, t, g, unknown or other
  misc_feature (520)..(520): n is a, c, g, or t
tcagtcgcactagtcacgaccggtgctcgatttagctacgactgcgaagggaaagggggaagagctcgctcagttaggacccagagggaaccatggaaaccccagcgcagctttctcttcctcctgtctactcgtggctcccagataccgacggataatttggtagttcgcgtcagtctaccgagcctacctgttcctttgctccgagggatacgacgccctccgttcnccgtagacgtacgggccctaagtccgtaggagttcgttacgacctacccttaccttacggtcccgttaggtacccaagtccgaaaacggttaaacgtttccgggacccgtaacgggtcccttaccccggagtacccttaccccgtacgtcgttttaccgttttaacgaactttcccgaacttcccgaacggacccggtacgggaccctacggtcgaacccttcgtacccaggtaacgtacggttcgacggttcgacgtaggttcgggtcgacggtaanacggtacttacgngtccaacctacgtaggacctacgacgtacgtacgtacgtaccgtacgtaggtaacgtttacgtttacggaccgttagtttaggtttaaacggtttacgtacggttacggttaacgtaacgttaacgtttaacgggttacccggtaacccgtttaccccccgtaaccccgttaacggggtttaaacccgggttacccgtaacccgggggttaaacgtaaccccgggtttaacgggttaaaaccgggttaaacccggggtttaaaacccggtaaaaacccccggggtaaaaacccgggttttaacccggggttttttaaaccccccgggggggtttaccccggttaaaaaaaacccccgggggtttcggtttttaaaaacccccccccccgggggtaaaaaacccccggttttttttcccggggttttaaaaccccccccgggggttttttacccccggttttttttaaaaccccccgggtttttaaacccccgggttttttaaaccccccccccccggggg

SEQ ID NO: 51673 - DNA, 621 bp, Homo sapiens
  misc_feature: GYAE6OF01CFK9W.39.11.A11.1.454.CMB.1.raw
  modified_base (193)..(193): a, c, t, g, unknown or other
  misc_feature (193)..(193): n is a, c, g, or t
tcagtcgcactagtcacgaccggtgctcgatttagctacgactgcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacngtcgctcaccatctcctgcactggaaccagcagtgacgttggtagttacaactatgtctctggtaccagcaatactcgaggacacgacgacccccaaactcatctatttatgagtcaagtacgtccggcctcgtagggtttactagtccgtcttctcgtggcctccgaagtctcggacaaaccgtccggtccctccctcgaccctagtcctcggtcggcctacccgaggtacgtaggacggaccggtaggtccttagtaatttacgttacgacggtcaggtcttactagttcgtactatacgtaggtcgacggttattcgtacggttcggttacggtaacgggtgggaaacccgttagggttaccttacggttaccggttaccgttagggacccgtaaccggtaccccggaaacccggtaaccccccg

SEQ ID NO: 51674 - DNA, 672 bp, Homo sapiens
  misc_feature: GYAE6OF01A4PRK.39.11.A11.1.454.CMB.1.raw
  modified_base (228)..(228): a, c, t, g, unknown or other
  misc_feature (228)..(228): n is a, c, g, or t
  modified_base (318)..(318): a, c, t, g, unknown or other
  misc_feature (318)..(318): n is a, c, g, or t
tcagtcgcactagtcacgaccggtgctcgatttagctacgactgcaggggggggtctcaggaggcagcgctctcaggacatctccaccatggcctgggctctgctgctcctccaccctcctcactcagggcacagggtcctgggcccagtctgccctgactcagcctgcctccgtgtcgtgggtctccgtggacagtccgctccaccatcctcctgcactcggaaccngcagtgtacgttggtagttacaatatcgtctccgtagtaaccaaccaaccgaccccggacaaaccggcccccgaagtcatagtatttagngacgtacactacgtccgcctgagggtctactagtcgtcttctcgtgctacgagtctcggacaacgaccggtccctccctacgacctagtccgtcgtcgggcctccgaggtcgtacggaacggtacgaggtcgtagttaatttaacgtacgtcgactacgtccttactaattactaagaacgtacgtaaagtttaacctttacgttcggtttacccggttacggggaccgggtaaaccggtacccgtaacggtcccgtaaccgggttaccccgtaaccggtacgggtaaccacccgggtacccgtaaccgggttccccgtacccccggtcccccggttaacggtcccgtaccccg

SEQ ID NO: 51675 - DNA, 712 bp, Homo sapiens
  misc_feature: GYAE6OF01D03Z1.39.11.A11.1.454.CMB.1.raw
  modified_base (169)..(169): a, c, t, g, unknown or other
  misc_feature (169)..(169): n is a, c, g, or t
  modified_base (181)..(181): a, c, t, g, unknown or other
  misc_feature (181)..(181): n is a, c, g, or t
  modified_base (192)..(192): a, c, t, g, unknown or other
  misc_feature (192)..(192): n is a, c, g, or t
  modified_base (197)..(197): a, c, t, g, unknown or other
  misc_feature (197)..(197): n is a, c, g, or t
  modified_base (216)..(216): a, c, t, g, unknown or other
  misc_feature (216)..(216): n is a, c, g, or t
  modified_base (234)..(234): a, c, t, g, unknown or other
  misc_feature (234)..(234): n is a, c, g, or t
  modified_base (306)..(306): a, c, t, g, unknown or other
  misc_feature (306)..(306): n is a, c, g, or t
  modified_base (360)..(360): a, c, t, g, unknown or other
  misc_feature (360)..(360): n is a, c, g, or t
tcagtcgcactagtcacgaccggtgctcgatttagctacgactgcgagggggggggtctcaggaggcagcgctctcaggacatctccaccatggcctgggctctgctgcctcctcaccctcctcacgtcgagggcacgagggtcctgggcccagtctcggcctgacacngcctgcctcgtntctgagcctcnggacngtcgatccactatcctccngaccacgtacggaacccnggactaggtaggtacggggtttggggttatgacttagtcgttccgtccgttacggtaaccagtactaatacnccgacggacctaaccgacccgtaccccaaacgtcctaagttacctatttaacgnggtaacgtacgtaaggtaccgtcccggtaccgttacggttaacggtttcaacgttcgtcttacgtcgtcggtaccctacggtacgtccggtacgaccgtaaccggcccgtaccgttcccgtacgtacccgttgttaccggtcggttcgggtccctacggacggtcgtacggtaacgggcgtaacggtctaaaggtttaccttagtacgtcgaacgtcgtacgttaacttagtcctacgtacgttgtacggtacgtcgttcgttacgttacggttacgtaacgggtacggtacggttaacgtacggtactacccggtttcgaacgttggaacccgtcggtaacccaaccccgg

SEQ ID NO: 51676 - DNA, 780 bp, Homo sapiens
  misc_feature: GYAE6OF01BPD96.39.11.A11.1.454.CMB.1.raw
  modified_base (754)..(754): a, c, t, g, unknown or other
  misc_feature (754)..(754): n is a, c, g, or t
  modified_base (774)..(774): a, c, t, g, unknown or other
  misc_feature (774)..(774): n is a, c, g, or t
  modified_base (776)..(776): a, c, t, g, unknown or other
  misc_feature (776)..(776): n is a, c, g, or t
  modified_base (778)..(778): a, c, t, g, unknown or other
  misc_feature (778)..(778): n is a, c, g, or t
tcagtcgcactagtcacgaccggtgctcgatttagctacgactgcagggcctctggaggcaccttcaatagttatgtcatcacttgggtgcgacaggcccctggacaagggcttgagtggggtgggagggatcatctctatgttggaacaccattgtttggacaacgaagttacgcacgaagtaacgttccgagggcaggagtcgacgtacgttaccggcggaacgtaatccgtaacgaggaccaacacgtccctaacaggtcggccgacttaggaaacggtaagtccgtaggtaagtacgtacggtaacggaacgggaacctaccggggttacccgtttacgtttaacgtttccgttaggtaccggacgggtaaggaaggggaccggtacggggttaaattccggtaaagtttaacggtaccgggacggggaccgggtacgtaaaccggttacgggtaccgggggaacctaacggggtaacccgtcggttacccgaccggttcctacccgtacgacccgttacccaacccggtaaaccgaccgggtcccgtaacgttccggttcccccgttcccgtacggtccctaccccgtaccctaacgaacgcctaaccgtaccgtacggggacggaccgtaccgacgggtcccggtccggtcgggtactccggaccggtacggtacgaaccggtaccttacttcccgagtacgtacgacgtacgcggacggcggcggaggaccgacgggtcaacgggtnaaaggcaggagtacggcagngntnag

SEQ ID NO: 51677 - DNA, 571 bp, Homo sapiens
  misc_feature: GYAE6OF01ESFAN.39.11.A11.1.454.CMB.1.raw
  modified_base (133)..(133): a, c, t, g, unknown or other
  misc_feature (133)..(133): n is a, c, g, or t
  modified_base (192)..(192): a, c, t, g, unknown or other
  misc_feature (192)..(192): n is a, c, g, or t
  modified_base (202)..(202): a, c, t, g, unknown or other
  misc_feature (202)..(202): n is a, c, g, or t
  modified_base (208)..(208): a, c, t, g, unknown or other
  misc_feature (208)..(208): n is a, c, g, or t
  modified_base (295)..(295): a, c, t, g, unknown or other
  misc_feature (295)..(295): n is a, c, g, or t
  modified_base (318)..(318): a, c, t, g, unknown or other
  misc_feature (318)..(318): n is a, c, g, or t
  modified_base (332)..(332): a, c, t, g, unknown or other
  misc_feature (332)..(332): n is a, c, g, or t
  modified_base (358)..(358): a, c, t, g, unknown or other
  misc_feature (358)..(358): n is a, c, g, or t
  modified_base (489)..(489): a, c, t, g, unknown or other
  misc_feature (489)..(489): n is a, c, g, or t
tcagtcgcactagtcacgaccggtgctcgatttagctacgactgcaggggggggtctcaggaggcagcgctctcaggacatctccaccatggcctgggctctgctgctcctcaccctcctcactcagggcacngggtcctgggcccagtctgccctgactcagcctgcctcgtgtctgggtcctcctggacngtcgctcacntctccngcacgtggaccagcagtcgacgttggagttacatatgtctctaggtaccaacaacacccgacaacgccccgaagtcatcgtatttangactcactacgcgcctgagggtntactatcgtcttcncgtcggctcgaagtctacggacaacnccggcctccgcgacctacttctcgtcggtctccgagtcgtaggacggacgtgtcgtagtatttactacgtcgctaagtcctataacttcgtacgaagtactaagttaacttcgttcgttccgtttacgggnggtaacggaccgtagtccgtacgtaccgttcgtacggtacgacgtacccgtacggtccacccgtcccgtcggtccttacccg

SEQ ID NO: 51678 - DNA, 514 bp, Homo sapiens
  misc_feature: GYAE6OF02IX52L.39.11.A11.1.454.CMB.1.raw
  modified_base (299)..(299): a, c, t, g, unknown or other
  misc_feature (299)..(299): n is a, c, g, or t
  modified_base (325)..(325): a, c, t, g, unknown or other
  misc_feature (325)..(325): n is a, c, g, or t
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
tcagtcgcactagtcacgaccggtgctcgatttagctacgactgcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccagcagtgacgttggtgttacaactatgtctcctggtaccaacaacaccccggcaaacgcccccgaagtcatgatttangacgtcactaatcggccctcagggtntctaatcgcttctctggctccaagtctggcaacncgcctcccngaccatctctggctcgaggctgaggacgaggctgattattactgcagctcatattacaagcaagtaatacttgttcctttggcgtagggacaagcgtgtaccgtcgtaggtcgagcccgaacggcctcgccccgttcggtctaccg

SEQ ID NO: 51679 - DNA, 488 bp, Homo sapiens
  misc_feature: GYAE6OF02I0LLK.39.11.A11.1.454.CMB.1.raw
  modified_base (443)..(443): a, c, t, g, unknown or other
  misc_feature (443)..(443): n is a, c, g, or t
tcagtcgcactagtcacgaccggtgctcgatttagctacgactgcagggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccagcagtgacgttggtggttacaactatgtctcctggtaccaacaacaccccggcaaagcccccgaagtcatgatttatgaggtcagtaatcggcctcagggttctaatcgcttctctgctcagtctgcaacacgcctcctgaccatctctggctcgagctgaggacgagctgattattacgtgacagtctacagttacacaagcagcagcactcttgtgtatcggnggaggacagctgaccgtctaggtcacgcccgaaggctcgtccccg

SEQ ID NO: 51680 - DNA, 562 bp, Homo sapiens
  misc_feature: GYAE6OF02IVI0S.39.11.A11.1.454.CMB.1.raw
  modified_base (329)..(329): a, c, t, g, unknown or other
  misc_feature (329)..(329): n is a, c, g, or t
tcagtcgcactagtcacgaccggtgctcgatttagctacgactgcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccagcagtgacgttggtggttacaactatgtctcctggtaccaacaaccaccccggcaaaacgccccccgaaagtccatgatttatgacgtcactaatcgcctcagggtntctaatcgcttctctgctccaagtctggcaacacggcctccctgaccatctcctgggctcaggctgaggacgaggcgtgaattattactgcacgctactattacttacaagcgtaagtaactacgttcgttccttttcgggacgggtacgggaccaaggtccgtaggtacccgtaccgtaggtccgtacggtacccgaacggtccgtaccggtcccccgtacggtcctacccg

SEQ ID NO: 51681 - DNA, 536 bp, Homo sapiens
  misc_feature: GYAE6OF02HN5PX.39.11.A11.1.454.CMB.1.raw
  modified_base (299)..(299): a, c, t, g, unknown or other
  misc_feature (299)..(299): n is a, c, g, or t
  modified_base (324)..(324): a, c, t, g, unknown or other
  misc_feature (324)..(324): n is a, c, g, or t
tcagtcgcactagtcacgaccggtgctcgatttagctacgactgcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccagcagtgacgttggtggttacaactatgtctcctggtaccaacaacaccccggcaaacgccccgaagtcatgatttangacgtcactaatcggcctcagggtntctaatcgcttctctggctccaagtctggcacacgcctcctgaccatctcgtcggctccgaggctgaggacgaggctgtattattactgacagctcatattacaagacaagtaattacttcgttccgttttcgggacggtagggaccaagtccgtcggtacccgttccgtaggtaccagacccacggcctccggtccccgtcggtcctaccg

SEQ ID NO: 51682 - DNA, 509 bp, Homo sapiens
  misc_feature: GYAE6OF02HCGOZ.39.11.A11.1.454.CMB.1.raw
  modified_base (326)..(326): a, c, t, g, unknown or other
  misc_feature (326)..(326): n is a, c, g, or t
  modified_base (360)..(360): a, c, t, g, unknown or other
  misc_feature (360)..(360): n is a, c, g, or t
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
tcagtcgcactagtcacgaccggtgctcgatttagctacgactgcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccagcagtgacgttggtgttacaactatgtctcctggtaccaacaacaccccggcaaacgcccccgaagtcatgatttatgacgtcactaatcggccctcaggggtntctaatcgcttctctggctccaagtctggcaacncgcctccngaccntctctgggctcgaggctgaggacgaggctgattattactgcagctcatattcaagcagtaatctgttcctttcggcggaggaccagcgtcgaccgtcgtacgtcacgcccaggcctcgcccccttcggtctacccg

SEQ ID NO: 51683 - DNA, 512 bp, Homo sapiens
  misc_feature: GYAE6OF02HCRZJ.39.11.A11.1.454.CMB.1.raw
  modified_base (325)..(325): a, c, t, g, unknown or other
  misc_feature (325)..(325): n is a, c, g, or t
  modified_base (369)..(369): a, c, t, g, unknown or other
  misc_feature (369)..(369): n is a, c, g, or t
  modified_base (508)..(508): a, c, t, g, unknown or other
  misc_feature (508)..(508): n is a, c, g, or t
tcagtcgcactagtcacgaccggtgctcgatttagctacgactgcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccagcagtgacgttggtggttacaactatgtctcctggtaccaacaacaccccggcaaagcccccgaagtcatgatttatgacgtcactaatcggccctcgagggtntctaatcgcttctctggctccaagtctggcaacacggcctcccngaccatctcgtgggctccgaggctgaggacgaggctgattatactgcagctcatttgctaatcagtgacggtcttatgtcttcgggagtcgggaaccaaggtccatccggtcctaggtcacggaccaaggcccaacccntacg

SEQ ID NO: 51684 - DNA, 520 bp, Homo sapiens
  misc_feature: GYAE6OF02GUP7H.39.11.A11.1.454.CMB.1.raw
  modified_base (236)..(236): a, c, t, g, unknown or other
  misc_feature (236)..(236): n is a, c, g, or t
  modified_base (387)..(387): a, c, t, g, unknown or other
  misc_feature (387)..(387): n is a, c, g, or t
tcagtcgcactagtcacgaccggtgctcgatttagctacgactgcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccagcagtgacgttggngttacaactatgtctctggtaccagcaatatcaggcacagcccccaaactcatcatttatgagtcagtaatcggcctcaggggtttctaatcgtcttctctggtctcaagtctggcaacacggcctcctcgacctatctcgtcggctccgnggctggaggacgaggctgattatactgcagtctctatttgactaatcagtgagtcttagtcgtacgttcggaaggttcgggaaccaaggttcgagttccggttacctacggtcacggtacccaacggtacccc

SEQ ID NO: 51685 - DNA, 578 bp, Homo sapiens
  misc_feature: GYAE6OF02I2P22.39.11.A11.1.454.CMB.1.raw
  modified_base (324)..(324): a, c, t, g, unknown or other
  misc_feature (324)..(324): n is a, c, g, or t
  modified_base (357)..(357): a, c, t, g, unknown or other
  misc_feature (357)..(357): n is a, c, g, or t
tcagtcgcactagtcacgaccggtgctcgatttagctacgactgcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccagcagtgacgttggtgttacaactatgtctcctggtaccaacaacaccccggcaaacgcccccgaagtcatgatttatgacgtcactaatcgcctcaggggtntctaatcgcttctctggctccagtctggcaacncggcctcctgaccatctctggctccgaggctgaggacgaggctgtattattactgcagctcattattacgaagctaagtaacttacttcgttcccgtttttcgggacgggtacgggtacccgtaaggccgttacggtacccggttacccgttaacgggttccgaaccggtaccccgtaacgggtcccgtcccggtccccccgttccggttaccctaccccg

SEQ ID NO: 51686 - DNA, 542 bp, Homo sapiens
  misc_feature: GYAE6OF02GEXFP.39.11.A11.1.454.CMB.1.raw
  modified_base (329)..(329): a, c, t, g, unknown or other
  misc_feature (329)..(329): n is a, c, g, or t
  modified_base (361)..(361): a, c, t, g, unknown or other
  misc_feature (361)..(361): n is a, c, g, or t
  modified_base (397)..(397): a, c, t, g, unknown or other
  misc_feature (397)..(397): n is a, c, g, or t
  modified_base (400)..(400): a, c, t, g, unknown or other
  misc_feature (400)..(400): n is a, c, g, or t
  modified_base (410)..(410): a, c, t, g, unknown or other
  misc_feature (410)..(410): n is a, c, g, or t
  modified_base (413)..(413): a, c, t, g, unknown or other
  misc_feature (413)..(413): n is a, c, g, or t
tcagtcgcactagtcacgaccggtgctcgatttagctacgactgcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatcctcctgcactggaaccagcagtgacgttggtgttacaactatgtctcctggtaccaacaacaccccggcaaacgcccccgaagtccatgatttatgacgtcactaatccggccctcgagggtntctaatcgcttctctgctcaagtctggcaacncgcctccctgaccatctctggctcgagctgagacgngcngtattatacngcngctcatattacaagtctaagtaacttacgttcgttcccgttttcggacgggtacggaccaaggtccgtacggacccgttcgtacggtcacgacccgaaggtcctcccggcccccgttcggtcctacccg

SEQ ID NO: 51687 - DNA, 502 bp, Homo sapiens
  misc_feature: GYAE6OF02FKUKJ.39.11.A11.1.454.CMB.1.raw
  modified_base (325)..(325): a, c, t, g, unknown or other
  misc_feature (325)..(325): n is a, c, g, or t
tcagtcgcactagtcacgaccggtgctcgatttagctacgactgcagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccagcagtgacgttggtggttacaactatgtctcctggtaccaacaacaccccggcaaagccccccgaagtcatgatttatgacgtcactaatcggccctcaggggtntctaatcgcttctctggctccaagtctggcaacacggcctccctgaccatctctgggctccaggctgaggacgaggctgattattactgcagctcatattcaagcagtaatactgtcctttcggcgaggaccaagctgaccgtctaggtcagcccaggcctcgcccctggtctaccg

SEQ ID NO: 51688 - DNA, 518 bp, Homo sapiens
  misc_feature: GYAE6OF02HHQ7N.39.11.A11.1.454.CMB.1.raw
  modified_base (372)..(372): a, c, t, g, unknown or other
  misc_feature (372)..(372): n is a, c, g, or t
  modified_base (416)..(416): a, c, t, g, unknown or other
  misc_feature (416)..(416): n is a, c, g, or t
tcagtcgcactagtcacgaccggtgctcgatttagctacgactgcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgcttataattatgtctcctggttccaacagcattcaggcagcgccccgaaactcttaatttatgtaggtctttcgtcgtccctcgtaggggtttctagtcgcttctccggctccgagtctggcaacacggcctccngaccatctctagactccgaggctgaggacgaggctgacttattntgcagctcatatactgtaagtcaagtgtatccactggtctggtcggcgggtaggacctaagtcgaccgttcgtacgtcacggacccaggtcctacgtccccg

SEQ ID NO: 51689 - DNA, 548 bp, Homo sapiens
  misc_feature: GYAE6OF02F11I4.39.11.A11.1.454.CMB.1.raw
  modified_base (328)..(328): a, c, t, g, unknown or other
  misc_feature (328)..(328): n is a, c, g, or t
tcagtcgcactagtcacgaccggtgctcgatttagctacgactgcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccagcagtgacgttggtggttacaactatgtctcctggtaccaacaaccaccccggcaaacgcccccgaagtccatgatttatgacgtcactaatcggccctgagggtntctaatcgcttctctcggctccaagtctggcaacacggccctccctgaccatctctgggcctccgaggctggaggacggaggctgatttagtacttgcagtctctatttgactaatcagtgaagtcttatcgttcgttaggagtcgggaacgtaacggtactacggtccgttcgttcgggtacctacggacccgtaaggacccctaccccgacttaccgg

SEQ ID NO: 51690 - DNA, 579 bp, Homo sapiens
  misc_feature: GYAE6OF02IA6TU.39.11.A11.1.454.CMB.1.raw
  modified_base (236)..(236): a, c, t, g, unknown or other
  misc_feature (236)..(236): n is a, c, g, or t
  modified_base (391)..(391): a, c, t, g, unknown or other
  misc_feature (391)..(391): n is a, c, g, or t
  modified_base (419)..(419): a, c, t, g, unknown or other
  misc_feature (419)..(419): n is a, c, g, or t
tcagtcgcactagtcacgaccggtgctcgatttagctacgactgcaggggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgctcaccatctcctgcactggaaccagcagtgacgttggngttacaactatgtctcctggtaccaacaaccaccccggcaaacgcccccgaaagtcatgtatttatgacgtcactaatcggccctcgaggggtgtctaatcgtcttactctggctccaagtctgcacacgcctcctgaccatctctcggctccgnggctgagacgaggctgattattactgcncgctaccatacttacagtactagtaatacgttcgttccgttttcggacgggacgggtacctaaacggtcgtacggtacccggttccgtaacgggttacccacggtaccccgtaaacgggtccgttacccgggtcccccccttccgggtacctaaccccgg

SEQ ID NO: 51691 - DNA, 709 bp, Homo sapiens
  misc_feature: GYAE6OF02GIR5S.39.11.A11.1.454.CMB.1.raw
tcagtcgcactagtcacgaccggtgctcgatttagctacgactgcagggggggggtctcaggaggcagcgctctcaggacatctccaccatggcctgggctctgctgctcctcaccctcctcactcagggcacagggtcctgggcccagtctgccctgactcaggctgcctccgtgtcgtggtctcgtaggacagtcgatccaccatcctctcgcacgtaggaaccagcagtgtacgggttggggttatgactatgtctccgtcggtaccagactaatactccgacggcaccacgaaccccccaaactctaatcctaatttataggtacggtacaagttaaacgtcccggtaccctacggtacggggttttactaaacgtccggtcctttcgtccgtggtaccctaccgtaaggttccgtcggaccctaaaccggacccggtccccttcccgttacgaacccttacttcccgttacggtccgggtccttacccggaggtccggtagggaaccgggaccggtacgggtccgtagttaacgtttacttaccgtgaccgacgttcctacgttagtttcgaacctaagtccgtaaggtcggtacgttactttagtcgttacggttacgggtaagggttaccggaaaccggtaacggtactaccgttaccggttaccgtacggtaccacggtaccccgtaacggtaaccccccg

SEQ ID NO: 51692 - DNA, 567 bp, Homo sapiens
  misc_feature: GYAE6OF02G06CJ.39.11.A11.1.454.CMB.1.raw
tcagtcgcactagtcacgaccggtgctcgatttagctacgactgcagggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatgtctcctggtaccagcaatatccaggcacacgcccccaaactcatctatttatgagtcagtatcggccctgtagggtttctaagtcgtactttctcgtcggtctacctaagttctggaccaaccgaccggtccctccctagaaccctatccgttcgtcgggcctccgaggctggacggacgaggtctagtattattactcgacagtctactatttcgactatcgagtcgagtcttatgttcgttagggtaacggttcgggaaccctaagggtctaagttccggttacgtaggttacgacggtacccgaacggaccccc

SEQ ID NO: 51693 - DNA, 517 bp, Homo sapiens
  misc_feature: GYAE6OF02GJTAP.39.11.A11.1.454.CMB.1.raw
tcagtcgcactagtcacgaccggtgctcgatttagctacgactgcagggggggggtctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgagtctttcgtcggcctcgaggggtttctagtcgcttctccggctccaagtctggcaacgacggcctccctgaccactctctagactccgaggctgaggacgaggctgactattattgcagctcatatactgaagtcaagttcgtatccactggcttggtcggcggagggacctaaggttcgacccgttcgtacggtcacggacccgaggcctcccgg

SEQ ID NO: 51694 - DNA, 652 bp, Homo sapiens
  misc_feature: GYAE6OF02JQVLX.39.11.A11.1.454.CMB.1.raw
  modified_base (208)..(208): a, c, t, g, unknown or other
  misc_feature (208)..(208): n is a, c, g, or t
  modified_base (226)..(226): a, c, t, g, unknown or other
  misc_feature (226)..(226): n is a, c, g, or t
  modified_base (248)..(248): a, c, t, g, unknown or other
  misc_feature (248)..(248): n is a, c, g, or t
tcagtcgcactagtcacgaccggtgctcgatttagctacgactgcagggggggtcgtcgaggaggcgagcgctctcaggacatctccaccatggcctgggctctgctgctcctcacctcctcactcagggcacagggtcctgggcccagtctgccctgactcagcctgcctcgtcgtctgggtcctcctaggacctagtcgctcaccntctctgcaactggaaccngcagtgactggtgtacactatntctctggtacacaacaccgcaacgccccaagtcatgatttatcgagtcgactatacggcctcgagggtcgtacgtaactcggacttctcgtacggtctcctaacgtcttaggcctaaccgacgggtaccctcccgttacgacctaacgttcttaccgtcgggtccttcccgtaacgggtcttcgggaacggaccgagggtacccgtaggtaacggtttaacttttaacgttcggaccgttaacgtccgtaaccgttagtacctttacgaacgaccgtaggttaaactaccttgtaccctttttgggacggaccggtacttaacggcgttacggacctttaccggtacgggtaccttaacggccaacgggtccttaccggcccccgttacgggtcccttaaccgg

SEQ ID NO: 51695 - DNA, 581 bp, Homo sapiens
  misc_feature: GYAE6OF02HCYE4.39.11.A11.1.454.CMB.1.raw
  modified_base (571)..(572): a, c, t, g, unknown or other
  misc_feature (571)..(572): n is a, c, g, or t
  modified_base (575)..(581): a, c, t, g, unknown or other
  misc_feature (575)..(581): n is a, c, g, or t
tcagtcgcactagtcacgaccggtgctcgatttagctacgactgcagggcctctggaggcaccttcaatagttatgtcatcacttgggtgcgacaggcccctggacaagggcttgagtgggtgggagggatcatctctatgtttggaacacccatgtttggtacaccaagttacgcacagaagttccagggcagagtcacgattaccgcggacgaatctacgagcacagcctacatggcgctgagaagtctgagatctgaggacacggccgtctatttctgtgcgagaggacgcgggtatcacttaagtagcgcgggcgactactggggccagggaaccctggtcaccggtctcctcacgcctccaccaagggcccatcggtccttcccccgtggccaccctccctccaagacgccacctcgtcgggggccaccgacggccggcccgtcggggcctcggcccgttcgggtccgaaacgggaccttaacccgtttcccgaaccttacggtcggaccgtacgttcggaacgggccggggcgtcgggaccgaacgggccggaccgagtaggacnncgnnnnnnn

SEQ ID NO: 51696 - DNA, 702 bp, Homo sapiens
  misc_feature: GYAE6OF02GSRC3.39.11.A11.1.454.CMB.1.raw
  modified_base (217)..(217): a, c, t, g, unknown or other
  misc_feature (217)..(217): n is a, c, g, or t
  modified_base (230)..(230): a, c, t, g, unknown or other
  misc_feature (230)..(230): n is a, c, g, or t
  modified_base (321)..(321): a, c, t, g, unknown or other
  misc_feature (321)..(321): n is a, c, g, or t
tcagtcgcactagtcacgaccggtgctcgatttagctacgactgcagggggggggtctcaggaggcagcgctctcaggacatctccaccatggcctgggctctgctgcctcctcaccctcctcactcgagggcacgagggtcctgggcccagtctcgccctgactcacgcctgcctcgtgtcgtgggtctccgtggacagtcgctcaccatcctccngcactcggaaccngcagtcgtacggttggtgttaacaacttatgtctcgtggtaaccaaccaaccgaccccggacaaaccgcccccgaagtcaatgtatttagngtacgtcaactaacgtccggtccctggaggggttcgtactaactcgtctttacgtcgtcggctaccgaagtcgtcggacaaccgccgccctcctacgaccatcctcgtcgggcctcgaggtcgtaggacggacggacggtctacgtaatttacgttacgtgaccgacgtacctctaactttacgttacgaaacgtacgtaaacggttaactttaccgtttacgtttcccggttttaacgggaccgggtaacgggtaacccgtaacggttccgtaccgggtaacccggttaccggtaaccgggttacccgtaaccggaacccccggtaacgggtcccgttacccccgggtacccccggttacccgggtaccctttaccccgg

SEQ ID NO: 51697 - DNA, 582 bp, Homo sapiens
  misc_feature: GYAE6OF02FU3XE.39.11.A11.1.454.CMB.1.raw
tcagtcgcactagtcacgaccggtgctcgatttagctacgactgcagggggggggtctcaggagggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatcctcctgcactggaaccagcagtgacgttggtcgttaacaactatgtctcctggtaaccaactaacaccccggcaaaacgccccccgaaagtccaatcgaatttatgacgtcacttaaatccggaccctacgacggggtctcgtaatcgactttctctggctaccaagtctggacaacgcggcctaccctgacccatcctcgtcgggcctccgaggtctggacggacgaggcgtgaacgttatacgtgactagtctcattacttcaagtctagtaactactgttcctttacgggacgtacggtaccaagtcgtacggacccgttaccgtaggtaccaacggcccgaaggtccgtcgtaccccctggtacctacccg

SEQ ID NO: 51698 - DNA, 577 bp, Homo sapiens
  misc_feature: GYAE6OF02IXDLT.39.11.A11.1.454.CMB.1.raw
  modified_base (240)..(240): a, c, t, g, unknown or other
  misc_feature (240)..(240): n is a, c, g, or t
  modified_base (328)..(328): a, c, t, g, unknown or other
  misc_feature (328)..(328): n is a, c, g, or t
  modified_base (359)..(359): a, c, t, g, unknown or other
  misc_feature (359)..(359): n is a, c, g, or t
  modified_base (566)..(566): a, c, t, g, unknown or other
  misc_feature (566)..(566): n is a, c, g, or t
  modified_base (571)..(577): a, c, t, g, unknown or other
  misc_feature (571)..(577): n is a, c, g, or t
tcagtcgcactagtcacgaccggtgctcgatttagctacgactgcagggcctctggaggcaccttcaatagttatgtcatcacttgggtgcgacaggcccctggacaagggcttgagtgggtgggagggatcatctctatgtttggaacacccatgtttggtacaccaagttacgcacagaagttccagggcagagtcacgattaccgcggacgaatctacgagcacagcctacatggcnctggagaagtctgagatctgaggacacggccgtctattctgtgcgagaggacggcgggtatcgacttaagtagcgcgggcgactacgnggggccagggaccctggtccaccgtctcccncacgccctccaccgaacgggcccacgtccggtccttcccccgtggccacccctcctcccaaacgcgccaccgtccgtcgggggccaccgacggccggcccgtcggggccttcgcccgttcgggtccgaacggtacccttaacctttcccacgttacgtcgccgacgttcggacggcgggtcgtcggcgaacgggccgacagtaggcnacgtnnnnnnn

SEQ ID NO: 51699 - DNA, 551 bp, Homo sapiens
  misc_feature: GYAE6OF02FJYWG.39.11.A11.1.454.CMB.1.raw
  modified_base (222)..(222): a, c, t, g, unknown or other
  misc_feature (222)..(222): n is a, c, g, or t
  modified_base (378)..(378): a, c, t, g, unknown or other
  misc_feature (378)..(378): n is a, c, g, or t
  modified_base (435)..(435): a, c, t, g, unknown or other
  misc_feature (435)..(435): n is a, c, g, or t
tcagtcgcactagtcacgaccggtgctcgatttagctacgactgcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccngcagtgacgttggtgttacaactatgtctcctggtaccaacaacaccccggcaaacgccccccgaagtccatgatttatgacgtcactaatcggccctcaggggtgtctaatcgcttctctggctccaagtctggcaacgacgtcctccctgaccntcctctgggcctccgaggtctgaggacgaggctggattattctgcagctcatacttnaagctaagtaattacgtcgttccgttttcgggcggtacgggaccaagtcctacggaccgttaccctaggttccacggtacccgtaacgggctccggtcccccttcggtcctacccg

SEQ ID NO: 51700 - DNA, 948 bp, Homo sapiens
  misc_feature: GYAE6OF02JXD3H.39.11.A11.1.454.CMB.1.raw
tcagtcgcactagtcacgaccggtgctcgatttagctacgactgcagggggggtcgtcgaggaggcgagcgctctcaggacatctccaccatggcctgggctctgctgctcctcaccctcctcacgtccaggcacagggtcctggccagtctgccctgacctcagcctggcctccgtgcttgggctcctagggactacggtcgcctcaccatctcctgactacgtggaacccagtcaagtgacggtttgcgtttaacgactatactctcctggtacctaacgaaccaccccggactaaccgacccccgaagttcccgaactacggtactttaacgttacggtaaccgttacgtaccgttaaaacgtccgggtacccctaccggtaacggggttacgggtttacccgtaaacgttaaccgggtccctttaaccgtttccgttaaccggtcgttacccgttaaaccggttaccgtttccggggacttaaacccggtaaccggggtaccccttcccccggttaccgtaaccccggtaacttacccgttacccggttacccggggttcccgttaccccggttaaccgggtcccgtttaccggggtaaccggggtaaccggggaaccggttacccggtaaccgggttaacggttttaaaccttaaccggtttacggtaacccgttagggcccgttaacgttacgttttacgggaaccttacgttaaccgtaacgggtttacgaaaccggggtttcccttttaagggttacgtttaaacccgggtttcgggtaaaccgggtttaacggggttaacccccggtaaacggggtttaacccggtaccggtttaacccgggttaaacccgggtttcccgggttaaaccgttaccggggaacccccggtttaacccggaaccccggttaaccccccgggtaaaccctttaacccccggg

SEQ ID NO: 51701 - DNA, 558 bp, Homo sapiens
  misc_feature: GYAE6OF02H1RTD.39.11.A11.1.454.CMB.1.raw
  modified_base (327)..(327): a, c, t, g, unknown or other
  misc_feature (327)..(327): n is a, c, g, or t
  modified_base (416)..(416): a, c, t, g, unknown or other
  misc_feature (416)..(416): n is a, c, g, or t
tcagtcgcactagtcacgaccggtgctcgatttagctacgactgcagggggggggtctcaggaggcagcgctctcaggacatctccaccatggcctgggctctgctgctcctcaccctctcactcagggcacagggtcctgggcccagtctgccctgactcagcctgcctccgtgtctgggtctcctggacagtcgctcaccatctcctgcactggaaccagcagtgacgttggtgttacaactatgtctcctggtaccaacaacaccccggacaaacgccccgaagtcatgatttatgacgtacactaactcggtcctcgagggtntctaatcgcttctctgctcaagtctggcaacgacgcctcctgacctatctcgtcgggctcgaggctggaggacgagctgtattactacngacagtctactattcgactaatcgtagtgtaacgtctttagtcggttacgttacgggaggttcgggaacctaagggttacctaagttcccggtacgttacggtaccacggtaaccccgtaagggaccccaaccccgtgtacg

SEQ ID NO: 51702 - DNA, 657 bp, Homo sapiens
  misc_feature: GYAE6OF02FPJUC.39.11.A11.1.454.CMB.1.raw
  modified_base (193)..(193): a, c, t, g, unknown or other
  misc_feature (193)..(193): n is a, c, g, or t
  modified_base (203)..(203): a, c, t, g, unknown or other
  misc_feature (203)..(203): n is a, c, g, or t
  modified_base (221)..(221): a, c, t, g, unknown or other
  misc_feature (221)..(221): n is a, c, g, or t
  modified_base (273)..(273): a, c, t, g, unknown or other
  misc_feature (273)..(273): n is a, c, g, or t
  modified_base (298)..(298): a, c, t, g, unknown or other
  misc_feature (298)..(298): n is a, c, g, or t
  modified_base (305)..(305): a, c, t, g, unknown or other
  misc_feature (305)..(305): n is a, c, g, or t
  modified_base (324)..(324): a, c, t, g, unknown or other
  misc_feature (324)..(324): n is a, c, g, or t
  modified_base (339)..(339): a, c, t, g, unknown or other
  misc_feature (339)..(339): n is a, c, g, or t
  modified_base (362)..(362): a, c, t, g, unknown or other
  misc_feature (362)..(362): n is a, c, g, or t
tcagtcgcactagtcacgaccggtgctcgatttagctacgactgcagggggggggtctcaggaggcagcgctctcaggacatctccaccatggcctgggctctgctgctcctcaccctcctcactcagggcacagggtcctgggcccagtctgccctgactcagcctgcctcgtgtctgggtctccgtggacngtcgctcacntctcctgcactggaaccngcagtgacgttggtagttacaactatgtctctggtaccaacacaccccgganaaacgcccccgaagtcatgatttangaccgtnactaatcggcctgagggtntctaatcgcttctcncggctaccaagtctggtacaacnccggccttcccgtagaccctatccttacgtcgggtcctccgaggtcctgggaacggaccggaggtcctagtaacgtttaacttacgttcggtacgacgtcctactacttaaccgttacgaaacgtaccgtaagttaaaccgttcgttaccggtttacctttttccgggggaacggtaaccggggtaaccctaacggtaccgttccggtaacccggttacccggttaacggtccgtaaccggtacccggaaacggttcccgtacccgtcccccgttaccggggtacccttacccgg

SEQ ID NO: 51703 - DNA, 770 bp, Homo sapiens
  misc_feature: GYAE6OF02GO6Z1.39.11.A11.1.454.CMB.1.raw
  modified_base (193)..(193): a, c, t, g, unknown or other
  misc_feature (193)..(193): n is a, c, g, or t
  modified_base (322)..(322): a, c, t, g, unknown or other
  misc_feature (322)..(322): n is a, c, g, or t
tcagtcgcactagtcacgaccggtgctcgatttagctacgactgcagggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacngtcgctcaccatctcctgcactggaaccagcagtgacgttggtgttacaatatgtctcctggtaccaacaacacccgacaacgcccccgaagtcatgtattatcgacgtcactaatccgcctgagggtntactatcgtcttctcgtcgtctaccgtaagttctacggacaaccgtaccgtccctcccgtagaaccctattccctaccgttcgggtccttacccggacgggtaccgtacgggaacggtaaccgggtaaggtcccgttaggtaacttttaacgtttaaccgttacggtaccgtaacggtccctttaacgtaaacgtttaaccgttaaccgtaaacggtaaccgttaaacggtttaaactttaacccgttttccgggttttaccccggtttttaccgggggaaccggggttaaccgggtaaccccgtaaagggttccccggtttaaccgggtaaccccggtttaccccggttaagggtacccccgtaaaccgggtaaccccccggtaacgggttacccccgtttaccccgggtaccccccccggtttaccgggtacccttaacccccggg

SEQ ID NO: 51704 - DNA, 734 bp, Homo sapiens
  misc_feature: GYAE6OF02IRDC5.39.11.A11.1.454.CMB.1.raw
  modified_base (197)..(197): a, c, t, g, unknown or other
  misc_feature (197)..(197): n is a, c, g, or t
  modified_base (241)..(241): a, c, t, g, unknown or other
  misc_feature (241)..(241): n is a, c, g, or t
  modified_base (251)..(251): a, c, t, g, unknown or other
  misc_feature (251)..(251): n is a, c, g, or t
tcagtcgcactagtcacgaccggtgctcgatttagctacgactgcagggggggggtctcaggaggcagcgctctcaggacatctccaccatggcctgggctctgctgctcctcaccctctcactcagggcacaggtcctgggcccagtctcgccctgactcacgcctggcctccgtgtcctgggtcctccgtggacngtcgctcaccatctcctgacactggaaccagcagtgacgttggngttacaactntcgtctctgtaccaacaccacccggtacaaaccgccccgtaagtcatacgtaatttatcgtaacgtcaacgtaactcccgggtaccctcgtaaggggttctactaacgtccgtcttcgtacgtcgggtaccttaccgaaatccggtacggtaccgaaccgtaaccgggtccccttacccgttacggaaccctacgttccgtacgtcgggtaaccctcccggtaaaggtccgtacggaaggggtaaccgacggtccgttaattacggtttaaactttaccgtacgaccgtactaccggttaactaagtttacgttacaaaacgggtctaaacggtttaacttcgtttaaccgggttcgttttacggggaacccgggagggtaacccaacggtccgttaaccgggtaaccccgttcggttaaaccgttaccgaacggtaccaccgggtaccctttcccggaccccctttcggtaccccttaaccg

SEQ ID NO: 51705 - DNA, 559 bp, Homo sapiens
  misc_feature: GYAE6OF02F5UU9.39.11.A11.1.454.CMB.1.raw
  modified_base (303)..(303): a, c, t, g, unknown or other
  misc_feature (303)..(303): n is a, c, g, or t
  modified_base (323)..(323): a, c, t, g, unknown or other
  misc_feature (323)..(323): n is a, c, g, or t
  modified_base (329)..(329): a, c, t, g, unknown or other
  misc_feature (329)..(329): n is a, c, g, or t
  modified_base (360)..(360): a, c, t, g, unknown or other
  misc_feature (360)..(360): n is a, c, g, or t
  modified_base (370)..(370): a, c, t, g, unknown or other
  misc_feature (370)..(370): n is a, c, g, or t
  modified_base (391)..(391): a, c, t, g, unknown or other
  misc_feature (391)..(391): n is a, c, g, or t
  modified_base (421)..(421): a, c, t, g, unknown or other
  misc_feature (421)..(421): n is a, c, g, or t
tcagtcgcactagtcacgaccggtgctcgatttagctacgactgcagggggggggtctcaggaggcagcgctctcaggacatctccaccatggacctgggctctgctgctcctcaccctcctcactcagggcacagggtcctgggcccagtctgccctgactcagcctgcctccgtgtctgggtctcctggacagtcgctcaccatctcctgccactggaaccagcagtgacggttggtggttacaactatgtctcctggtaccaacaaccaccccggcaaacgcccccgaatcatgatttangacgtcactaatcggccctnagggtntctatcgtctctctgctcaagtctggcaacncgccctccgngacccatctcgtcggcctccnggtctggaggacgaggctgtatttactacngccagctcaattatacaagctaagtaacttacgttcgttcccgttttcggaccggttacggaacctagctacggtaccgttacccgtagtaccacggccgtaacggcccttacccggcccccgttcggtccctacccg

SEQ ID NO: 51706 - DNA, 623 bp, Homo sapiens
  misc_feature: GYAE6OF02JCSC3.39.11.A11.1.454.CMB.1.raw
  modified_base (144)..(144): a, c, t, g, unknown or other
  misc_feature (144)..(144): n is a, c, g, or t
  modified_base (241)..(241): a, c, t, g, unknown or other
  misc_feature (241)..(241): n is a, c, g, or t
  modified_base (424)..(424): a, c, t, g, unknown or other
  misc_feature (424)..(424): n is a, c, g, or t
  modified_base (430)..(430): a, c, t, g, unknown or other
  misc_feature (430)..(430): n is a, c, g, or t
  modified_base (438)..(438): a, c, t, g, unknown or other
  misc_feature (438)..(438): n is a, c, g, or t
  modified_base (471)..(471): a, c, t, g, unknown or other
  misc_feature (471)..(471): n is a, c, g, or t
  modified_base (474)..(474): a, c, t, g, unknown or other
  misc_feature (474)..(474): n is a, c, g, or t
  modified_base (486)..(486): a, c, t, g, unknown or other
  misc_feature (486)..(486): n is a, c, g, or t
  modified_base (494)..(494): a, c, t, g, unknown or other
  misc_feature (494)..(494): n is a, c, g, or t
tcagtcgcactagtcacgaccggtgctcgatttagctacgactgcagggggggggtctcaggaggcagcgctctcaggacatctccaccatggcctgggctctgctgctcctcaccctcctcactcgagggcacgacgggtccngggcccagtctcgccctgactcacgcctcgcctccgtgtcgtcggtcctccgtggacacggtccgcctacacctatcctcctgcctacgacgaaccngcagtgacgttgtgtaacactagtcgtctcgtacgtaaccaaccgaaccgtacccggacaaaccgccccgagtacactagtactttagcgtacgtacaactacgccgcctaggacgggttactactactcgtcttaccgtcgtcgactactacgtgacgaccacgtaccgtcctcctacgacncttccncgtcgccncgacgcgtaggacgcgcgtatacttaatagtcnacntacactgtaccntaaacgtntaacgttacttccgtaccggttccgtaggggaccggtaacgtactcggtaccggtacccgtaccggtacggtaccgaccgtacggacccggtaacgtccgtacccccggtaccgtccggtcccttaccg

SEQ ID NO: 51707 - DNA, 518 bp, Homo sapiens
  misc_feature: GYAE6OF02H5DK6.39.11.A11.1.454.CMB.1.raw
  modified_base (309)..(309): a, c, t, g, unknown or other
  misc_feature (309)..(309): n is a, c, g, or t
  modified_base (508)..(509): a, c, t, g, unknown or other
  misc_feature (508)..(509): n is a, c, g, or t
  modified_base (511)..(518): a, c, t, g, unknown or other
  misc_feature (511)..(518): n is a, c, g, or t
tcagtcgcactagtcacgaccggtgctcgatttagctacgactgcagggcctctggaggcaccttcaatagttatgtcatcacttgggtgcgacaggcccctggacaagggcttgagtgggtgggagggatcatctctatgtttggaacacccatgtttggtacaccaagttacgcacagaagttccagggcagagtcacgattaccgcggacgaatctacgagcacagcctacatggcgctgagaagtctgagatctgaggacacggccgtctatttctgtgcgagaggacgcgggtatcacttaagngcgcgggcgactacgtggggccaggggaaccctggtcaccgtctcctcagcctccacaggcccatcggtctcccctgccaccctcctccagacgcacctcgtcggggcacgagccggcccgtgggctcgcctcggcaaggccttaccttcccacttaggtcgaccgactggacgcggggctgggcgaggccgcgatagnngnnnnnnnn

SEQ ID NO: 51708 - DNA, 713 bp, Homo sapiens
  misc_feature: GYAE6OF02H1D3G.39.11.A11.1.454.CMB.1.raw
  modified_base (306)..(306): a, c, t, g, unknown or other
  misc_feature (306)..(306): n is a, c, g, or t
  modified_base (476)..(476): a, c, t, g, unknown or other
  misc_feature (476)..(476): n is a, c, g, or t
tcagtcgcactagtcacgaccggtgctcgatttagctacgactgcagggggggggtctcaggaggcagcgctctcaggacatctccaccatggcctgggctctgctgctcctcaccctcctcactcagggcacgagggtcctgggcccagtctcgccctgactcagcctgcctccgtgtcgtgggtctctggacagtcgctcaccatctctgcacgtggaaccagcagtgacgttggtagttacactatgtctcgtagtaaccaacaccgacccggacaaaccgccccgtaatcatagtatttagngacgtcaactatccggcctaggtgggtactactactcgtctttccgtactcgcctacgaacgtcgtacgactaccgaccgtccctaccgtacgacctagttccgtcgtcggccttaccgaggtcgtagggaacgggacggacgtcgttagtaacgtttacgttaaccggngtaccgtaacgtacctttaccgtaaagtttaaccgtaccgtaaaggtacctttaaaaggttaaaccgttttccgttttaacccggggtttacggtttttaacccgggggaacgggtaaccgggtaaccgtaaccgttccgttaaccccgggtaaccgtttacccgtaacgggtacccacccggtacccgtaaccgggtcccgttacccccggtcccgttacgggttacctaccccgg

SEQ ID NO: 51709 - DNA, 764 bp, Homo sapiens
  misc_feature: GYAE6OF02JSI66.39.11.A11.1.454.CMB.1.raw
  modified_base (550)..(550): a, c, t, g, unknown or other
  misc_feature (550)..(550): n is a, c, g, or t
tcagtcgcactagtcacgaccggtgctcgatttagctacgactgcaggggggggtcgtcgaggaggcagcgctctcaggacatctccaccatggcctgggctctgctgctcctcaccctcctcactcagggcacagggtcctgggcccagtctgccctgactcagcctgcctcgtgtcgtgggtctccgtggacagtcgctcgaccatcctcctgcacgttggaacccagtaccagtgacggttgtggttaaccaactatcgtctccgtggtaaccaaccaccgacccggacaaacgcccccgagtacagtacgtattagtcgacggtactaactaacgtcccggtaccctcgtaacggggtcgttaacgttaacgtccgttactccgttcgtcggtaccttaccgacgttacgtacggaccaaacgtacccgggacccttcccgacgtaaccctattccgtacggttccggtacctaccacggggtaccttagggaaccgggtacgtaagggtaccctgtaaacgtttacgtttaccgtgtaaccggtntaccgtaactagtttacaactaaccggacttaacggtaaacttccgtttaacggtttaccgtttaccgggggtacggtaaccggggtaacccgtaaacgggtcccttaaccggggttaaccgttacccggttaaacgggtacccgtaaccgggaccccggttaacggccccggttaacccgtcccccccggtttacggtacccgttaaccccgg

SEQ ID NO: 51710 - DNA, 597 bp, Homo sapiens
  misc_feature: GYAE6OF02FK385.39.11.A11.1.454.CMB.1.raw
  modified_base (240)..(240): a, c, t, g, unknown or other
  misc_feature (240)..(240): n is a, c, g, or t
  modified_base (576)..(576): a, c, t, g, unknown or other
  misc_feature (576)..(576): n is a, c, g, or t
  modified_base (586)..(586): a, c, t, g, unknown or other
  misc_feature (586)..(586): n is a, c, g, or t
  modified_base (592)..(592): a, c, t, g, unknown or other
  misc_feature (592)..(592): n is a, c, g, or t
tcagtcgcactagtcacgaccggtgctcgatttagctacgactgcagggcctctggaggcaccttcaatagttatgtcatcacttgggtgcgacaggcccctggacaagggcttgagtgggtgggagggatcatctctatgtttggaacacccatgtttggtacaccaagttacgcacagaagttccagggcagagtcacgattaccgcggacgaatctacgagcacagcctacatggcnctgagaagtctgagatctgaggacacggccgtctatttcctgtgcgagagggacgcgggtatcacttaagacgcggcgggcgactacgtggggccagggaaccctggtcaccgtctcctcacgcctccaccaacgggccccagtccggtccttcccccgtggccctaccccgtcctacccaacggtacgcccaccgtcgtcgggggccacgacggccggtcccgtcgggtccgtcgccgtggtccgaaacggtaccttaccgttaccacgttacggttcgccgtaacgtcggacggccgggtcgtcgggaccaacggggccgtacgaagttacggngacgctacgntagctncgtcg

SEQ ID NO: 51711 - DNA, 671 bp, Homo sapiens
  misc_feature: GYAE6OF02HLN69.39.11.A11.1.454.CMB.1.raw
  modified_base (231)..(231): a, c, t, g, unknown or other
  misc_feature (231)..(231): n is a, c, g, or t
  modified_base (481)..(481): a, c, t, g, unknown or other
  misc_feature (481)..(481): n is a, c, g, or t
  modified_base (506)..(506): a, c, t, g, unknown or other
  misc_feature (506)..(506): n is a, c, g, or t
tcagtcgcactagtcacgaccggtgctcgatttagctacgactgcagggggggggtctcaggaggcagcgctctcaggacatctccaccatggcctgggctctgctgctcctcaccctcctcactcagggcacgagggtcctcgggcccagtctgccctgactcagcctgcctccgtgtcgtgggtcctccgtggacagtcgctcaccatcctcctgaccacgtagaaccngctaggtggtacgttggtagttaacaacttatcgtcctccgtaggtaaccaaccaaccgaccccggacaaacccggccccgtaaatccaagtcgtaattttacaggtaccttacactaacgtccggcccctggtagggttcgtactaacgtcgttcttctcgtcggcctacgtaacgtcgtacgaccaccgtaccgtccctacgtacactcgttcctggccggtcaccggaggtccgtaggtacggacgngtccgtagttactttacgttcgtancgtacgtctaacgtagtaacgttaccgaagtaacttagtaactttcccgtttcggttaccgttacgggaccgtaacgggtacaacggtcgtaaccgtacccggttcgtaaccggagacccgtaccggtacgccccttacccgggtaccctcgggtaccctacccg

SEQ ID NO: 51712 - DNA, 761 bp, Homo sapiens
  misc_feature: GYAE6OF02JI45R.39.11.A11.1.454.CMB.1.raw
tcagtcgcactagtcacgaccggtgctcgatttagctacgactgcagggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatgactatcgtctcctggtaccagcaatactccaggcaacacgacccccaaactcatctatttatgacggtcagtaatccggccctcgtacgggtttactaagtccgtctttctctcggtctaccgtaagttcgtcggaccaaaccgtaccggtccccttaccccgtacgaacccctacgtttcccgttccggtccggggtacccttacccgtaacggggtcccttaggaaccggggtaccggtacgggtccgttacgtaacgttttaaacgttaccgttcggtacctaacgtacccttcgttaacgttttcggaaccttaaacgttccgttaagggttacggtaacggtttacctttaacggtttacggtttacccggttaaccgggggttaaaagggttacccggggtaaaacccgttaagggttacccttaaccgggtttcccggtttaaccccggtttaacgggtaccccgttaaacccgggttaacccccggtaaaccccgggttaaaccccccc

SEQ ID NO: 51713 - DNA, 652 bp, Homo sapiens
  misc_feature: GYAE6OF02IE8EA.39.11.A11.1.454.CMB.1.raw
  modified_base (224)..(224): a, c, t, g, unknown or other
  misc_feature (224)..(224): n is a, c, g, or t
  modified_base (499)..(499): a, c, t, g, unknown or other
  misc_feature (499)..(499): n is a, c, g, or t
  modified_base (592)..(592): a, c, t, g, unknown or other
  misc_feature (592)..(592): n is a, c, g, or t
tcagtcgcactagtcacgaccggtgctcgatttagctacgactgcagggggggggtctcaggaggcagcgctctcaggacatctccaccatggcctgggctctgctgctcctcaccctcctcactcagggcacagggtcctgggcccagtctgccctgactcagcctgcctccgtgtctggtctcctggacagtcgctccaccatcctcctgcactcggaaccngcagtgacgttggtcgttacactatcgtctctacggtaccaacaaccaccccggacaaacgccccgaagtcagtgtatttatgaaccgtcaaccgtaacgtccggtcctacggagggttctactaagttcgactttctccgtagtccgtacctaacgtctacgggtaccaccgaaccgtcccttcccgtaccgtacctacgttccgtacgtcggtccctacgcgggtacgtacgggacggaccggacggtactagttacttaacgttactcgacncgtactactattactacgacgtacaaagttaacttaccgttcgtttaccggttacggtcgggaacggtaccaacggtcgtacgtacccggttntaaccggcgaaccgtcccggaacggtccgtacccccgtcccgtaccggttaccgtacccg

SEQ ID NO: 51714 - DNA, 651 bp, Homo sapiens
  misc_feature: GYAE6OF02JMI8G.39.11.A11.1.454.CMB.1.raw
  modified_base (251)..(251): a, c, t, g, unknown or other
  misc_feature (251)..(251): n is a, c, g, or t
  modified_base (297)..(297): a, c, t, g, unknown or other
  misc_feature (297)..(297): n is a, c, g, or t
tcagtcgcactagtcacgaccggtgctcgatttagctacgactgcaggggggggggtctcaggaggcagcgctctcaggacatctccaccatggcctgggctctgctgctcctcaccctcctcactcagggcacagggtcctgggcccagtctcgccctgactcagcctgcctccgtgtctgggtctccgtggacagtcgctcaccatctcctgcactaggaaccagcagtgacgttggtagtaacaactntgtcctcgtacgtaaccaaccgaaccacccgacaaccgccccgaancatagtatttacacgactactaactaacgtccgtacctcggtagggtctactactcgtcttcgtcgtcgtctaccgtaagtcgtacggacaaccggtccgcccttacctcgaacctgttccgtacgtcggcctccgtaggtccgtggaaccgggacggtacggcttacgttatttacgttacgcgtacagtcgtactattacgtaacgaagtacgtaagtttacgtccgtttccggtttaccggttaccggggacgttacgggacgtaggtaccgttacgtacccggttacggtaccgaccgtaccggtacccggtacggcccgtaccggtcccccgttaggtcccttacccgg

SEQ ID NO: 51715 - DNA, 587 bp, Homo sapiens
  misc_feature: GYAE6OF02IDRPT.39.11.A11.1.454.CMB.1.raw
  modified_base (325)..(325): a, c, t, g, unknown or other
  misc_feature (325)..(325): n is a, c, g, or t
  modified_base (369)..(369): a, c, t, g, unknown or other
  misc_feature (369)..(369): n is a, c, g, or t
tcagtcgcactagtcacgaccggtgctcgatttagctacgactgcagggggggggtctcaggaggcagcgctctcaggacatctccaccatggcctgggctctgctgctcctcaccctcctcactcagggcacaggtcctgggcccagtctgccctgactcagcctgcctccgtgtctggtctctggacagtcgctcaccatctctgcactggaaccagcagtgacgttggtgttacactatgtctccgtgtaaccacaaccgcccggacaaaccgccccgtaagtcatgtattatgacgtctaactaagtccgacctgagggtntactatcgtcttctgtcgctctagtcgcgacacgacgccctccngaacctcgtctcgtcgaccttccgagtcgaggtacggacgcgtctagtaacgtttcttagtgtacctacgactactaagttacgttacgaacgtctaaagttaacttaccgttcggtttaccgttcggacgggaacgtaccgagttacccgaggtacccttcggaacggttcctacgacccgtaagtcccgttacccgccccgttacgcccttacccg

SEQ ID NO: 51716 - DNA, 720 bp, Homo sapiens
  misc_feature: GYAE6OF02IAI95.39.11.A11.1.454.CMB.1.raw
  modified_base (706)..(706): a, c, t, g, unknown or other
  misc_feature (706)..(706): n is a, c, g, or t
  modified_base (712)..(712): a, c, t, g, unknown or other
  misc_feature (712)..(712): n is a, c, g, or t
  modified_base (715)..(715): a, c, t, g, unknown or other
  misc_feature (715)..(715): n is a, c, g, or t
  modified_base (717)..(717): a, c, t, g, unknown or other
  misc_feature (717)..(717): n is a, c, g, or t
  modified_base (719)..(720): a, c, t, g, unknown or other
  misc_feature (719)..(720): n is a, c, g, or t
tcagtcgcactagtcacgaccggtgctcgatttagctacgactgcagggcctctgggaggcaccttcaatagttatgtcatcacttgggtgcgacaggcccctggacaagggcttgagtggggtggagggatcgatctctatgtttggaacaccatgtttggtacaccaagttacgcacagaagttccagggcagagtcacgattaccgcgacgaatctacgagcacagcctacatcggcgctgagacgtctgagaatctagaggacacgccgtatatttctgtgtcgtagacgacgcgggtatcgaacgtttaagtacgcggtccgggacgtacgtaacgtcggggccgaacggggaacctggtaccacccggttcctccctcgacggcccttaccgaacccgtacgggacccctaacgttcccgggttcccgtttaccccccgttacgggtcccctaccccgttacccgttaccccgtaaacggtaaccgacccgtaacccggtttccgggtaccggggggggtaccctaaccggaacgggtaccccgggtacccggtttaccgggtccggttcggtacccggtttcggtaaccgttaaacgggtaacccgttaaccgtttacccgtaacgttacggtacggtccggaactacggacgggtacgggtccgtcgggaaccgtaacgggccgaccgtagtacgtgntagccncgncncnn

SEQ ID NO: 51717 - DNA, 784 bp, Homo sapiens
  misc_feature: GYAE6OF02F0T84.39.11.A11.1.454.CMB.1.raw
  modified_base (218)..(218): a, c, t, g, unknown or other
  misc_feature (218)..(218): n is a, c, g, or t
  modified_base (240)..(240): a, c, t, g, unknown or other
  misc_feature (240)..(240): n is a, c, g, or t
tcagtcgcactagtcacgaccggtgctcgatttagctacgactgcagggggggggtctcaggaggcagcgctctcaggacatctccaccatggcctgggctctgctgctcctcaccctcctcactcagggcacagggtcctgggcccagtctgccctgactcagctgcctcgtgtctggtctcgtgacagtcgctcacatcctctgcactcggaaccncgcagtgaccggttggggttangtactatcgtctcctggtaccagactaatactccgaggccacgaccgacccctaatcaatcctagtttacagtacgtacaagttaacgtccggtacccttggtaacggggttttacctaaacggttccgtaccgtttcgtaccgtggtaccctaccggtaagttccgtacggtacctaaaccggtacccggttccccttacccgtacggtaaccctacgtttccgtaccggttcgggtacccgttaccggtaacgggttcccgtaacgggtaaccggggtaaccgtacgggtaaccgtttacggttaaacgtttaaccgttaccgttacggtaaccgttacgttaccgtttaacgttaacgttttacgtacccgtaacgtttacccgtaaggttacgggtaaccgttaccgtttagttaccggtttacggttaaccgggtaaacgggtacgggttaacccgtaaagggttacccgtaacggttttcccggtaaccggttaacgggtcccctaaacggttaccccgggtaaaggttaaccccccg

SEQ ID NO: 51718 - DNA, 722 bp, Homo sapiens
  misc_feature: GYAE6OF02HVLP7.39.11.A11.1.454.CMB.1.raw
  modified_base (194)..(194): a, c, t, g, unknown or other
  misc_feature (194)..(194): n is a, c, g, or t
tcagtcgcactagtcacgaccggtgctcgatttagctacgactgcaggggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacngtcgctcaccatcctctgcacgtacggaaccagctagtgacgttggtagttaacacttatgtctcgtagtaaccaaccgaaccacccggacaaaccgccccgaagtacatacgtatttacgagtacgtactaactacgtccggacctagagggttctactaatccgtcttcgtcgtcggcctacgtacgtcgtacggaactaacgaccggtccctaccgtcgaacctacttcgtcgtcggtacctaccggaggtcgtagggaacgggacggtacggtacttagttaactttaacgtttacgacgtccgacgtacctaagttaacgttaactttaacggaacgtaacgttaaacgtttaaacgttccgtttaccgggttttacggtttaccggggaaccgggtaacggttaaccgtaacggttccggtaaccggtacccccggttaaccgttaacgggttacccaaccgggttaaccccgtacggtccccgttaccccggtaccccgttacgggtaccctttaacccgg

SEQ ID NO: 51719 - DNA, 731 bp, Homo sapiens
  misc_feature: GYAE6OF02FYCPJ.39.11.A11.1.454.CMB.1.raw
  modified_base (196)..(196): a, c, t, g, unknown or other
  misc_feature (196)..(196): n is a, c, g, or t
  modified_base (208)..(208): a, c, t, g, unknown or other
  misc_feature (208)..(208): n is a, c, g, or t
  modified_base (691)..(691): a, c, t, g, unknown or other
  misc_feature (691)..(691): n is a, c, g, or t
tcagtcgcactagtcacgaccggtgctcgatttagctacgactgcaggggggggggtctcaggaggcagcgctctcaggacatctccaccatggcctgggctctgctgctcctcaccctcctcactcagggcacagggtcctgggcccagtctcgccctgactcagcctgcctccgtgtctgggtctccgtggacngtcgctcacctntctcctgcctacgtacggaaccagctagtcgtacggtttgggtacggttaaccaacgttatcgtccttccgtacggtaacccaaacgaacccgtacccccggacaaaccggaccccccgaagtacagttacgtactttagtacgtaccgtactaaccgtacgtccggtacccgtacggtagggtacgtactaacgtccggtcctttctcggtcggtacctaccgtaagtccgtacggtaccgaaccgtacccgggtcccttacccgacgtacctacgttccttaccgggtcggaccctacggacggtcgggtaacggtacgggaaccggcgggtcgtaggttaacttttaacgttaccggtagtacctcgtaccttactaaagttacttaccacgtaacgttaaagttaacgttccgtttcggtttaccggttcgggaccgggtaaggtaccaagtccggtacgtacccggtcgtacggtacnccggtacgtcgtcccgtccgtacccgttcgtacgttcccg

SEQ ID NO: 51720 - DNA, 642 bp, Homo sapiens
  misc_feature: GYAE6OF02H41ZA.39.11.A11.1.454.CMB.1.raw
  modified_base (194)..(194): a, c, t, g, unknown or other
  misc_feature (194)..(194): n is a, c, g, or t
  modified_base (224)..(224): a, c, t, g, unknown or other
  misc_feature (224)..(224): n is a, c, g, or t
  modified_base (250)..(250): a, c, t, g, unknown or other
  misc_feature (250)..(250): n is a, c, g, or t
  modified_base (332)..(332): a, c, t, g, unknown or other
  misc_feature (332)..(332): n is a, c, g, or t
  modified_base (472)..(472): a, c, t, g, unknown or other
  misc_feature (472)..(472): n is a, c, g, or t
tcagtcgcactagtcacgaccggtgctcgatttagctacgactgcagggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacngtcgctcacatctcctgcacgtcggaaccngcagtgtacgttggtgtaacactatntctctgtaaccacaaccacccgacaaccgcccccgaagtcatagtattagtcgactacaactacgtccggcctcggagggtntactaactcgtcttctcgtcgcctaccgagttcgtacgaccaacgtaccggtcccttacccgtacgtaccctacgttccgttcgtcgggtcctccgcggtacgtagggacgggacgaggtcgtagtactttacttacgtnacgtacgactactagtacgttaacaagtaactaagttaacgttccgttacgtttaccggtttacgggacgggtaaccggtaccgtaacggtacgtaccggtaccgtaccggtaaggtccgtaaccgaccgtaacggtccctacccggtccccgttaccggtccttacccg

SEQ ID NO: 51721 - DNA, 704 bp, Homo sapiens
  misc_feature: GYAE6OF02IT4W2.39.11.A11.1.454.CMB.1.raw
  modified_base (212)..(212): a, c, t, g, unknown or other
  misc_feature (212)..(212): n is a, c, g, or t
  modified_base (224)..(224): a, c, t, g, unknown or other
  misc_feature (224)..(224): n is a, c, g, or t
tcagtcgcactagtcacgaccggtgctcgatttagctacgactgcagggggggggtctcaggaggcagcgctctcaggacatctccaccatggcctgggctctgctgctcctcaccctcctcatcagggcacagggtcctgggcccagtctgccctgactcagcctgcctccgtgtctgggtctcgtaggacagtcgatccaccatctcctncacgtagaaccngcagtcgacggttggggtatgactatgtctcgtgtaccagacaatactcaggcaaccaccgacccctaaacgtctactacttaagtttacgtaggacggtactacgttaactcccggtacccttacggttaacgggtttcttaacgtccgttcctttacgtcgtcggtactacgtaaacgtcgtacgaccaaccgtacccgggtcccctcccgtagtaacccttactcgtaccgtccgggtaccctaccggtacggtcgtacgggaacggtacgacggtactttacggttatttaaccggttccgacgtacgtaactaccttacgtacgtttacgctaagtcgttaaacgtggtaaccgttagtttacttcgggttaacgttaccggggtaagttaccggggaacttaaccggtacgttaaccgtttccgtaacccggttacggtacccgtaaccggtaccccggtacccgtaacccccg

SEQ ID NO: 51722 - DNA, 647 bp, Homo sapiens
  misc_feature: GYAE6OF02HK7GM.39.11.A11.1.454.CMB.1.raw
  modified_base (195)..(195): a, c, t, g, unknown or other
  misc_feature (195)..(195): n is a, c, g, or t
  modified_base (314)..(314): a, c, t, g, unknown or other
  misc_feature (314)..(314): n is a, c, g, or t
  modified_base (351)..(351): a, c, t, g, unknown or other
  misc_feature (351)..(351): n is a, c, g, or t
  modified_base (401)..(401): a, c, t, g, unknown or other
  misc_feature (401)..(401): n is a, c, g, or t
tcagtcgcactagtcacgaccggtgctcgatttagctacgactgcagggggggggtctcaggaggcagcgctctcaggacatctccaccatggcctgggctctgctgcctcctcaccctcctcactcagggcacagggtcctgggcccagtctgccctgactcagcctgcctccgtgtctgggtctcctggaccngtcgctccaccatcctcctgccactggaaccagctaggtcgacgttggtacgttaacaactatgtctcctggtaccaacaaccaccccggcaaaacgccccgaatcaatcgtatttagnacgtcactaacgtccggccctcgaggggtgtactaancgtcttctactggtctctaagtctggacaacgaccgcctacctgaacctntacctcgcggtctacgcgtcgtagaggacgaggtctgtattacttacgtgtacacgtctacgtacttaacgttactaagtaccgtaaagttaattaccgtttacgtttcccggttttaacgggtccgggtaacgggtaccgtaaacggtccgttaacggtacccggttaccgttaacgggttaccgaaccggtcccgaaccgggtccgtacccggttaccccccgttacggtacccgttaacccgg

SEQ ID NO: 51723 - DNA, 719 bp, Homo sapiens
  misc_feature: GYAE6OF02F8JWA.39.11.A11.1.454.CMB.1.raw
  modified_base (330)..(330): a, c, t, g, unknown or other
  misc_feature (330)..(330): n is a, c, g, or t
tcagtcgcactagtcacgaccggtgctcgatttagctacgactgcagggggggggtctcaggaggcagcgctctcaggacatctccaccatggcctgggctctgctgctcctcaccctcctcactcgaggcacagggtcctgggcccagtctgccctgactcagcctgcctccgtgtcctgggtctccgtggacaggtccgctacaaccattccgtcctgcacgtcggaaccagcaggtgtaacggtttggtcgttaacacttaagtgtctccgtaggtaaccaacaaccgaccccggacaaaccgcccccgaatcgtaatcgtatttanacgtaccgactaactaactccggccttcgagggtctactaacgtctcttctctcggccttaccgaagttcgtaggaccaacgtacccggcccttaccgtacgaccctacgttccgtacgtcggtcctacggaacggtcgtaggaacggacggtacgtacgtaattaacgttacgttacgttacgacgacgtacctatacgtttaaccttaacggaacgtaccgtaatttaaccgttacgttccggttttaccggtttaccgggtaacccgggtaacggttaaccgaacggttaccgtaacggtaaccccggttaccgtacgttaccggaaccgtacccggtaaccggtcgttcccccggtaccccgtttaccgggtacccttaacccgg

SEQ ID NO: 51724 - DNA, 663 bp, Homo sapiens
  misc_feature: GYAE6OF02H2XPP.39.11.A11.1.454.CMB.1.raw
  modified_base (212)..(212): a, c, t, g, unknown or other
  misc_feature (212)..(212): n is a, c, g, or t
  modified_base (246)..(246): a, c, t, g, unknown or other
  misc_feature (246)..(246): n is a, c, g, or t
  modified_base (262)..(262): a, c, t, g, unknown or other
  misc_feature (262)..(262): n is a, c, g, or t
  modified_base (646)..(646): a, c, t, g, unknown or other
  misc_feature (646)..(646): n is a, c, g, or t
  modified_base (650)..(650): a, c, t, g, unknown or other
  misc_feature (650)..(650): n is a, c, g, or t
  modified_base (654)..(654): a, c, t, g, unknown or other
  misc_feature (654)..(654): n is a, c, g, or t
  modified_base (656)..(656): a, c, t, g, unknown or other
  misc_feature (656)..(656): n is a, c, g, or t
tcagtcgcactagtcacgaccggtgctcgatttagctacgactgcagggcctctggaggcaccttcaatagttatgtcatcacttgggtgcgacaggcccctggacaagggcttgagtgggtgggagggatcatctctatgtttggaacaccatgtttggtacacctaagttaccgcacagaagttccagggcagagtcacgtattaccggnggacgaatctacgagcaacacgcctacatcggcnctagagaagtctaganatctagagacgacggccgtacttatttctgtgcgagacggacgcgggtatctaagttaagagccggcgggactacgtaggtcggggaccacgggtaacccgtggtccaacccgttctccgtcgaccgccctaccgaccgacgggtccctaacgttccggttccctccccgtacggacccctaccccttacccgtaccgtaaacggccgtacctaacccggttcgggtcggggtaccaccggtacggcccgggtacccgtcggggtcctcgggtcccgtacgggtacgaaccggtaccttacccttaccgtacgtacggtcgtaccgtaccggtacggcgggtccgggaccgtacggacggaaccgggccacgtacgtagcgtanacgncctncncgatccg

SEQ ID NO: 51725 - DNA, 749 bp, Homo sapiens
  misc_feature: GYAE6OF02F2VHY.39.11.A11.1.454.CMB.1.raw
  modified_base (162)..(162): a, c, t, g, unknown or other
  misc_feature (162)..(162): n is a, c, g, or t
  modified_base (197)..(197): a, c, t, g, unknown or other
  misc_feature (197)..(197): n is a, c, g, or t
  modified_base (228)..(228): a, c, t, g, unknown or other
  misc_feature (228)..(228): n is a, c, g, or t
  modified_base (583)..(583): a, c, t, g, unknown or other
  misc_feature (583)..(583): n is a, c, g, or t
tcagtcgcactagtcacgaccggtgctcgatttagctacgactgcagggggggggtctcaggaggcagcgctctcaggacatctccaccatggcctgggctctgctgctcctcaccctctcactcagggcacagggtcctgggcccagtctgccctgacctnacgcctcgcctcgtgtcgtggtctcgtgacagtcnctcaccatcctctcgcctacgtacggaaccngcgagtcggtacggtttggttacggttaactaactagtcgtctccgttacggacgacgactaactactccgacgacacgaccgaacccctaactctactacgttaatttacgtaggacggttactaacgtaacgtccggtacccttacgggtacggggttcttaaccgttaacgtccggttacgtttcctccggttacggtacctacccgtaatccggtacgaacgtaacccgtacccgggtccctacccgtacctaaccgctttaccgtacggtccgggtcccgtaccggtacggtacgtacggtaacgggaccggtagggtacttagttaagtttaaccgttactaccggtanaaccgtacttacggtaaacttccgttaacgaaaccgtacgtaaacgtttaaccgtactttaccggtttaccggttacggaccggggtaaacgtacgtaaccggtacgttacccggtaccgttacggtaccggtaccacccggtaaccgtaccgtccgtacccccgg

SEQ ID NO: 51726 - DNA, 639 bp, Homo sapiens
  misc_feature: GYAE6OF02JJR63.39.11.A11.1.454.CMB.1.raw
  modified_base (194)..(194): a, c, t, g, unknown or other
  misc_feature (194)..(194): n is a, c, g, or t
  modified_base (207)..(207): a, c, t, g, unknown or other
  misc_feature (207)..(207): n is a, c, g, or t
  modified_base (221)..(221): a, c, t, g, unknown or other
  misc_feature (221)..(221): n is a, c, g, or t
  modified_base (278)..(278): a, c, t, g, unknown or other
  misc_feature (278)..(278): n is a, c, g, or t
  modified_base (303)..(303): a, c, t, g, unknown or other
  misc_feature (303)..(303): n is a, c, g, or t
  modified_base (315)..(315): a, c, t, g, unknown or other
  misc_feature (315)..(315): n is a, c, g, or t
  modified_base (392)..(392): a, c, t, g, unknown or other
  misc_feature (392)..(392): n is a, c, g, or t
tcagtcgcactagtcacgaccggtgctcgatttagctacgactgcaggggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacngtcgctcacatcnctgcactggaaccngcagtgacgttggtcgttaacaactatgtctcctggtaaccaacaaccaccccgganaaacgccccgaagtcatgactttangacgtcactaanccggcctcgagggtctactaacgttcgtcttctcgtcgctacgaagtctcggacacgtccggtccctcctacgaccncttccgtcgtacggtcctacgacgtcgtggaacggacggtacggtctagttaacgttacgttacgtcgacacgtacctacgtaacttactacgaacgtacgtaaagttaacttacgttcggtttacccgtttacgggacgggtaacggacctaaggtccggttaaccggtaccttacggtacggtaccgtaccggtaccggaaccgggtcccgtaccccggtccccggttacggtacccttacccgg

SEQ ID NO: 51727 - DNA, 818 bp, Homo sapiens
  misc_feature: GYAE6OF02IQ251.39.11.A11.1.454.CMB.1.raw
  modified_base (206)..(206): a, c, t, g, unknown or other
  misc_feature (206)..(206): n is a, c, g, or t
  modified_base (244)..(244): a, c, t, g, unknown or other
  misc_feature (244)..(244): n is a, c, g, or t
tcagtcgcactagtcacgaccggtgctcgatttagctacgactgcaggggggggggtctcaggaggcagcgctctcaggacatctccaccatgcctgggctctgctgcctcctccaccctcctcactcgagggcacgagggtccgtgggccctagtcgtgccctgactcacgcctcgccttcgtgtcgttcgggtctccgtggacngtccgctcaccactctcctacgctaacgtaggaaccgngctacggtggtaccgggtttgggtacggttaacctaacttagttacggttccctccgttaacggtaacccgaaacgtaaacccgacccccggtacaaaacccggcccccgtaaacgtcttaacgtgttaacgttttacgtcggtaaccttcctaaccggttaacgtcccggtacccgtacggtacggggttctacgtacgttccgtcgtttccgtcgtacggtcctacgtaacggttccgtacgaccgtaacgacccggttccctacgtaccggtaactaccgttcgttaccggttccgggtaccctaccggggtacggtccggtagggaacgggaccgggtagggtacctagtttaacggtttaacttacgtaccgtaccgacgttacctaacgttaacgttacgtaacgacgttacgttaacgtttaactttccgggttttacgtttcccgggtttcgggaccgggttaacggaccgacgttaccggtaccgttacccggttacggtacccggttaacgcccgtaaccgtacgggttcccgacccggttcccccggttagtccccttaccgg

SEQ ID NO: 51728 - DNA, 728 bp, Homo sapiens
  misc_feature: GYAE6OF02GCPWN.39.11.A11.1.454.CMB.1.raw
  modified_base (240)..(240): a, c, t, g, unknown or other
  misc_feature (240)..(240): n is a, c, g, or t
  modified_base (718)..(718): a, c, t, g, unknown or other
  misc_feature (718)..(718): n is a, c, g, or t
tcagtcgcactagtcacgaccggtgctcgatttagctacgactgcagggcctctggaggcaccttcaatagttatgtcatcacttgggtgcgacaggcccctggacaagggcttgagtgggtgggagggatcatctctatgtttggaacacccatgtttgtacaccaagttacgcacagaagttccagggcagagtcacgattaccgcggacgaatctacgagcacagcctacagtggcncgtgagaagtctgagatctggagacgacggccgtcttatttctgtgcgaggaggacggcggtatcctaacgttaagtaggcgcgggacgaacgtacgtcggggaccgaacgggtaacccgtgggtcctacccggtcgtaccctccggtacgcccctacccgtaaccgaaccgggtccccaacgttcccgggtcccgttttccccccgaggtcccctaaccccgttcccgtacccgaaacggtaccgcccgtaacccgtccgggtacgggggacctaccggaaccggtcccgggaccccggtcgggccgttacggtcccgttagggtaccctaaacggggtaccttaacccgtttcccgaaaccgtttcggtaccggtaccggtaaccgtcgggtaacgggccggggtaccggttacgggaacccgggtaagggtcccggtaccggtaagttaacggtcgcgacgtccgtagacccggngtacgactcg

SEQ ID NO: 51729 - DNA, 583 bp, Homo sapiens
  misc_feature: GYAE6OF02H2Y5X.39.11.A11.1.454.CMB.1.raw
  modified_base (196)..(196): a, c, t, g, unknown or other
  misc_feature (196)..(196): n is a, c, g, or t
  modified_base (229)..(229): a, c, t, g, unknown or other
  misc_feature (229)..(229): n is a, c, g, or t
  modified_base (323)..(323): a, c, t, g, unknown or other
  misc_feature (323)..(323): n is a, c, g, or t
  modified_base (362)..(362): a, c, t, g, unknown or other
  misc_feature (362)..(362): n is a, c, g, or t
tcagtcgcactagtcacgaccggtgctcgatttagctacgactgcaggggggggggtctcaggaggcagcgctctcaggacatctccaccatggcctgggctctgctgctcctcaccctcctcactcagggcacagggtcctgggcccagtctgccctgactcagcctgccttcgtgtcgtgggtcctcgtggacnggtcgctcacctatctcctgcacgtcggaaccngcagtcgacgttggtgtactactatgtctctgtaccaacaaccacccggacaacgccccgaagcatagtattatgactcactatccggcctagnggtgtactagtcgtctctctgctacgagtcgtcgacacnccgtcctccgtcgactacgtctacgcggtcctccgaggtcgtaggaccgggtaggacgtcgtaacgtatttacgttacgcgtacgtagtccgtactaagttccttacggtaacgacttagtaacgttactcggtttacggttcgggacggtacggacacggtcgtcgtccgtacgtacggactccgacgtacggtccgtccgtacccgtccggttatcccg

SEQ ID NO: 51730 - DNA, 616 bp, Homo sapiens
  misc_feature: GYAE6OF02ID6T7.39.11.A11.1.454.CMB.1.raw
  modified_base (188)..(188): a, c, t, g, unknown or other
  misc_feature (188)..(188): n is a, c, g, or t
  modified_base (193)..(193): a, c, t, g, unknown or other
  misc_feature (193)..(193): n is a, c, g, or t
  modified_base (201)..(201): a, c, t, g, unknown or other
  misc_feature (201)..(201): n is a, c, g, or t
  modified_base (208)..(208): a, c, t, g, unknown or other
  misc_feature (208)..(208): n is a, c, g, or t
  modified_base (220)..(220): a, c, t, g, unknown or other
  misc_feature (220)..(220): n is a, c, g, or t
  modified_base (300)..(300): a, c, t, g, unknown or other
  misc_feature (300)..(300): n is a, c, g, or t
  modified_base (480)..(480): a, c, t, g, unknown or other
  misc_feature (480)..(480): n is a, c, g, or t
  modified_base (540)..(540): a, c, t, g, unknown or other
  misc_feature (540)..(540): n is a, c, g, or t
tcagtcgcactagtcacgaccggtgctcgatttagctacgactgcaggggggggggtctcaggaggcagcgctctcaggacatctccaccatggcctgggctctgctgctcctcaccctcctcactcagggcacgagggtcctgggcccagtctgccctgactcagcctgcctcgtgtctggtctccnggacngtcgctcncatctcnacatcggaaccngcagtcgacgttggtagttacactatctctcctagtaccaacaaccgacccgacaaccgccccgaatcatagtagtttancgacgtactactaacgtcggtacctcggagggttctacgtatccgtacttctcgtcggtccttacacgtccgtagaccaaccgtaccgtcccttaccgcgtacacttccgtacgtcgggccttacggacggtgtacggaacggacggtcggtacttagttaacgtttcttaccgtcgtanacgtactacctagttacttacggaatacgtaattacgttacgttcgtttaccggtacggngggtaaccgacgacgtcgtaccggtaccgtacgtagaccgaccgcgacggtctcccggacccgttcgtacctccgg

SEQ ID NO: 51731 - DNA, 606 bp, Homo sapiens
  misc_feature: GYAE6OF02JXJX2.39.11.A11.1.454.CMB.1.raw
  modified_base (123)..(123): a, c, t, g, unknown or other
  misc_feature (123)..(123): n is a, c, g, or t
  modified_base (161)..(161): a, c, t, g, unknown or other
  misc_feature (161)..(161): n is a, c, g, or t
  modified_base (198)..(198): a, c, t, g, unknown or other
  misc_feature (198)..(198): n is a, c, g, or t
  modified_base (206)..(206): a, c, t, g, unknown or other
  misc_feature (206)..(206): n is a, c, g, or t
  modified_base (224)..(224): a, c, t, g, unknown or other
  misc_feature (224)..(224): n is a, c, g, or t
  modified_base (246)..(246): a, c, t, g, unknown or other
  misc_feature (246)..(246): n is a, c, g, or t
  modified_base (270)..(270): a, c, t, g, unknown or other
  misc_feature (270)..(270): n is a, c, g, or t
  modified_base (279)..(279): a, c, t, g, unknown or other
  misc_feature (279)..(279): n is a, c, g, or t
  modified_base (281)..(281): a, c, t, g, unknown or other
  misc_feature (281)..(281): n is a, c, g, or t
  modified_base (285)..(285): a, c, t, g, unknown or other
  misc_feature (285)..(285): n is a, c, g, or t
  modified_base (289)..(289): a, c, t, g, unknown or other
  misc_feature (289)..(289): n is a, c, g, or t
  modified_base (294)..(294): a, c, t, g, unknown or other
  misc_feature (294)..(294): n is a, c, g, or t
  modified_base (378)..(378): a, c, t, g, unknown or other
  misc_feature (378)..(378): n is a, c, g, or t
  modified_base (449)..(449): a, c, t, g, unknown or other
  misc_feature (449)..(449): n is a, c, g, or t
  modified_base (519)..(519): a, c, t, g, unknown or other
  misc_feature (519)..(519): n is a, c, g, or t
tcagtcgcactagtcacgaccggtgctcgatttagctacgactgcaggggggggggtctcaggaggcagcgctctcaggacatctccaccatggcctgggctctgctgctcctcaccctcctnactcagggcacagggtcctggcccagtctgccctgacnagcctgcctcgtgtcgtgggtctccgtgaccaggtcnctccactntctcctgcactggaaacngccagtgacgttgtagtacatntgtctcacggtacacacacccganaaccgccancntagnttancgtcncatacgccgactgaggtgtacatcgtctactcgtcgtactcctaacgtcgtacgacgtaccgacgacccctttccgcgttaacnccgtttcgccggtacggtctacgcggcgtaccggtaacggtgcgtactggtactttacgtcctgacgtacncgtataactacacgacggttacaatttaccggttacgttcccttacggttacggaccgtaaccgggtacncgtaccggttcggtaccgttaacggtacctaccggtaaccgtcccggtacgtcccggtaccccgtacccggttccgtacccgttccg

SEQ ID NO: 51732 - DNA, 867 bp, Homo sapiens
  misc_feature: GYAE6OF02JJ9PP.39.11.A11.1.454.CMB.1.raw
  modified_base (862)..(862): a, c, t, g, unknown or other
  misc_feature (862)..(862): n is a, c, g, or t
tcagtcgcactagtcacgaccggtgctcgatttagctacgactgcagggcctctggaggcaccttcaatagttatgtcatcacttgggtgcgacaggcccctggacaagggcttgagtgggtgggagggatcatctctatgttggaacaccatgtttgtacaccgaagttacgcacagaagttccgagggcagagtcacgacttaccggcggacgaatctacgagcactacgacctacagtcggcgctagaacgaagtctgagtatcaggtacggacgaccggccgtacttatttcgtgtcggaccgaggtacgggaccggtacgggtactaccgtaacgttaaggtacggtccggacgggccggtaaccgttaacgtccgggggtaccgaaccgggggtaaacccgttcgggtaacccgacccggttacccttaccggtaccgtaaccggtacccccgttacccgaacccggtaaaccggggtccccttaacggttccccggtttaaccccgtttcccccccggttgggtaacccccgtacccccgttaccccgtacccgaaaccgggtaacccgaccccgttaacccggttacccggtacggggggtacccaacccgggtaccgggtaccccgggttcccccggttacggggtcccgttcccgggtacccgttacccgggtaaccgtaaaccggttaacccgttaaccccgttacccggttaacccggttagggttcccggtaccgtaacggtaccgggtaccggttcccggggtaccgtaccggggtacgggaccggtaacccggtaacgtaacgttaccggacgttacgacgtaccggacgtacccggttagaccggngtacg

SEQ ID NO: 51733 - DNA, 819 bp, Homo sapiens
  misc_feature: GYAE6OF02JLICQ.39.11.A11.1.454.CMB.1.raw
  modified_base (195)..(195): a, c, t, g, unknown or other
  misc_feature (195)..(195): n is a, c, g, or t
  modified_base (233)..(233): a, c, t, g, unknown or other
  misc_feature (233)..(233): n is a, c, g, or t
  modified_base (265)..(265): a, c, t, g, unknown or other
  misc_feature (265)..(265): n is a, c, g, or t
  modified_base (298)..(298): a, c, t, g, unknown or other
  misc_feature (298)..(298): n is a, c, g, or t
tcagtcgcactagtcacgaccggtgctcgatttagctacgactgcaggggggggggtctcaggaggcagcgctctcaggacatctccaccatggcctgggctctgctgctcctcaccctcctcactcagggcacgagggtcctgggcccagtctgccctgactcagcctgcctcgtgtcgtggtctccgtggacngtccgctacaccattcctcctcgactacgtcggaaccngcaggttcggtacggttgggttagtacaactntcgtctcgtacgtaccaacaaccgaccccgganaaccggtcccgaagtctagtacgtagttacgtacggtacgtacctaacgttaccgtcccgggtaccccgtgggtacggggttacgttaacgtaaccggttcggttccgtttccgtaccgggtccgggtaccttaccggttaacggttcgtaccgggacgtaaccggtcccggtaccctacccgtacggaccctacgtttccgttccggtaccggtaccgtaccggtacggtaccgttagggaacggtacggtacggtaccttaggttaacttacggtttaactcggaccgtacgttaccgtactaagtttacgtaccgaaacggtaacttaaagtttaaacccggttcgttttccccggggttttacgggttaaccggggggaccggtaacgggtacccgttaacgggtcccgggtttaacccggtaccgggtttacccgtaacggggttacctaacccgggtacccggttaccggtcccggttacccccggacccgggtttcttaacccccggtacccgg

SEQ ID NO: 51734 - DNA, 504 bp, Homo sapiens
  misc_feature: GYAE6OF01ADH4E.43.14.B03.1.454.CMB.1.raw
  modified_base (496)..(496): a, c, t, g, unknown or other
  misc_feature (496)..(496): n is a, c, g, or t
tcagtgtgagtagtcacgaccggtgctcgatttagtgtgagtagttccgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagctacttatgtcttcggacgtggaccaggtcaccgactggtcagcccaaggccaacccnctgtctac

SEQ ID NO: 51735 - DNA, 539 bp, Homo sapiens
  misc_feature: GYAE6OF01DKW9F.43.14.B03.1.454.CMB.1.raw
  modified_base (528)..(528): a, c, t, g, unknown or other
  misc_feature (528)..(528): n is a, c, g, or t
tcagtgtgagtagtcacgaccggtgctcgatttagtgtgagtagttccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaacgcccccaaatcatgatttatgatgtcagtaatcggcctcgtagggtttctaatcgcttctctggctcaagtctggacaacaccggcctccctgaccatctcgtcgggctccgaggctggacggacgaggctagatttatactgcagctcaatataacaagcaagcagctacttatcgtacttacggaacgttgggaacctagggtccaacccgacgtaggtccacgacccaaaggaccccaacccnctgtcctaccg

SEQ ID NO: 51736 - DNA, 555 bp, Homo sapiens
  misc_feature: GYAE6OF01D8O23.43.14.B03.1.454.CMB.1.raw
  modified_base (431)..(431): a, c, t, g, unknown or other
  misc_feature (431)..(431): n is a, c, g, or t
tcagtgtgagtagtcacgaccggtgctcgatttagtgtgagtagttccgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaacgccccaaactcatgatttatgatgtcagtaatcggccctcgaggggtttctaatcgcttctctggctcaagtctgcaacacggcctccctgaccatctctgggctccgaggctggacggacgaggctgatttattactgcagctacatanacaagcagcagactacttatcgttacgttacggaacgtcgggaaccaagggtcccaaccgaccgttacgggtccaacggaccccgaaacgggacccccaaaccccacgttcgtacctttacccg

SEQ ID NO: 51737 - DNA, 543 bp, Homo sapiens
  misc_feature: GYAE6OF01BGDTJ.43.14.B03.1.454.CMB.1.raw
tcagtgtgagtagtcacgaccggtgctcgatttagtgtgagtagttccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaacgcccccaaaactcatgatttatgatgtcagtaatcggccctctaggggtttctaatcgcttctctggctcaagtctggcaacacggcctccctgaccatctctgggcctccgaggctggaggacgaggctgtattattactgcagctcatatacaagcagcagctacttatgtcttacggaactcgggaacctaaggtccaaccgacgtacggtaccacgaccccgaagggaccccaaaccccgtactcgtccctaacccg

SEQ ID NO: 51738 - DNA, 667 bp, Homo sapiens
  misc_feature: GYAE6OF01DQHPY.43.14.B03.1.454.CMB.1.raw
  modified_base (207)..(207): a, c, t, g, unknown or other
  misc_feature (207)..(207): n is a, c, g, or t
  modified_base (235)..(235): a, c, t, g, unknown or other
  misc_feature (235)..(235): n is a, c, g, or t
tcagtgtgagtagtcacgaccggtgctcgatttagtgtgagtagttccgtcggggggggttcgtcagggaggcagccgctctcgggacgtctccaccatggcctgggctcgtcgctattcctcaccctccgtctactcagggcacagggtcctcggcccaggtctcgaccctgactcagcctgcctccgtgtctggtctcctggacngtcgatcacatctcctgcactggaaccngctaggtcggacgttgggtcggttaataacttgtcgtctcgtacggttaccaacaaccgtaccaggaccaaacgacccccaaaactcgaatcgtaactttatgtactgtactagtacgtccggtcctacgtagggtttactaagtacgtcgttactctggtacctacgtaagtcgtcggactaaacggcggtaccctccgtacgaacctagttctcgtcggtcctaccgacggtctgggaacggacgacggtcttagtactttagttactggtactacgtcctacaacttaactaacgaaacgtcaagactacgtactacttactcgttacgttaccggtaacggacgggtaacccgaacggtaccgaacccggtaacgtacggtaccgaaccgacccggtaacggacccctaacccgacttcgtcctaccg

SEQ ID NO: 51739 - DNA, 635 bp, Homo sapiens
  misc_feature: GYAE6OF01EAO2O.43.14.B03.1.454.CMB.1.raw
  modified_base (251)..(251): a, c, t, g, unknown or other
  misc_feature (251)..(251): n is a, c, g, or t
  modified_base (352)..(352): a, c, t, g, unknown or other
  misc_feature (352)..(352): n is a, c, g, or t
tcagtgtgagtagtcacgaccggtgctcgatttagtgtgagtagttccggcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactntgtctctgtaccaacaacaccaggacaaacgccccaactcatgtatttatgtatgtacagtaactccggtccctcgtaggggtttacaattccgactttcncgttcggccttaccgaagttcctaggaccaacgccggcccttcccgagaccctatcctagtcgggtcctcggagtcgtaggaacggacgaggtctagtaactttagtacctgacagtacctataattacaacgaagccaagccaagacctaacgttatcgttacgttacgggaaacgtacggggaaacctacgggtacccaaacccgggtacctaacgggtacccaacgggtacccccgaaacgggaccccccaaaacccgtcgttaaccgtcccgtaacccg

SEQ ID NO: 51740 - DNA, 552 bp, Homo sapiens
  misc_feature: GYAE6OF01CN4UU.43.14.B03.1.454.CMB.1.raw
  modified_base (303)..(303): a, c, t, g, unknown or other
  misc_feature (303)..(303): n is a, c, g, or t
tcagtgtgagtagtcacgaccggtgctcgatttagtgtgagtagttccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgtttggtggttaataactatgtctcctggtaccaacaacacccaggcaaagcccccaaatcatgatttangatgtcagtaatcggcctgagggtttactaatcgcttctctggctcaagtctggcaacacggccctccctgaccatctctgggctccaggctgacgggacgaggctagattatactgcagctacatatacaagcagcagactacttaatcgttcgttacgggaactcgggaacctaagggtcccaaccgaaccgttgggtaccaacggaccccaaacgggaccccaaacccccacttcgtaccgtaccc

SEQ ID NO: 51741 - DNA, 553 bp, Homo sapiens
  misc_feature: GYAE6OF01BZ4UO.43.14.B03.1.454.CMB.1.raw
  modified_base (224)..(224): a, c, t, g, unknown or other
  misc_feature (224)..(224): n is a, c, g, or t
  modified_base (301)..(301): a, c, t, g, unknown or other
  misc_feature (301)..(301): n is a, c, g, or t
  modified_base (370)..(370): a, c, t, g, unknown or other
  misc_feature (370)..(370): n is a, c, g, or t
  modified_base (420)..(420): a, c, t, g, unknown or other
  misc_feature (420)..(420): n is a, c, g, or t
  modified_base (541)..(541): a, c, t, g, unknown or other
  misc_feature (541)..(541): n is a, c, g, or t
tcagtgtgagtagtcacgaccggtgctcgatttagtgtgagtagttccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccngcagtgacgttggtgttataactatgtctcctggtaccaacaacaccaggacaaacgcccccaaactcatgatttangatgtacagtaactcggccctcgtagggtttctaatcgcttctctgctcaagtctgcaacacgcctccngacctatcgtctcgggctcgaggctggacggacgagctgtacttattacncgcagtctataatactaacgaagcagacagtctaacttagtcgttacgttacggaacgtcgggtaaccaacggtccgaaccgtacgtacggtacaccgtaccccgaacgaccccaaacccnctcgtcctaccg

SEQ ID NO: 51742 - DNA, 677 bp, Homo sapiens
  misc_feature: GYAE6OF01BF29E.43.14.B03.1.454.CMB.1.raw
  modified_base (225)..(225): a, c, t, g, unknown or other
  misc_feature (225)..(225): n is a, c, g, or t
  modified_base (297)..(297): a, c, t, g, unknown or other
  misc_feature (297)..(297): n is a, c, g, or t
tcagtgtgagtagtcacgaccggtgctcgatttagtgtgagtagttccgcggggggggtctcaggaggcagcgctctcgggacgtatccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctctgtaccaacaacaccagcaaacgccccaaactcatgatttangatgtcagtaatccggtcctcgtagggtttctaagtcgtcttctcgtggctccaagtctggaccaacgaccggtccctacccgtcgacctactccttcgtcgggccttacccgagggtcgtacgggaacgggacggtaacggtcttaggtaacttttacgttacgtcggactacgtcctacgtaactttaacaacgtaaacggctaacggccgtaagtacccttaacgtttaacgttcgtttacccgttaaccggggtaaaccgttacggggaaaacccttaacggggtacccaaccccgggtaaccgttaacgggtacccgaacggtaacccccgaaccggaaccccccaaacccccgtgttacccgtcccgtaacccg

SEQ ID NO: 51743 - DNA, 673 bp, Homo sapiens
  misc_feature: GYAE6OF01D88W0.43.14.B03.1.454.CMB.1.raw
  modified_base (226)..(226): a, c, t, g, unknown or other
  misc_feature (226)..(226): n is a, c, g, or t
tcagtgtgagtagtcacgaccggtgctcgatttagtgtgagtagttccggcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtggttataactatgtctcctgtaccaacaacaccaggacaaacgacccccaaactcaatgtatttatgatgtcaagtaactccggccttacgtaggggtttactaagttcgtctttctcgtcggctaccaagtcgtggaccaaacgccggtccctcccgtacgaaccctacttccgtacgtcgggcctccgaggtcgtagggacggacgaggcgttagtaactttattacgtgactagtcctactaataacgtacaagacgaacgacgaagtacctaactttacgttacggttaccgttaaccgggaaaccggttcggggaaaccctaaacggggttacccctaacccggtaaccgttacggggaaccctaaccgggaacccccgaaaccgggaacccccctaaacccccgtacgttcccgtaccctaaccccg

SEQ ID NO: 51744 - DNA, 560 bp, Homo sapiens
  misc_feature: GYAE6OF01CZ7S5.43.14.B03.1.454.CMB.1.raw
  modified_base (324)..(324): a, c, t, g, unknown or other
  misc_feature (324)..(324): n is a, c, g, or t
  modified_base (456)..(456): a, c, t, g, unknown or other
  misc_feature (456)..(456): n is a, c, g, or t
  modified_base (461)..(461): a, c, t, g, unknown or other
  misc_feature (461)..(461): n is a, c, g, or t
tcagtgtgagtagtcacgaccggtgctcgatttagtgtgagtagttccgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgtttggtggttataactatgtctcctggtaccaacaacacccaggacaaacgcccccaaaactcatgatttatgatgtacagtaatcgcctnagggtttacaatcgcttctactggctacaagtctggacaacacggccctccgtagaccatctcgtgggccttccgaggctgaggacgaggcttaggtaattattactgacagtctacatataacaagactanacganctaacgttatcgttcttaccggaactcgggaccaagggtcccaccggacctaagtccctaagaccccgtaaacggcccaaacccccatcgttactaccg

SEQ ID NO: 51745 - DNA, 729 bp, Homo sapiens
  misc_feature: GYAE6OF01CQO8X.43.14.B03.1.454.CMB.1.raw
tcagtgtgagtagtcacgaccggtgctcgatttagtgtgagtagttccgcggggggggtctcaggaggcagcgctctcgggacgtctccaccatggcctgggctctgctattcctcaccctcctcactcagggcacagggtcctgggcccagtctgccctgactcagcctgcctccgtgtcgtgggtctcctggacagtcgatcaccatcctctgcactacggaaccagcagtgacgttggtaggttataactatcgtctctacgtacaacaacaccgaggaccaaaccgacccaaactacagtacgtatttatagtatcgtactaagtaacgtccggtacccgttacggtaacgggggttttacctaacgttccggttaccttcgttcgtcggtacctaccgtaacgtcgtacgaccgtaaaccggtaccggtccccgttacccgtacgtaaccctacgtttacccgtcggtccgggtacccgttaaccgacgggtaccgttaaccgggaacgggtaacccgggtaacgggttacgtaacggtttaactttaacgttaccgttagaaccgtacgtccgtaactaattaaccgtaaacaacgtacgaacgactaacgtactattacgtacgttaccgtaacggttacggacggaaccgtacggtaccgtaccgtacgtacggtaccaccgtacccgaaccggtacccaacccgtcctcgtacgtacccg

SEQ ID NO: 51746 - DNA, 552 bp, Homo sapiens
  misc_feature: GYAE6OF01C8Q3B.43.14.B03.1.454.CMB.1.raw
tcagtgtgagtagtcacgaccggtgctcgatttagtgtgagtagttccggcggggggggtctcaggaggcagcgctctcgggacgtatccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttaatactatgtctctggtaccaacaacacccaggcaaacgcccccaaactcatgatttatgatgtcagtaatcggccctcgtaggggtttactagtcgtcttctctgctcagtctggacaacacggcctccgtgaccatctcgtcgggcctccgaggtctggacggacggaggtctagattattactcgcagctcatactacaagcagacagactactttagtgttcgttacggaacgtcgggacctaacggtccaaccgtcgtacggtccacgacccgaacggacccaaccccgtactcgtctacccg

SEQ ID NO: 51747 - DNA, 700 bp, Homo sapiens
  misc_feature: GYAE6OF01AXCDZ.43.14.B03.1.454.CMB.1.raw
  modified_base (249)..(249): a, c, t, g, unknown or other
  misc_feature (249)..(249): n is a, c, g, or t
tcagtgtgagtagtcacgaccggtgctcgatttagtgtgagtagttccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacggttggtgttatactntgtctcctgtaccaacaacacccaggacaaacgcccccaaactcatgtatttatgatgtacagtaatccggccctacgtaggggtttactaatcgtacttctcgtcggtacctccgaagtccgtggaccaacgaccggtcccctcccgtacgtacccacttccgttcgtcggggtccctaccggacgggtcgtacgggacgggtacggaacggggtcctaggtaacttttaacgtttaacgtcggaccgtagtccttactaattaacttaacgaacgtacacggtacacgtccttaagtttacgttcgttaccggttaaccgggtaacgttacgggggaaacccgtttaacggtacccgtaccccggtaaccggttaaccgggtacccgtaacggtaaccccccgaaaccggtaccccccaaacccctcgttaaccggtcccttaaccccg

SEQ ID NO: 51748 - DNA, 550 bp, Homo sapiens
  misc_feature: GYAE6OF01BVRLJ.43.14.B03.1.454.CMB.1.raw
  modified_base (362)..(362): a, c, t, g, unknown or other
  misc_feature (362)..(362): n is a, c, g, or t
tcagtgtgagtagtcacgaccggtgctcgatttagtgtgagtagttccgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctctggtaccaacacacccaggacaaacgccccaaactcatgatttatgatgtcagtaatcggccctcgtagggtttctaatcgtcttctctggctcaagtctggcaacncggccctccctgacccatcctcgtgggcctccgaggctggaggacgaggtctgatttattactgcagctcaatatacaagacagcagctacttatcgtacttcggaactcgggaacctaagggtccaacccggtacctacgggtaccaacggaccccaaacggaccccaaaccccgctcgtcctaccg

SEQ ID NO: 51749 - DNA, 550 bp, Homo sapiens
  misc_feature: GYAE6OF01CGGZV.43.14.B03.1.454.CMB.1.raw
  modified_base (225)..(225): a, c, t, g, unknown or other
  misc_feature (225)..(225): n is a, c, g, or t
  modified_base (244)..(244): a, c, t, g, unknown or other
  misc_feature (244)..(244): n is a, c, g, or t
tcagtgtgagtagtcacgaccggtgctcgatttagtgtgagtagttccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttanactatgtctctggtaccaacaacaccaggcaaagcccccaaactcatgatttatgatgtcagtaatcggcctcgtaggggtttctaatcgtcttctctggctcaagtctaggcaacacggccctccctgacctatctacgtgggccttccgacggctggaggacgaggctagtatttattactgactagcctacataataacgaagacagcagtctacttatcgtacgttcggaactcgggaacctaaggtccaaccggtacgtaggtccacgacccaacggacccaaaccctcgtcgtcctaccg

SEQ ID NO: 51750 - DNA, 591 bp, Homo sapiens
  misc_feature: GYAE6OF01D48AH.43.14.B03.1.454.CMB.1.raw
tcagtgtgagtagtcacgaccggtgctcgatttagtgtgagtagttccgcggggggggtctcaggaggcagcgctctcgggacgtctccaccatggcctgggctctgctattcctcaccctcctcactcagggcacagggtcctgggcccagtctgccctgactcagcctgcctcgtgtctgggtctctggacagtcgatcaccatctcctgcactggaaccagcagtgacgttggtgttaataactatgtctctggtaccaacaacacccaggcaaacgcccccaaactcactgattttaatgatgtctagtaatccggtcctcgtaggggtttctaatcgtctttctctcggctacaagtctggactaacgacggcctccctgaccatctcgtcggggcctcgaggcctgacgggacgaggctagtatttacttacgtgcaagtcctactatatacaagtcaagacagtacactttagtcgttcgttaccggaacgtcgggaaccctaacgggtacctacccggaaccgttacgggtaccaccggaaccccgaaacggacccccaaaccctcctacgtcccgttacccg

SEQ ID NO: 51751 - DNA, 823 bp, Homo sapiens
  misc_feature: GYAE6OF01EBMLK.43.14.B03.1.454.CMB.1.raw
  modified_base (199)..(199): a, c, t, g, unknown or other
  misc_feature (199)..(199): n is a, c, g, or t
tcagtgtgagtagtcacgaccggtgctcgatttagtgtgagtagttccggcggggggggtctcaggaggcagcgctctcgggacgtctccaccatggcctgggctctgctattcctcaccctcctcactcagggcacagggtcctgggcccagtctgccctgactcagcctgcctcgtgtcgtcgggtctccgtggacngtcgatcacatcctcctgacacgtacggaaccagcaggttgtacggttgggttagtttaataacttagtcggttctaccgtacggtaaccaaaccaaccacccgaacggaaccaaaacccggacccccaaaacgtcaacgttacgttaagtttagtagtacgttacgtacgtaaacgttaaccggtcccggtacccttagggttacggggtttactaacgttccgtacctttcgtcgtacggtacccttaacgtaacggttccgtacggacccgtaaacccggtacccggtcccctacccgtacgtaacccgtacttacccggttacggttcggtacccgttaccgaccgggtacggtacggacggggtaaccgggaacggtacggttacgttaatttaacgtttacgtaacgcgtacgtctaactaacgtaactaacgtaacgaacgtacgtaacgtacgtacgtttaacttacgttacggttccggttaaaccggaaccgggttaaccggtaaccgggtaaccggtaaccggtaccccgttaaccggtcgggtaacccgacccggaaacccggtaaccccgtaaccccgaaacccgtacccgttccgtaccgttaacccccg

SEQ ID NO: 51752 - DNA, 785 bp, Homo sapiens
  misc_feature: GYAE6OF01EAXCA.43.14.B03.1.454.CMB.1.raw
tcagtgtgagtagtcacgaccggtgctcgatttagtgtgagtagttccgcggggggggtctcaggaggcagcgctctcgggacgtctccaccatggcctgggctctgctattcctcaccctcctcactcagggcacagggtcctgggcccagtctgccctgactcagcctgcctccgtgtcgtgggtctcctggacagtcgatccaccatcctcctgccacgtacggaaccagccgaggttggtacggtttgggtaggtttaactaaacttattcgttccttaccgttacggtaaaccctaaaccaaacccaaccccgaacgggaaccaaaacccggaacccccccaaaaccttacctaactttacggttaattttaagtaggtacgttacggtacgtaaacggttaacgtcccggtacccgttacggttaacggggttttaccttaaacgttccgttacctttaccgtccgtacggtacccttaccgtaacggtccgtacggaccgtaaccgaccggtcccctacccgtacgtaccctacttcctcggtcggcctacgacggcgtaggacggacggagtctagtactttacgtacgtgactacgctataactactaacaacgtacagacgtacgtacttacgttacgtacggttacgttaaccgggtaacgggttacggaacccggttaaaccggtaccgtaaaccggtaccggtacggacccgaaccggaacccccgaaccggtaaccccctaacccgtaccgttccgtacccgttaaccccg

SEQ ID NO: 51753 - DNA, 691 bp, Homo sapiens
  misc_feature: GYAE6OF01AY4W4.43.14.B03.1.454.CMB.1.raw
  modified_base (142)..(142): a, c, t, g, unknown or other
  misc_feature (142)..(142): n is a, c, g, or t
  modified_base (206)..(206): a, c, t, g, unknown or other
  misc_feature (206)..(206): n is a, c, g, or t
  modified_base (219)..(219): a, c, t, g, unknown or other
  misc_feature (219)..(219): n is a, c, g, or t
  modified_base (452)..(452): a, c, t, g, unknown or other
  misc_feature (452)..(452): n is a, c, g, or t
tcagtgtgagtagtcacgaccggtgctcgatttagtgtgagtagttccggcgggggggtctcgaggaggcagcgctcgtcgggacgtctccaccatggcctgggctctgctattcctccaccctcctcactcgagggcacgngggtcctcggacccagtctcgccctgactcgagcctgcctcgtgtcgtgggttcctccgtgganacgtcgatccacntcctaccgtgcaacgtaggaaccagcgtaagtggtacgtttggtagtttaactaactgttgtctcgtacgtaaccaaccaacaccgacgaccgaaaccacccctaaactcattacgtaatttacgtagtatacgtagtaaacgttacgtcccggtaccgttacggttaacgggtttaccttaacgtcgtcttccgtcgttacgtccgtaccgtacggttcgacgtaccgaacnccgtaccctccgacttaccgacttccgacgtccggtacgtaccgcgttacgacgtacgggagacggtcgtagttaactttaacgtcgtacgtacgtacgtactcgtataaccgtaacgaacacgcgaacgacgttaacgttcttaacgtcgaaccgttaggacgtaccgaccgtacggcctaaccgtacgcgtaccgacccgtaccgtacccgaaccgtacctactccgtattaccccg

SEQ ID NO: 51754 - DNA, 610 bp, Homo sapiens
  misc_feature: GYAE6OF01EBKMW.43.14.B03.1.454.CMB.1.raw
  modified_base (137)..(137): a, c, t, g, unknown or other
  misc_feature (137)..(137): n is a, c, g, or t
  modified_base (207)..(207): a, c, t, g, unknown or other
  misc_feature (207)..(207): n is a, c, g, or t
  modified_base (251)..(251): a, c, t, g, unknown or other
  misc_feature (251)..(251): n is a, c, g, or t
  modified_base (289)..(289): a, c, t, g, unknown or other
  misc_feature (289)..(289): n is a, c, g, or t
  modified_base (296)..(296): a, c, t, g, unknown or other
  misc_feature (296)..(296): n is a, c, g, or t
  modified_base (308)..(308): a, c, t, g, unknown or other
  misc_feature (308)..(308): n is a, c, g, or t
  modified_base (487)..(487): a, c, t, g, unknown or other
  misc_feature (487)..(487): n is a, c, g, or t
  modified_base (493)..(493): a, c, t, g, unknown or other
  misc_feature (493)..(493): n is a, c, g, or t
  modified_base (518)..(518): a, c, t, g, unknown or other
  misc_feature (518)..(518): n is a, c, g, or t
  modified_base (529)..(529): a, c, t, g, unknown or other
  misc_feature (529)..(529): n is a, c, g, or t
  modified_base (598)..(598): a, c, t, g, unknown or other
  misc_feature (598)..(598): n is a, c, g, or t
tcagtgtgagtagtcacgaccggtgctcgatttagtgtgagtagttccggcgggggggtctcaggaggcagcgctctcgggacgtctccaccatggcctgggctctgctattcctcaccctctcactcagggcacgngggtcctgggcccagtctgccctgactcagcctgcctccgtgtctgggtctcctggacagtcgatcaccntctcctgcactggaaccagcagtgacgttggtgttactaacgtnttgtctcgtggtaaccaacaacacccgaggaccaaacnccccaancattgtatttgngtatcgtactagtaactccggccgttagtaggggttttctaactcgtcttccgtcgtcggacctccgtaaagttccgtcggaacaaccgtcccggtccctacccgtgaaccctcttcgttcgtcgggtctccgaggcgtagggacgacggaggtctaggtaattaacttcgtcgacgtntacctnaacttactaacgaagactacgctanacttaacgttntacgttacgtcggtaacgtcgacgtaacgtccgaccgactcgtaccacgaccaaccgcccgaaaccccntacgtcctaacc

SEQ ID NO: 51755 - DNA, 697 bp, Homo sapiens
  misc_feature: GYAE6OF01D3HGB.43.14.B03.1.454.CMB.1.raw
  modified_base (206)..(206): a, c, t, g, unknown or other
  misc_feature (206)..(206): n is a, c, g, or t
  modified_base (210)..(210): a, c, t, g, unknown or other
  misc_feature (210)..(210): n is a, c, g, or t
  modified_base (250)..(250): a, c, t, g, unknown or other
  misc_feature (250)..(250): n is a, c, g, or t
  modified_base (317)..(317): a, c, t, g, unknown or other
  misc_feature (317)..(317): n is a, c, g, or t
tcagtgtgagtagtcacgaccggtgctcgatttagtgtgagtagttccgcgggggggtctcaggaggtagcgctctcgggacgtctccaccatggcctgggctctgctattcctcaccctcctcactcagggcacgagggtcctgggcccagtctgccctgactcagcctgcctccgtgtctgggtctcctggacagtcatcaccntccncctgcactggaaccagcagtgacgttggtagttataactntcgtctctggtaccaacacaccaggacaaacgaccccaactcatgtactttatgatgtacagtaacnccggcctcgtagggtttacaatcgtacttctcgtaggctaccaagtctggcaacgacggtccctccctcgacctagtcctcgtacgggtcctacccgaggtccgtacgggacgggaaccgggtacggtaccgttaggtaacttttaacgtttaccgtacgggtactacggtccctacgtaaacttaacgttaacgaacggtaccgaaccgtacgaacgtaccctaaattttacggttacgttaccggtttaaccgggtaaacgttaccggggaacccgtaaacgggttaccgaaccccggtaacgaaccgggttcgaacccggtaccccgaaaccggtcccccaaaacccccgttgtacccggttcctaccgttaccccg

SEQ ID NO: 51756 - DNA, 717 bp, Homo sapiens
  misc_feature: GYAE6OF01CFU9H.43.14.B03.1.454.CMB.1.raw
  modified_base (552)..(552): a, c, t, g, unknown or other
  misc_feature (552)..(552): n is a, c, g, or t
tcagtgtgagtagtcacgaccggtgctcgatttagtgtgagtagttccgcggggggggtctcaggaggcagcgctctcgggacgtctccaccatggcctgggctctgctattcctcaccctcctcactcagggcacagggtcctgggcccagtctgccctgactcagcctgcctcgtgtctgggtctccgtggacagtcgatccacatcctcctgccactggaacccagcaggtcgtacgtttgggtagttaataacttagtgtcctaccgtacggtaacctaaccaaccgacccgaggaccaaaaccgtaccccccaaagtccaataggtaattttacgtaggtatacggttactaaggttaaccgtcccggtaccccgtttaggtacggggttttacttaacgtccgttcttccgtccgtgtcctaccgtagtcgcggacaaccgccgtccctccgtagacctatcctacgtcggtcctccggacgcgtaggacggacgtacggtcgtacgttaacttacgttacgcgactacgtctactaaccgttaanaaccgaagacctacgaactaccgttacttaacgtttgtccgttaaccggttaccggaacggtaccggtaaccgaaccggttacccgtaccgtaacggttacccggactaccccggaacccgtaacccggacccctaaacccggtacttcgtaacccctaccccgg

SEQ ID NO: 51757 - DNA, 510 bp, Homo sapiens
  misc_feature: GYAE6OF02HME2A.43.14.B03.1.454.CMB.1.raw
tcagtgtgagtagtcacgaccggtgctcgatttagtgtgagtagttccgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaatcatgatttatgatgtcagtaatcggccctcaggggtttctaatcgcttctctggctccaagtctggcaacacggcctccctgaccatctctgggctccaggctgaggacgaggctgattatactgcagctcatatacaagcagcagcacttatgtcttacggaactgggaccaaggtcaaccgtacctaggtcagcccaaggcccaacccactcgctaccg

SEQ ID NO: 51758 - DNA, 500 bp, Homo sapiens
  misc_feature: GYAE6OF02JJWE6.43.14.B03.1.454.CMB.1.raw
  modified_base (264)..(264): a, c, t, g, unknown or other
  misc_feature (264)..(264): n is a, c, g, or t
  modified_base (316)..(316): a, c, t, g, unknown or other
  misc_feature (316)..(316): n is a, c, g, or t
  modified_base (437)..(437): a, c, t, g, unknown or other
  misc_feature (437)..(437): n is a, c, g, or t
tcagtgtgagtagtcacgaccggtgctcgatttagtgtgagtagttccgcgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaanaacaccaggcaaagcccccaaatcatgatttatgatgtcagtaatcggcctnaggggtttcaatcgcttctctggctccaagtctggcaacacggcctcctgaccatctctggctcaggctggagacgaggctgattagtactgcagctcatatacaagcagcagtcacttangtacttcggaactgggacctaaggtcacgactaggtcagcccaaggccaacccactcgctacg

SEQ ID NO: 51759 - DNA, 555 bp, Homo sapiens
  misc_feature: GYAE6OF02HSJW0.43.14.B03.1.454.CMB.1.raw
  modified_base (117)..(117): a, c, t, g, unknown or other
  misc_feature (117)..(117): n is a, c, g, or t
  modified_base (311)..(311): a, c, t, g, unknown or other
  misc_feature (311)..(311): n is a, c, g, or t
  modified_base (370)..(370): a, c, t, g, unknown or other
  misc_feature (370)..(370): n is a, c, g, or t
  modified_base (477)..(477): a, c, t, g, unknown or other
  misc_feature (477)..(477): n is a, c, g, or t
tcagtgtgagtagtcacgaccggtgctcgatttagtgtgagtagttccgcgggggggggtctcaggaggcagcgctctcgggacgtctccaccatggcctgggctctgctattcccnccaccctcctcactcaggacacgagggtccgtgggcccgagtacgtcggccctagaacgtcagcctgcctccgtgtctgggtctcctggacagtcgatcaccatctcctgcactggaaccagcagtgacgttggtggtataactatgtctctggtacaacaacaccaggcaaacgccccaaactcatgtattangatgtcagtaatcggcctgagggtttctaatcgtcttctctgctcaagtctggacaacncggtcctccctagaccatcgtcgtcgggcttccgaggctaggacggaccgagtctaggtattagttactgctacgctacgattacacaagacagcagactacttagngtctacgacgtcggacacggtccaaccgacgtagactaccgacccgtaacggacccctaaccctacgtacgctaaccg

SEQ ID NO: 51760 - DNA, 526 bp, Homo sapiens
  misc_feature: GYAE6OF02JFPFB.43.14.B03.1.454.CMB.1.raw
  modified_base (245)..(245): a, c, t, g, unknown or other
  misc_feature (245)..(245): n is a, c, g, or t
tcagtgtgagtagtcacgaccggtgctcgatttagtgtgagtagttccgcgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttanaactatgtctcctggtaccaacaacacccaggcaaagcccccaaatcatgatttatgatgtcagtaatcggccctcagggtttctaatcgcttctctggctccaagtctggcaacacggcctccctgaccatctctggctcaggctgagacgaggctgattattactgcagctcatactacaagcagcaagcacttatgtcttacggaacttgggaaccaaggttccaaccgacgtacggtcaacggtacccaaggaccccaaccccgactcgtctaaccg

SEQ ID NO: 51761 - DNA, 553 bp, Homo sapiens
  misc_feature: GYAE6OF02HVCL3.43.14.B03.1.454.CMB.1.raw
  modified_base (414)..(414): a, c, t, g, unknown or other
  misc_feature (414)..(414): n is a, c, g, or t
tcagtgtgagtagtcacgaccggtgctcgatttagtgtgagtagttccgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacaccaggacaaagcccccaaatcatgatttatgatgtcagtaatcggccctcgtaggggtttctaatcgcttctctggctcagtctggcaacacggcctcctgaccatctctgggctccaggctgaggacgagctgattatacngcagctacatataacaagcagcagcactttatcgtacttacaggtactacggggaacctaagggtccaaacccggtaccgttaacggtccaacggacccccgaaacgggacccccaaaccccgtacgtacggtaacccc

SEQ ID NO: 51762 - DNA, 500 bp, Homo sapiens
  misc_feature: GYAE6OF02GVBB1.43.14.B03.1.454.CMB.1.raw
  modified_base (364)..(364): a, c, t, g, unknown or other
  misc_feature (364)..(364): n is a, c, g, or t
  modified_base (428)..(428): a, c, t, g, unknown or other
  misc_feature (428)..(428): n is a, c, g, or t
  modified_base (494)..(494): a, c, t, g, unknown or other
  misc_feature (494)..(494): n is a, c, g, or t
  modified_base (497)..(497): a, c, t, g, unknown or other
  misc_feature (497)..(497): n is a, c, g, or t
tcagtgtgagtagtcacgaccggtgctcgatttagtgtgagtagttccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaacgcccccaaactcatgatttatgatgtcagtaatcggccctgaggggtttctaatcgcttctctggctccaagtctggcaacncggcctccctgaccatctctgggctccgaggctggaggacgaggctgatttatactgacagctnatatacaagcagcagctattatgtctcgactggaccaggtcaccgctagcagccaggcccaacccntcncac

SEQ ID NO: 51763 - DNA, 560 bp, Homo sapiens
  misc_feature: GYAE6OF02GKAKQ.43.14.B03.1.454.CMB.1.raw
  modified_base (251)..(251): a, c, t, g, unknown or other
  misc_feature (251)..(251): n is a, c, g, or t
  modified_base (362)..(362): a, c, t, g, unknown or other
  misc_feature (362)..(362): n is a, c, g, or t
tcagtgtgagtagtcacgaccggtgctcgatttagtgtgagtagttccgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactntgtctctggtaccaacaacaccaggcaaacgcccccaaactcatgatttatgatgtcagtaatcggccctcgaggggtttctaatcgcttctctggctcagtctgacaacncggcctcctgaccatctcgtgggctccgaggctggaggacgaggctagtattacttacgtgcagtcctacattactaacaagcacgcacgtactaacttatcgttacgttacggaacgtcggaaccgtaggtccaaccgtaccgtaaggtccaacggacccgaacggacccctaaccccgactaccgtacctaacccg

SEQ ID NO: 51764 - DNA, 598 bp, Homo sapiens
  misc_feature: GYAE6OF02I2AUJ.43.14.B03.1.454.CMB.1.raw
tcagtgtgagtagtcacgaccggtgctcgatttagtgtgagtagttccgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacaacacccaggcaaacgcccccaaaactcatgaattactgatgtacagtaatccggcctcgtacggggtttactaatcgacttctctggctctaagtctggacaacacggcctcctgaccatctcgtggcctcgagctaggacggacgacggtctagtattattactgacgacgtctactataactaacaagacagaccaagactacttactcgttaccgtacggtaacgtcgggtaaccgtaacggtccgtaacccggtaaccgtacgggtaccgtaacgaaccccggaacggacccccaaaccccgtacgttaccggtaccctaacccgg

SEQ ID NO: 51765 - DNA, 559 bp, Homo sapiens
  misc_feature: GYAE6OF02GKWUB.43.14.B03.1.454.CMB.1.raw
tcagtgtgagtagtcacgaccggtgctcgatttagtgtgagtagttccgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacaacacccaggcaaacgcccccaaactcatgatttatgatgtcagtaatccggcctcgtacgggtttctaatcgtcttctctggtctcaagtctgacaacgacggcctacctcgaccactctcgtgggctccgaggctagaggacgaggctgtattacttactgctagtctcattaactacgaagacacgacacgtactacttagtcgtacgttacggacgttaggaccgtaagtccgaaccgtacgtaggaccaacgacccgaacgaccccaaccctacgtccgtctaaccg

SEQ ID NO: 51766 - DNA, 657 bp, Homo sapiens
  misc_feature: GYAE6OF02IWXWC.43.14.B03.1.454.CMB.1.raw
  modified_base (225)..(225): a, c, t, g, unknown or other
  misc_feature (225)..(225): n is a, c, g, or t
  modified_base (315)..(315): a, c, t, g, unknown or other
  misc_feature (315)..(315): n is a, c, g, or t
tcagtgtgagtagtcacgaccggtgctcgatttagtgtgagtagttccgcgggggggggtctcaggaggcagcgctctcgggacgtctccaccatggcctgggctctgctattcctcaccctcctcactcaggcacagggtcctgggcccagtctgccctgactcagcctgcctccgtgtctgggtcctcctggacagtcgatcaccatctctgcactggaaccngcagtgacggttggtaggttaataacgtatcgtctcctacggtaccaacaaccacccaggaccaaacgacccccaaactcaatgatttangtatgtcagtaacgtccggcctcggtagggtttctaatcgtcttctccgtggacctacgagttcgtgacctaacgaccggtcccctacccgtacgtaccctaacgttccgtacgtcggggtccttaccgaggtacgtagggacgggtacggtacggtacgtagttaacgttacttacgtcgactagacgtacattaacgactaaacgacgtacgactacgacgttaccttagttacgttaccgttaacggaaccgtacgggtaaccgaacggttccgaacccgtaccgtacgacgtaaccgaacccgaaccgaacccgtacccctaacgtcgtcctaacccg

SEQ ID NO: 51767 - DNA, 671 bp, Homo sapiens
  misc_feature: GYAE6OF02IDPCX.43.14.B03.1.454.CMB.1.raw
tcagtgtgagtagtcacgaccggtgctcgatttagtgtgagtagttccgcggggggggggtctcaggaggcagcgctctcgggacgtctccaccatggcctgggctctgctattcctcaccctcctcactcagggcacagggtcctgggcccagtctgccctgactcagcctgcctcgtgtctgggtctctgacagtcgatcaccatctcctgcactgggaaccagctagtgacgttggtaggttataactatcgtctccgtagtaaccaaacaacaccaggacaaaacgaccccaaactcacttagaactttagtacgaagttcgtacaagtacgtccgtccgttagtacgggttactaatcctctactctacggtctacgtaacgtcgtagacaaacgccggtcctaccgtagaccttaactcgtacgtggacctacggtacgtcgtaggaacggacggtacgacgttaataattttactacgtacgactacgaccttaacgttataaacgttaacgaacgacgtactacggaacctactttaactttacgtacgttaaaccggttccggaaaacggttcgggtaaaaccggtacggttaacccaaaccggtacgtaacgtacccgaaggaccccacgaaacccctaacccggcttaccggccttaccg

SEQ ID NO: 51768 - DNA, 702 bp, Homo sapiens
  misc_feature: GYAE6OF02GMD7K.43.14.B03.1.454.CMB.1.raw
  modified_base (225)..(225): a, c, t, g, unknown or other
  misc_feature (225)..(225): n is a, c, g, or t
  modified_base (308)..(308): a, c, t, g, unknown or other
  misc_feature (308)..(308): n is a, c, g, or t
tcagtgtgagtagtcacgaccggtgctcgatttagtgtgagtagttccgcgggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccngcagtgacgttggtgttaataactagtcgtctcgtacggtaaccaaccaaccacccgaggaccaaaccgacccccaaatcatntatttagtagatcgtacagtactccggtcctcgtacgggtttactacgtccgtcttacgtccgtcgtacctaccgagttcgtacggaccctaacgtaccggtccctacccgtacgtacccgtacgttcccgtccggttacggggtcctacccgggtaggtccggtacgggtaacgggtaccggtaagggtccgttaggttaacttttaacgttacgttacggacttacgtcgtaactaattaacgtaacgaacgtcgtaacgtcgtaacggtacttaacgttacgtcgttaccggtaaccgtacggtacgggtaaccgtacgggtaacccgtaccgtacgtacggtaccaccgtacccgaccggtacccctaaccctcggtccgtacctaccgg

SEQ ID NO: 51769 - DNA, 586 bp, Homo sapiens
  misc_feature: GYAE6OF02IV8YN.43.14.B03.1.454.CMB.1.raw
  modified_base (132)..(132): a, c, t, g, unknown or other
  misc_feature (132)..(132): n is a, c, g, or t
  modified_base (462)..(462): a, c, t, g, unknown or other
  misc_feature (462)..(462): n is a, c, g, or t
tcagtgtgagtagtcacgaccggtgctcgatttagtgtgagtagttccgcggggggggggtctcaggaggcagcgctctcgggacgtctccaccatggcctgggctctgctattcctcaccctcctcactcngggcacagggtcctgggcccagtctgccctgactcagcctgcctccgtgtctgggtctcctggacagtcgatcaccatctcctgcactggaaccagcagtgacgttggtggttaataactatgtctcctaggtaccaaacaacacccaaggaccaaacgacccccaaactcatgtaatttatgatgtacagtaactcggccctacgtacggggtttactaagtcgtcttctctggtctacagtctcggacaacgcggtcctccctcgacctatctcgtgggcctacgagctggacggacgagtctagtattatactgcagtctcatacanaacgcagcagtctaactttagtcgttactacgggtaacgtacgggtaactacggtcctaaccggtacgtacggtaccacggtacccgaacggtacccaacccgtaacgttaccgtacctacccg

SEQ ID NO: 51770 - DNA, 715 bp, Homo sapiens
  misc_feature: GYAE6OF02H8LD0.43.14.B03.1.454.CMB.1.raw
tcagtgtgagtagtcacgaccggtgctcgatttagtgtgagtagttccgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcacgtcggaaccagcgagtgtacggttggtaggtttaataactagtcgttctccgtggtaaccaacaaccaccaaggacaaacgacccccaaactcatagtactttatgtatgactagtaactccggccctggtacgggtttactacgtcgtcttcttcgtcggcctacgtaacgtcgtacggaccaaaccgaccggtccctaccgtacggaccctacttccgttccggtcggggtaccctacccggtacgggtaccgtagggtaccgggaacggtacgggtcttaggttactttaagttacgcgtactacgtacttactataaccgtaaacgtaacgaccgagtacgaacgtacgtttaactttaaggtcgttaaccgttacggtacggtacccgggtaaccgtaaccggtcccgtaaccgaaccggttacccggtaacgaacccggtacccggaaaccgggtaccccaacccgttacccgtacctacccgttaaccccg

SEQ ID NO: 51771 - DNA, 524 bp, Homo sapiens
  misc_feature: GYAE6OF02JG4CI.43.14.B03.1.454.CMB.1.raw
  modified_base (410)..(410): a, c, t, g, unknown or other
  misc_feature (410)..(410): n is a, c, g, or t
  modified_base (429)..(429): a, c, t, g, unknown or other
  misc_feature (429)..(429): n is a, c, g, or t
tcagtgtgagtagtcacgaccggtgctcgatttagtgtgagtagttccgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctctgtaccaacaacaccagcaaagcccccaaatcatgatttatgatgtcagtaatccggcctcgtaggggtttctaatcgtcttctctcggctccaagtctggacaacgacgccctcctgacctatctcgtgggcctccgaggctggacggacgngctagtacttatactgacngtctctatacacaagcagcagactacttatcgtctacgacgtggaaccaggtccacgactacgcacgccgacgacccaaccctagtcgacctacg

SEQ ID NO: 51772 - DNA, 634 bp, Homo sapiens
  misc_feature: GYAE6OF02GAGNU.43.14.B03.1.454.CMB.1.raw
  modified_base (226)..(226): a, c, t, g, unknown or other
  misc_feature (226)..(226): n is a, c, g, or t
  modified_base (360)..(360): a, c, t, g, unknown or other
  misc_feature (360)..(360): n is a, c, g, or t
tcagtgtgagtagtcacgaccggtgctcgatttagtgtgagtagttccgcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcctggtaccaacaacaccaggcaaacgcccccaactcaatgtatttatgatcgtcagtaactcggccctcgtagggtttctaatcgcttctcgtgctccaagtcngacaacaccggtcctccctacacctatcctccgtcggggtcctacccgagcgtaggaggaccggaggtcgttaggtactttaacttaccgtgaccagttcctacgtaataacttaacgaagtaccgaagccaaggtacctaacgtttagtcggttacgttaacgggtaacgtaccggaaccgtaaggggtccctaacccggtaccggtaacggtaccgaacccgtaacccgtaaccggaccccctaaacccgtccttacgtaccccttacccgg

SEQ ID NO: 51773 - DNA, 693 bp, Homo sapiens
  misc_feature: GYAE6OF02IAR2Y.43.14.B03.1.454.CMB.1.raw
  modified_base (212)..(212): a, c, t, g, unknown or other
  misc_feature (212)..(212): n is a, c, g, or t
  modified_base (233)..(233): a, c, t, g, unknown or other
  misc_feature (233)..(233): n is a, c, g, or t
  modified_base (262)..(262): a, c, t, g, unknown or other
  misc_feature (262)..(262): n is a, c, g, or t
  modified_base (332)..(332): a, c, t, g, unknown or other
  misc_feature (332)..(332): n is a, c, g, or t
tcagtgtgagtagtcacgaccggtgctcgatttagtgtgagtagttcgcgggggggtcgtcaggaggcagcgctctcgggacgtctccaccatggcctgggctctgctattcctcacctcctcactcaggcacacgggtcctcgggcccagtctcgccctgacctcacgctcgccctccggtgtctcgggtctccgaggacagtcgatcacngtctcctgcacgtggaaaccngcaggtgtaccggtttggtacggtttaanaaccgttatcgttctcccgttaggttaaaccaacaaaccaccgaggaccaaaacgacccccctaaactanacttacgtaactttataggtaactgtactaagtaacgtcggccccttaggtacggggtttactaacgtcgtcttcgtagtcggtcctacctaagttcgacgtacaacgccggtaccctcgtacgaccattcgtcgtcggaccttcgaggtcctaggacggaacgtcgggactggtaactttactcggtcgactacgtaccttacgattaacgacgtaaacgcgactacgggacacgttacttcgtagtaccgttaacgtaccgacggggtaacctaccggaaccgtttaaccgacgtttacggaacccacgggtaaccccaacgggtaccccctaaacccgtacggttcctaactcccggg

SEQ ID NO: 51774 - DNA, 846 bp, Homo sapiens
  misc_feature: GYAE6OF02GGHRW.43.14.B03.1.454.CMB.1.raw
tcagtgtgagtagtcacgaccggtgctcgatttagtgtgagtagttccggcggggggggggtctcaggaggcagcgctctcgggacgtctccaccatggcctgggctctgctattcctcaccctcctcactcagggcacagggtcctgggcccagtctcgccctgactcagcctgcctccgtgtcgtgggtctcctggacagtcgactcaacctatcctcctgacctacgtacggaacccagcagtggacggtttgggttaggttaactaactatgttcctccgtaggtaacccaacaacctaccgaggacaaacgaccccccaaactcaatgtaactttagtagtacttaggtactagtaacgtccggtcccttacggtacggggttttactaatccgtacttctacgttcggaccttccgtaaacgttccgttacggacccgtaaaccgtacccggtcccttacccgtacgaacccgtacgtttaccgtcggttcgggtcccttaacccggaaggtccggttacgggacgggtaaccgggtacgggtacttaacgggttaacttttaaccggtttaaccgtccgtacgtaacccgttaccgtaaccgtaattaacctaaaacggtaacggtactaaacgggtcccgaaaacgtttcccttaaacgtttacgtttaggtttacccgtttaaacgggggaaaccgttttaccgggggaaaccctaacggggttaaccccgaaacccggtttaaccggtaacccgggttactaaaccccgggaaccccgtacccgggtaaaccccccgttaaaccccgtacggttaccccgttacgttaccccccgg

SEQ ID NO: 51775 - DNA, 694 bp, Homo sapiens
  misc_feature: GYAE6OF02JMTCV.43.14.B03.1.454.CMB.1.raw
  modified_base (255)..(255): a, c, t, g, unknown or other
  misc_feature (255)..(255): n is a, c, g, or t
  modified_base (436)..(436): a, c, t, g, unknown or other
  misc_feature (436)..(436): n is a, c, g, or t
tcagtgtgagtagtcacgaccggtgctcgatttagtgtgagtagttccgcgggggggggtcgtcaggaggcagcgctctcgggacgtctccaccatggcctgggctctgctattcctcaccctcctcactcagggcacagggtcctgggcccagtctgccctgactcagcctgcctccgtgtctcgggtctcctggacagtcgatccaccatctctgcactcggaaccagcagtgacgttgggtgttaataactntcgtctccgtgtaccaacaacaccacgacaaacgcccccaaatccatactattttacgagtatagtctaacgtaacgtccgtccgtacgttacggggtttactaacgttcgtaccttctcgtacgtctaccgtaagtcgtacgtactaaccggaccggtcccttacccgactaaacccgtnttcccgtacgtccgggtacctacccggtacggtccgtaagggaaccgggtaacggtacgggtacgttaacgtaagttttaccgtaacgtacgtacgacgttactacgtaataacgttaacaaggtccagacctagccgttattaacgtgttaccgttagtaaccgtaggaaccgtacggtacccggaaccgtacgtacggtaaccaccggaacccgtaaccgggccccctaaaccggaccgttaccgtacccgtaccg

SEQ ID NO: 51776 - DNA, 710 bp, Homo sapiens
  misc_feature: GYAE6OF02HYFIR.43.14.B03.1.454.CMB.1.raw
  modified_base (245)..(245): a, c, t, g, unknown or other
  misc_feature (245)..(245): n is a, c, g, or t
  modified_base (420)..(420): a, c, t, g, unknown or other
  misc_feature (420)..(420): n is a, c, g, or t
  modified_base (701)..(701): a, c, t, g, unknown or other
  misc_feature (701)..(701): n is a, c, g, or t
tcagtgtgagtagtcacgaccggtgctcgatttagtgtgagtagttccgcggggggggggtctcaggaggcagcgctctcgggacgtctccaccatggcctgggctctgctattcctccaccctctcactcaggcacgagggtcctcgggcccagtctcgccctagacctcgacgcctcgcctcgtgtcgtgggtcctccgtggacacgtcgactcacctacttctcctgacacgtacggaaccncgacgaggtcgtacggttggttaggttaataactagtcgtccttaccgtacggtaaaccaacgtaaccaacccgaaggaccaaaaccgacccccgaaactcgaagttagtactttagtgacgtagtacaacgttaccgccgtaccgtcggtaacggtttactaacgtcgacttcncgtacgctacctagcgtagaccaacgaccgtcctaccgtactaccgtactcgtccggtacggtacctcggaacgtcgtaggaacgggtaacgtcggtattagttaacgttacgtacgtcgtaccgtaactcgtaaactaccgaagtacaaacggtacctacgacgtaaccgtcttaaaccggtttatcggttaacgttaaccggaaggttacccggaagtaacgggtccctaacgacggtccgtacgaacccgacggaaccgaaccccaaccgtgttaccnccttaaccg

SEQ ID NO: 51777 - DNA, 743 bp, Homo sapiens
  misc_feature: GYAE6OF02GA5BA.43.14.B03.1.454.CMB.1.raw
  modified_base (326)..(326): a, c, t, g, unknown or other
  misc_feature (326)..(326): n is a, c, g, or t
tcagtgtgagtagtcacgaccggtgctcgatttagtgtgagtagttccgcggggggggggtctcaggaggcagcgctctcgggacgtctccaccatggcctgggctctgctattcctccaccctcctcactcaggcacagggtcctgggcccagtctgccctgactcagcctgcctccgtgtcgtcgggtctccgtaggacagtcgactcaccatctcctgactacgtcggaaaccagcaggtcgtacggttggtaggttaataactatcgtactcctaggtaaccaaacaacaccagacaaacgaccccaatcatcgaattacgngatgtactaagtacgtaccggcctacgtacgggtttactaacgtcgttattcgtctcggactactaagtcacgtacaaccgtacggacccctccgtaacgacctacttccgtacggtacgggccttacccgacgggtacgtagggtaacgggaacgaccggtacgttagttaaacgtttacttaacggtaccgtaacggtcgtacctaaccgtaaaacttaaccggtaaacgaaaccggtccgtaaccgagtacgtaaccctttaaggttaaccttaccggttaaccggtaacgggtacgggttaaccgggaaacccgtaaccggggtaacctaaacccggtaaccgttaacgacccgtaacccgtaacccggaacccgaaccctaaccccgtaggtttaacccggcccttaacccg

SEQ ID NO: 51778 - DNA, 752 bp, Homo sapiens
  misc_feature: GYAE6OF02FZZF2.43.14.B03.1.454.CMB.1.raw
  modified_base (563)..(563): a, c, t, g, unknown or other
  misc_feature (563)..(563): n is a, c, g, or t
tcagtgtgagtagtcacgaccggtgctcgatttagtgtgagtagttccgcgggggggggtctcaggaggcagcgctctcgggacgtctccaccatggcctgggctctgctattcctcaccctctcactcagggcacagggtcctgggcccagtctgccctgactcagtccctgcctccgtgtcgtgggtcctcctaggacagtcgatccaacctagttcctccgtgcctacgtacggaacctagctaacggtgacggtttggtgtaactaactctgtctacgtcgtaccaacaaccaccgagaccgaaaccacccctaactctaatcgtaattagtacgtagtcgtacgaagtaacgttccggacccctggttaacgggtttacaacggttcgtaccttctccgtcgccttaccgtagttcgacgtaccaccgccgtacccttccacgtacctacgttccgtacggtcggccttacggtcggtcgtacggacggacgtacggtacgttacttacgttacttaccgcggtactacgtcttaactactaaccgtaacaaccggtnaccggtaacgtacgttaacgttaacgtttaccgtaacggtttcccggtaaacgttaccgggttaacccggaacccggtaagggttaaccccgtaacccgtaaccggtttaaacggacccgttaacccggaaccccgggttaacccgaaaccccttaaccccgttcggtaacccgtccccgttaacccgg

SEQ ID NO: 51779 - DNA, 764 bp, Homo sapiens
  misc_feature: GYAE6OF02IBF2F.43.14.B03.1.454.CMB.1.raw
  modified_base (205)..(205): a, c, t, g, unknown or other
  misc_feature (205)..(205): n is a, c, g, or t
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
tcagtgtgagtagtcacgaccggtgctcgatttagtgtgagtagttccgcggggggggggtctcaggaggcagcgctctcgggacgtctccaccatggcctgggctctgctattcctcaccctcctcactcagggcacgagggtcctgggcccagtctgccctgactcagcctgcctccgtgtctgggtcctcgtgacagtcgancactatctctgacactggaaccngcagtgtacggttggtacggttanaacgtagtcgtactccgtacgtaaccaacaaccaaccgaacggaacctaaaccgaaccccctaaactaccgaacgttacgtaagttttacttaggtacgttacgtaccggtaagttaacgtccggtcccgttaccggttaacgggggtttactaacgtcgtacttcgtcgttacgtaccgtacctaacgttccgtacggaccgtaacgacccggtcctacccgtaccgtaaccgtaccgtccgttaccggtaccgggtccgtaaccggtggtaccggtagggtaaccgggacggtacgtaccggttagtaactttacgttaacggttaccgacgttacgacttacgaactaacgtaaaccgtaacgaaccgtaggtacgttaaacgtttacttacgtttcggttacgttaacggaacgtacgggaaccggtacggtaaccgtactaaccggtacggtaccgaacggacccgacggaacccaaccgttaccggtcgtaccctacgttacccgg

SEQ ID NO: 51780 - DNA, 727 bp, Homo sapiens
  misc_feature: GYAE6OF02GYG0V.43.14.B03.1.454.CMB.1.raw
  modified_base (216)..(216): a, c, t, g, unknown or other
  misc_feature (216)..(216): n is a, c, g, or t
  modified_base (235)..(235): a, c, t, g, unknown or other
  misc_feature (235)..(235): n is a, c, g, or t
  modified_base (263)..(263): a, c, t, g, unknown or other
  misc_feature (263)..(263): n is a, c, g, or t
tcagtgtgagtagtcacgaccggtgctcgatttagtgtgagtagttccgcggggggggggtctcaggaggcagcgctctcgggacgtctccaccatggcctgggctctgctattcctcaccctcctcactcgaggcacgagggtcctgggccctagtctcgccctgactcagtcctgcctccgtgtcgtgggtctctggacaggtcgactcacctntctcctgcacgtggaaccngcaggtgtcgtttggtagttactaactntcgtctcgtcggtaaccaacgaaccaccagaccaaaccgccccaaactcacgtatattacgtagtactcggtactaagtaccgccgtcccgtacggttaacgggtttcacgttcgttccttccgacttcggtcctacgtagtcgtacgaccgaacgtccgtcctaccgtacgtaccctgttccgtacggttccgggtacctacccgggagttccgtagggtaacgggtacggtagggttaccttagggttaaccttttacgtacggtacgtaaccgtcgtaaccgttctaagtaacgtaaccgacgtcgtaaccgtcgtaacgttaccttaacggtttaccgttcggttaccggttacggtacggtacccgtacgggtaccgttacccggaccctaacggtaccggaccgtaaccggaacccggttaacccacccgaacccgttacgttaccgtcctaacccgg

SEQ ID NO: 51781 - DNA, 490 bp, Homo sapiens
  misc_feature: GYAE6OF01BVSM6.18.11.A11.1.454.CMB.1.raw
  modified_base (207)..(207): a, c, t, g, unknown or other
  misc_feature (207)..(207): n is a, c, g, or t
  modified_base (459)..(459): a, c, t, g, unknown or other
  misc_feature (459)..(459): n is a, c, g, or t
tcagtacgagtatgcacgaccggtgctcgatttagctacgactgcagggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctcaacaataacaactacttagcttggtaccagcagaaaccaggacagcccctaaggtcctcatttactgggcatctaccgggagtccgggtcctgaccgattcagagcagcggtctgggacagatttcactctcacatcacaacctgcaggctgaagatgtgcagtttatactgtcagcaatactatagtcctctctcacgttcgcgaggaccaaggtgagatacgaaacgatgtgctgacactatntgtcttcattcctcccgcattctgtactacg

SEQ ID NO: 51782 - DNA, 499 bp, Homo sapiens
  misc_feature: GYAE6OF01A6DWN.18.11.A11.1.454.CMB.1.raw
  modified_base (461)..(461): a, c, t, g, unknown or other
  misc_feature (461)..(461): n is a, c, g, or t
  modified_base (470)..(470): a, c, t, g, unknown or other
  misc_feature (470)..(470): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggctagtttatactgtcagcaatactatagtcctcctctcacgttcggcggaggaccaaggtgagatacaacgactgngctgcaccntctgtcttcattcctcccgcatctgctac

SEQ ID NO: 51783 - DNA, 495 bp, Homo sapiens
  misc_feature: GYAE6OF01EWX81.18.11.A11.1.454.CMB.1.raw
  modified_base (379)..(379): a, c, t, g, unknown or other
  misc_feature (379)..(379): n is a, c, g, or t
  modified_base (447)..(447): a, c, t, g, unknown or other
  misc_feature (447)..(447): n is a, c, g, or t
  modified_base (461)..(461): a, c, t, g, unknown or other
  misc_feature (461)..(461): n is a, c, g, or t
  modified_base (470)..(470): a, c, t, g, unknown or other
  misc_feature (470)..(470): n is a, c, g, or t
  modified_base (472)..(473): a, c, t, g, unknown or other
  misc_feature (472)..(473): n is a, c, g, or t
  modified_base (485)..(485): a, c, t, g, unknown or other
  misc_feature (485)..(485): n is a, c, g, or t
  modified_base (492)..(492): a, c, t, g, unknown or other
  misc_feature (492)..(492): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttatacagctccaacaataacaactacttagcttggtaccagcagaaaccaggacagccccctaagtcctcatttactgggcatcctacccggggagtccggggtccctgaccgattcagaggcagcgggtctgggacagatttcactctcaccatcaccaacctgcaggctgaantgtgctagtttattactgtcagcaatactatacgtcctctctcacgttcggcggaggaccaaggtganatacaaacgactgngctgcacgntnntctcatcctccncatctgntac

SEQ ID NO: 51784 - DNA, 511 bp, Homo sapiens
  misc_feature: GYAE6OF01CVM2F.18.11.A11.1.454.CMB.1.raw
  modified_base (482)..(482): a, c, t, g, unknown or other
  misc_feature (482)..(482): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctaccaacaataacaactacttagcttggtaccagcagaaaccaggacagccccctaaggtcctcatttactgggcatctacccgggagtcccggggtccctgaccgattcagaggcagcgggtctgggacagatttcactctcaccatcaaccaacctgcaggctgaagatgtggctagtttatactgtcagcaatactatacgtcctcctctctacggttcggacggaaggaccaagggtgagatacgaaacgactgtggctgccacntctgtcttcatcttcccgcatctgactac

SEQ ID NO: 51785 - DNA, 492 bp, Homo sapiens
  misc_feature: GYAE6OF01ENUFN.18.11.A11.1.454.CMB.1.raw
  modified_base (466)..(466): a, c, t, g, unknown or other
  misc_feature (466)..(466): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctaccgggagtccggggtccctgaccgattcagaggcagcgggtctgggacagatttcactctcaccatcaccaacctgcaggctgaagatgtggcagtttattactgtcagcaatactatagtcctctctcacgttcggcggaggaccaaggtgagatcaacgactgtgctgcacntctgtctcatctcccgcatctgctac

SEQ ID NO: 51786 - DNA, 504 bp, Homo sapiens
  misc_feature: GYAE6OF01BTDK7.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttatactgtcagcaatactatagtcctcctctcacgttcggacggagggaccaagggtgagatacaaacgtactgtggctgcacatctgtcttcatccttcccgctatctgctac

SEQ ID NO: 51787 - DNA, 714 bp, Homo sapiens
  misc_feature: GYAE6OF01CSSAO.18.11.A11.1.454.CMB.1.raw
  modified_base (177)..(177): a, c, t, g, unknown or other
  misc_feature (177)..(177): n is a, c, g, or t
  modified_base (182)..(182): a, c, t, g, unknown or other
  misc_feature (182)..(182): n is a, c, g, or t
  modified_base (187)..(187): a, c, t, g, unknown or other
  misc_feature (187)..(187): n is a, c, g, or t
  modified_base (206)..(206): a, c, t, g, unknown or other
  misc_feature (206)..(206): n is a, c, g, or t
  modified_base (210)..(210): a, c, t, g, unknown or other
  misc_feature (210)..(210): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagggcgccacnacagnacacncacgcgagtgtttatttanacgntcctaaccaaataaactaaacctaacttacgtacgtcgttacgaaccagacgaaaacgaaaccgaacggaacgaccccgtaaccccgttaacggtccctacttaactttacggcggacctacttaccccgggtaacccgggtacggggtccccgggttccaccggaccgtacttacgagggacgcgacggggtcggtcggtacggacagttacttacaccttcaccaactactaccaaacccttaacgcacggtacgtcgtaaggaagtgttgggtcgacgtttaagttttaacttagtcgtaacgacgtaactaaacttactaaagttccgttcccctccttcctaccgttaccgggttccggggacggggtaaccggaaccggtaagggtaggaagtaccgttaaacggaaaaccgtagtcggggtcgtcgtacgaccctaactacttcgttacgttccttacactttccccgtcccgaccttattccgtagaacttaaccg

SEQ ID NO: 51788 - DNA, 560 bp, Homo sapiens
  misc_feature: GYAE6OF01B5MV6.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactactagcttggtaccagcaagaaaccaggacacgaccccctaaggtcctcatttactgggcatccgtacccgggagtcccggggtccctgaccgattcagaggcaggcgggtctgggacagtatttcactctcaccatccaaccaacctgacaggctagaagatgtggactagttttatactgtacagactaatactatacgtccctcctctcacggttcgggcggacgggaaccgaagggtcggaacgatacgaaacgtacgtggtacggctcgaccaccgtattctacgttccttacacttcccgttccccgcctattcctgacctaacg

SEQ ID NO: 51789 - DNA, 501 bp, Homo sapiens
  misc_feature: GYAE6OF01BBQXD.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctctctcacgttcggcggagggaccaaggtggagatcaaacgactgtggctgcaccgatctgtcttcatcttcccgcatctgctac

SEQ ID NO: 51790 - DNA, 521 bp, Homo sapiens
  misc_feature: GYAE6OF01BU9R8.18.11.A11.1.454.CMB.1.raw
  modified_base (208)..(208): a, c, t, g, unknown or other
  misc_feature (208)..(208): n is a, c, g, or t
  modified_base (484)..(484): a, c, t, g, unknown or other
  misc_feature (484)..(484): n is a, c, g, or t
  modified_base (489)..(489): a, c, t, g, unknown or other
  misc_feature (489)..(489): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaccaggacagccccctaaggtcctcatttactgggcatccgtaccgggagtccgggtccctgaccgattcagaggcagcgggtctgggacagatttcactctcaccatccaccaacctgcaggctagaagatgtggactagttttatactgtacagtcaatactatacgtccctctctctacgttcggacggaggaccaaggtgacgatacaaacgatgtagctcgacaccgnttacngttcttcacttcctcccgctatcctgctaacg

SEQ ID NO: 51791 - DNA, 496 bp, Homo sapiens
  misc_feature: GYAE6OF01CS1LS.18.11.A11.1.454.CMB.1.raw
  modified_base (419)..(419): a, c, t, g, unknown or other
  misc_feature (419)..(419): n is a, c, g, or t
  modified_base (478)..(478): a, c, t, g, unknown or other
  misc_feature (478)..(478): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagagcagcggtctgggacagatttcactctcaccatcagcagcctgcagcctgaagatttgctaacttactattgtcagcaggcgcacaatttcccgntcactttcggcggagggaccaaggtggagatacaagaactgtgctgcacatctgtcttnatcttcccgcatctgaac

SEQ ID NO: 51792 - DNA, 738 bp, Homo sapiens
  misc_feature: GYAE6OF01ARVYB.18.11.A11.1.454.CMB.1.raw
  modified_base (233)..(233): a, c, t, g, unknown or other
  misc_feature (233)..(233): n is a, c, g, or t
tcagtacgagtatgcacgaccggtgctcgatttagctacgactgcgaagggggcaggcaacgatggtgttggctacgacccgtaggttccttctagtttctctgttgcctctggaatctctggtgccgacgggacagtcgttgatgacccagtcgttccagtactccctggtttagtgtcctcgtgggcgagagggccaccatcgaacgtgcaagtccagccagagtgtttanacaggcctcaacataacactacttagcttggtaccagtcgtacgaaacccaggacacggccccctaaaggtccctactagtttacgtcgggctactccgtaaccccggggagttccccggggtacccgtagggacccggagtttccggacgacggctaggtcgggtcgtacgggacaacgtactttcgaaccttccgtaccaaccgtacttcccgaacccgaaacccgtcgacctacggccctaggaacgtacgtggtacggacctaaggttttactaaccgtacgtacaagtacctaaattacctataacgtccctacctcgtacctacggttcgggacgggacgggaacccgaagggtcgggacgtaacttaccgtaaaaccggtacgttcgggtacggaccgttacggaccctaaacccgtaagttcccggttacggttccctttacgaactttccccgtttaccccgacccttagttcccgggtacgaacccgttaacccg

SEQ ID NO: 51793 - DNA, 526 bp, Homo sapiens
  misc_feature: GYAE6OF01BXVLB.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagagcagcgggtctgggacagatttcactctcaccatcaccaacctgcaggctgaagatgtggctagtttattactgtacagacaatactatacgtcctcctctcacgttcggcggacgggaccaagggtggagatacgaaacgactgtcggctgaccaccgattctgttccttacacttccgttccccgcctatcctgactacg

SEQ ID NO: 51794 - DNA, 560 bp, Homo sapiens
  misc_feature: GYAE6OF01BY63Z.18.11.A11.1.454.CMB.1.raw
  modified_base (215)..(215): a, c, t, g, unknown or other
  misc_feature (215)..(215): n is a, c, g, or t
  modified_base (414)..(414): a, c, t, g, unknown or other
  misc_feature (414)..(414): n is a, c, g, or t
  modified_base (437)..(437): a, c, t, g, unknown or other
  misc_feature (437)..(437): n is a, c, g, or t
  modified_base (501)..(501): a, c, t, g, unknown or other
  misc_feature (501)..(501): n is a, c, g, or t
tcagtacgagtatgcacgaccggtgctcgatttagctacgactgctaggggtcgagcaagactggtgttgcagacccaggtcttcattctctggttcgctctggatctcgtggtgccgacgggacatcgtgatcgacccagtctccagactccctggttcgtgtctctgggcgagagggccaccatcaactgcaagtccagccagagtgttttanaccagctccaacaacgtaacaactactagcttggtaccagcagaaacctaggaccagccccctaaggtcctcatttaactgggcatcctaccgggagtccggggtcctgaccgattcgagagcacgcgggtctgggacaggtagtttccactctcaccatcaccaactgcaggctggaagatgtcgctagtttatactntcagcaatctatacgtcctcctntctacgttcgggacgtaggtaccagggtgagtatacaaacgtactggtacgtctcgactaccgngtccgtacggtccttacgaacttcccgttaccccgactaagttccgtacgtacctaacg

SEQ ID NO: 51795 - DNA, 501 bp, Homo sapiens
  misc_feature: GYAE6OF01E1BME.18.11.A11.1.454.CMB.1.raw
  modified_base (283)..(283): a, c, t, g, unknown or other
  misc_feature (283)..(283): n is a, c, g, or t
  modified_base (449)..(449): a, c, t, g, unknown or other
  misc_feature (449)..(449): n is a, c, g, or t
  modified_base (472)..(472): a, c, t, g, unknown or other
  misc_feature (472)..(472): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttacngggcatctacccgggagtcccggggtccctgaccgattcagaggcagcgggtctgggacagatttcactctcacatcaccaactgcaggctagaagatgtggctagtttattactgtcagcaatactatacgtcctcctctcacgttcggcggaggaccaggtganatacaaacgatgtgctgcacatntgtcttcacttcctcccgcatcctgctac

SEQ ID NO: 51796 - DNA, 501 bp, Homo sapiens
  misc_feature: GYAE6OF01EAU2G.18.11.A11.1.454.CMB.1.raw
  modified_base (476)..(476): a, c, t, g, unknown or other
  misc_feature (476)..(476): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcggtctgggacagatttcactctcacatcaccaacctgcaggctgaagatgtggctagtttattactgtcagcaatactatagtcctcctctcacgttcggcggagggaccaaggtggagatacgaacgactgtggctgcacgatcngtcttcatcttcccgcatctgctac

SEQ ID NO: 51797 - DNA, 492 bp, Homo sapiens
  misc_feature: GYAE6OF01BK51N.18.11.A11.1.454.CMB.1.raw
  modified_base (208)..(208): a, c, t, g, unknown or other
  misc_feature (208)..(208): n is a, c, g, or t
  modified_base (456)..(456): a, c, t, g, unknown or other
  misc_feature (456)..(456): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaccaggacagccccctaaggtcctcatttactgggcatcgtaccgggagtccgggtcctgaccgattcagagcagcggtctgggacagatttcactctcaccatcaccaactgcaggctgaagatgtgctagtttatactgtcagcaatactatacgtcctctctcacgttcggcggaggaccaaggtgagatacaaacgactgngctgcacatctgtctcatcctccgctatctgactac

SEQ ID NO: 51798 - DNA, 513 bp, Homo sapiens
  misc_feature: GYAE6OF01BCMWC.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatccaccaacctgcaggctgaagatgtggcagtttattactgtcagcaatactatagtcctcctctcacgttccggcggacgggaccagggtggagatacgaaacgactgtggctggaccaccgtatctgtcttcattcctcccgcatctgactac

SEQ ID NO: 51799 - DNA, 585 bp, Homo sapiens
  misc_feature: GYAE6OF01APO84.18.11.A11.1.454.CMB.1.raw
  modified_base (208)..(208): a, c, t, g, unknown or other
  misc_feature (208)..(208): n is a, c, g, or t
  modified_base (286)..(286): a, c, t, g, unknown or other
  misc_feature (286)..(286): n is a, c, g, or t
  modified_base (360)..(360): a, c, t, g, unknown or other
  misc_feature (360)..(360): n is a, c, g, or t
  modified_base (388)..(388): a, c, t, g, unknown or other
  misc_feature (388)..(388): n is a, c, g, or t
tcagtacgagtatgcacgaccggtgctcgatttagctacgactgcagggcagcaagatggtgttgcagacccaggtcttcatttctctgttgctctggatctctggtgccgacggggacatcgtgatgacccagtctccagactccctggttgtgtctctgggcgaggaggcgaccagtcaactgcaagtccagccagagtgttttanacagctccaacaataacaactacttagcttggtaccagcaagaaccaggacacgccccctaaggtcctctatttacgngggcagtccgtacccgggagtcccggggtcctgaccgattcgagagcaggcggtctgggacagtattcacttcncaccatccaccaacctgcaggctgaagntgtggactagtttatacgtgtacagactaatactaatacgtcctaccgtctacgtacggtttcgggacgggtaacgggaccgaagggtcggaagtaactacgaaacggtacgtggtcggtctacggaccacccgtagttccgtaggttcccttacacgtttaccccttccccggactaacttcctggaaccttaacg

SEQ ID NO: 51800 - DNA, 508 bp, Homo sapiens
  misc_feature: GYAE6OF01CZ4WP.18.11.A11.1.454.CMB.1.raw
  modified_base (474)..(474): a, c, t, g, unknown or other
  misc_feature (474)..(474): n is a, c, g, or t
  modified_base (502)..(502): a, c, t, g, unknown or other
  misc_feature (502)..(502): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttatacagctccaacaataacaactacttagcttggtaccagcagaaaccaggacacgcccctaaggtcctcatttactgggcatccgtacccgggagtcccgggtcctgaccgattcagaggcagcgggtctgggacagtatttcactctcaccatccaccaacctgacaggctagaagatgtggctaagtttatactgtcagcaatactatacgtcctcctctcacgttcgggcggaaggaccaaggtggagatacaaacgatgtggcngcaccatctgtctcatcctcccgcatcngactac

SEQ ID NO: 51801 - DNA, 503 bp, Homo sapiens
  misc_feature: GYAE6OF01EURW4.18.11.A11.1.454.CMB.1.raw
  modified_base (208)..(208): a, c, t, g, unknown or other
  misc_feature (208)..(208): n is a, c, g, or t
  modified_base (473)..(473): a, c, t, g, unknown or other
  misc_feature (473)..(473): n is a, c, g, or t
  modified_base (475)..(475): a, c, t, g, unknown or other
  misc_feature (475)..(475): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaccaggacagccccctaaggtcctcatttactgggcatctacccgggagtccggggtccctgaccgattccagaggcagcgggtctgggacagatttcactctcaccatcaccaacctgcaggctagaagatgtgctagtttattactgtcagcaatactatacgtcctcctctcacgttcggcggaggaccaagggtgagatacaacgactgtgctgcacntntgtcttcatccttcccgctatctgctac

SEQ ID NO: 51802 - DNA, 519 bp, Homo sapiens
  misc_feature: GYAE6OF01DJ5D9.18.11.A11.1.454.CMB.1.raw
  modified_base (448)..(448): a, c, t, g, unknown or other
  misc_feature (448)..(448): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttatacagctccaacaataacaactacttagcttggtaccagcagaaaccaggacagccccctaaggtcctcattactgggcatcgtacccgggagtccggggtcctgaccgattcagaggcagcggtctgggacagatttcactctcaccatccaccaacctgcaggctgaagatgtggctagtttatactgtcagcaatactatagtcctcctctcacgttcggcgagggaccaagggtgganactacaaacgactggtacgctagccaccgtattcctagtccttcacttccttccccgctatcctgactacg

SEQ ID NO: 51803 - DNA, 517 bp, Homo sapiens
  misc_feature: GYAE6OF01CT9LF.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatcctacccgggagtcccggggtccctgaccgattcagaggcagcgggtctgggacagatttcactctcaccatccaaccaacctgacaggctgaagatgtgctagtttatactgtcagcaatactatacgtcctctctcacgttcggcggaaggaccaaggtggagactacaaacgactggtggctgcaccatcgtgtccttcattccttcccgactattcctgactac

SEQ ID NO: 51804 - DNA, 608 bp, Homo sapiens
  misc_feature: GYAE6OF01ADCF6.18.11.A11.1.454.CMB.1.raw
  modified_base (209)..(209): a, c, t, g, unknown or other
  misc_feature (209)..(209): n is a, c, g, or t
  modified_base (292)..(292): a, c, t, g, unknown or other
  misc_feature (292)..(292): n is a, c, g, or t
  modified_base (507)..(507): a, c, t, g, unknown or other
  misc_feature (507)..(507): n is a, c, g, or t
tcagtacgagtatgcacgaccggtgctcgatttagctacgactgcagggcagcaagatggtgttgcagacccaggtcttcatttctctgttgctctggatctctggtgccgacgggacatcgtgatgacccagtctccagactccctggttgtgtctcgtggtcgagagggccaccatcaactgacaagtccagccagtagtgttttanacagctaccaacaataacaactacttagcttggtaccagacaacgaaaccaggaccacgtacccctaagtcctactattacgnggacacgtccgtaccgggacgtcccgggtcctagaccgtatcgaggacggcgaggcggtacgtgggactagtacttcactcacaccataccaccactgacgaggctagagtagttgtagtacttagttttactacgtagtacgaacgtactaacttactacgttccgtccctcgtacctcgtacggttcgggacggtacggaaccgaggtcgaanactaacgtaacgacgtggtcgacttaccgacgtaacctagttcccgtagttcccttaccactttccccgtacccggacttatccgttagaccttaacccgg

SEQ ID NO: 51805 - DNA, 517 bp, Homo sapiens
  misc_feature: GYAE6OF01CMM76.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaggtcctcatttactgggcatcctacccgggagtcccggggtccctgaccgattcagaggcaggcgggtctgggacagatttcactctcaccatcaccaacctgcaggctgaagatgtgctagtttatactgtcagacaatactatagtccctcctctctacgtcggacggacggaccaagggtggagatacgaaacgactgtggctgcaccgatctgtccttcacttccttcccgcatctgactacg

SEQ ID NO: 51806 - DNA, 503 bp, Homo sapiens
  misc_feature: GYAE6OF01BS3VN.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaactgcaggctagaagatgtggctagtttatactgtcagcaatactatacgtcctcctctcacgttcggcggaggaccaagggtgagatcgaaagactgtgctgcacgatctgtcttcattcctcccgctatctgactac

SEQ ID NO: 51807 - DNA, 579 bp, Homo sapiens
  misc_feature: GYAE6OF01B76UW.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttatacagctcaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctagaagatgtggactagttttaattactgttacacgtacaattacttagtacgtcccttcctctccgtacggtttccgggacgggaacggtaaccgaaggtaggaacgattaaccgaaacggtacttacggtacggtctacgaccaaccgtatccgtgttccttactacttcccgttccccacctacgtacgacctacgttaacccg

SEQ ID NO: 51808 - DNA, 495 bp, Homo sapiens
  misc_feature: GYAE6OF01ECH94.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaaacaataacaactacttagcttggtaccagcagaaaccaggacagccccctaaggtcctcatttactgggcatctacccgggagtccggggtcctgaccgattcagagcagcgggtctgggacagatttcactctcacatcaccaactgcaggctgaagatgtgctagtttatactgtcagcaatactatagtcctctctcacgttcggcggaggaccaaggtgagatacaaacgactgtgctgcacctatctgtcttcatcctcccgcatctgctac

SEQ ID NO: 51809 - DNA, 496 bp, Homo sapiens
  misc_feature: GYAE6OF01BJ2O2.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttatactgtcagcaatactatagtcctcctctcacgttcgcgagggaccaagggtgagatcaaacgactgtggctgcaccatctgtctcatcctccgcatctgctac

SEQ ID NO: 51810 - DNA, 503 bp, Homo sapiens
  misc_feature: GYAE6OF01EPN0W.18.11.A11.1.454.CMB.1.raw
  modified_base (474)..(474): a, c, t, g, unknown or other
  misc_feature (474)..(474): n is a, c, g, or t
  modified_base (497)..(497): a, c, t, g, unknown or other
  misc_feature (497)..(497): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcggtctgggacagatttcactctcacatcaccaactgcagctgaagatgtggctagtttatactgtacagcaatactatacgtcctcctctcacgttcggcggaggaccaaggtggagatacaaacgactgtggctgcaccgatntcgtctcatccttcccgacatcngactac

SEQ ID NO: 51811 - DNA, 541 bp, Homo sapiens
  misc_feature: GYAE6OF01BFDM2.18.11.A11.1.454.CMB.1.raw
  modified_base (208)..(208): a, c, t, g, unknown or other
  misc_feature (208)..(208): n is a, c, g, or t
  modified_base (329)..(329): a, c, t, g, unknown or other
  misc_feature (329)..(329): n is a, c, g, or t
  modified_base (369)..(369): a, c, t, g, unknown or other
  misc_feature (369)..(369): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctaccaacaataacaactacttagcttggtaccagcagaaaccaggacagcccctaaggtcctcattactgggcatctaccgggagtccgggtcctgaccgattcagagcagcggtntgggacagattcactctcacatcaccactgcaggctgaanatgtgctagtttactactgtcagcaatactatacgtcctcctctacgacgttcggacggtacggaacctaagggtggaagacgttaccgaaacggtacgtaggtgaccgtgaccaccgtagtccgttagttccttactacgttcctttccccgactaacttcttgactaacg

SEQ ID NO: 51812 - DNA, 585 bp, Homo sapiens
  misc_feature: GYAE6OF01D750K.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtcccggggtccctgacccgattcagagcagcggtctgggacagatttcactctcacatcaccaactgcaggctagaagatgtggactagtttatactgtcagcaatactatacgtcctctctcgtacgttcggacggtaacgggacctaagggtggtaagaactaccgaaaacggaaccgttggtacgggacttcggacctaacccgtaagttccgttacggttccctttaccactttccccgtttaccccggacccttaattcccgttacggaacccttaaccg

SEQ ID NO: 51813 - DNA, 497 bp, Homo sapiens
  misc_feature: GYAE6OF01DT0DD.18.11.A11.1.454.CMB.1.raw
  modified_base (378)..(378): a, c, t, g, unknown or other
  misc_feature (378)..(378): n is a, c, g, or t
  modified_base (481)..(481): a, c, t, g, unknown or other
  misc_feature (481)..(481): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtcccggggtcctgaccgattcagaggcagcgggtctgggacagatttcactctcaccatcaccaactgcagctgaagntgtgctagtttatactgtcagcaatactatacgtcctcctctcacgttcggcggaagggaccaaggtgagatacgaacgactgtggctgcaccatctgtctcntcttccgcatctgcta

SEQ ID NO: 51814 - DNA, 530 bp, Homo sapiens
  misc_feature: GYAE6OF01CXP10.18.11.A11.1.454.CMB.1.raw
  modified_base (207)..(207): a, c, t, g, unknown or other
  misc_feature (207)..(207): n is a, c, g, or t
  modified_base (494)..(494): a, c, t, g, unknown or other
  misc_feature (494)..(494): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttanacagctacaacaataacaactacttagcttggtaccagcagaaaccaggacagccccctaaggtcctcatttactgggcactcgtacccgggagtcccgggtccctgacccgattccagaggcaggcggtcgtgggacagatttcactctcaccatcaccaactgcaggctagaagatgtggtactagtttattactgtacagacaatacgtatacgtcctcctctctacgttccgggacggagggaccagggtacggagatacgaaacgatggtgctcgacaccgnttctgtcttctattccttcccgactatctgactaac

SEQ ID NO: 51815 - DNA, 513 bp, Homo sapiens
  misc_feature: GYAE6OF01CYMBA.18.11.A11.1.454.CMB.1.raw
  modified_base (506)..(506): a, c, t, g, unknown or other
  misc_feature (506)..(506): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctaccaacaataacaactacttagcttggtaccagcagaaaccaggacacgccccctaaggtcctcatttactgggcatccgtacccgggagtcccggggtccctgaccgattcagaggcagcgggtctgggacagatttcactctcaccatcaccaacctgcaggctagaagatgtggctagtttatactgtcagacaatactatacgtccctctctctacgttcgggcggaaggaccaagggtggagatacaaacgactgtgctgcacatctgtcttcatcctcccgcatcngtactac

SEQ ID NO: 51816 - DNA, 500 bp, Homo sapiens
  misc_feature: GYAE6OF01CJLKM.18.11.A11.1.454.CMB.1.raw
  modified_base (208)..(208): a, c, t, g, unknown or other
  misc_feature (208)..(208): n is a, c, g, or t
  modified_base (456)..(456): a, c, t, g, unknown or other
  misc_feature (456)..(456): n is a, c, g, or t
  modified_base (470)..(470): a, c, t, g, unknown or other
  misc_feature (470)..(470): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaccaggacagccccctaaggtcctcatttactgggcatctaccggagtcccggtcctgaccgattcagaggcagcgggtctgggacagatttcactctcaccatcacaacctgcaggctgaagatgtggcagtttatactgtcagcaatactatacgtcctctctctacgttcggcggaaggaccaaggtgagatacaaacgacnggtgctgacacctntctgtcttcattcctcccgcatctgactac

SEQ ID NO: 51817 - DNA, 556 bp, Homo sapiens
  misc_feature: GYAE6OF01C6RRL.18.11.A11.1.454.CMB.1.raw
  modified_base (208)..(208): a, c, t, g, unknown or other
  misc_feature (208)..(208): n is a, c, g, or t
  modified_base (349)..(349): a, c, t, g, unknown or other
  misc_feature (349)..(349): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaccaggacacgcccctaaggtcctcatttactgggcatccgtaccggagtccgggtcctgaccgattcagagcagcggtctgggacagatttcactcncaccatcaccaactgcaggctagaacgatggtgctagtttatactgtcagctaatactatacgtccctctctcgacgttcgggacggacgggaccagggtagagactacgaaacgactggtacggctacggaccacccgtaattccgttaggttcctttaccaactttccccgtttccccgacctagttcctaggtaacccttaacg

SEQ ID NO: 51818 - DNA, 508 bp, Homo sapiens
  misc_feature: GYAE6OF01EVHI4.18.11.A11.1.454.CMB.1.raw
  modified_base (502)..(502): a, c, t, g, unknown or other
  misc_feature (502)..(502): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactggcatctacccgggagtccggggtccctgaccgattcagaggcagcggtctgggacagatttcactctcaccatcaccaacctgcaggctagaagatgtgctagtttattactgtcagcaatactatgtcctctctcacgttcggacggacgggaccaaggtggaagtagtacaaacgactgtgctgacaccgatctgtcttcatccttcccgctatcngctacg

SEQ ID NO: 51819 - DNA, 509 bp, Homo sapiens
  misc_feature: GYAE6OF01DABF9.18.11.A11.1.454.CMB.1.raw
  modified_base (474)..(474): a, c, t, g, unknown or other
  misc_feature (474)..(474): n is a, c, g, or t
  modified_base (499)..(499): a, c, t, g, unknown or other
  misc_feature (499)..(499): n is a, c, g, or t
  modified_base (504)..(504): a, c, t, g, unknown or other
  misc_feature (504)..(504): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttatacagctccaacaataacaactacttagcttggtaccagcagaaaccaggacacgccccctaaggtcctcatttactgggcatcgtaacccgggagtcccggggtcctgaccgattcagaggcagcgggtctgggacagatttcactctcaccatcaaccaacctgcaggctagaagatgtggctaagtttatactgtcaagtcaattactatacgtcctctctcgacgttcggcggaagggaccaagggtgagattacaacgactgngctgcaccatctgtcttcatctccncatcngctac

SEQ ID NO: 51820 - DNA, 514 bp, Homo sapiens
  misc_feature: GYAE6OF01D41L3.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaaacaataacaactacttagcttggtaccagcaagaaaccaggacagccccctaaggtcctcattactgggcatcgtacccgggagtcccggggtcctgaccgattcagaggcagcggtctgggacagatttcactctcaccatccaccaacctgcaggctgaagatgtgctagtttattactgtcagcaatactatagtccctctctcacgttcggcggagggaccaagggtggagatacgaaacgactgtggctgaccaccatctgtccttcacttcttccccgctatctgactac

SEQ ID NO: 51821 - DNA, 519 bp, Homo sapiens
  misc_feature: GYAE6OF01CCM4L.18.11.A11.1.454.CMB.1.raw
  modified_base (284)..(284): a, c, t, g, unknown or other
  misc_feature (284)..(284): n is a, c, g, or t
  modified_base (386)..(386): a, c, t, g, unknown or other
  misc_feature (386)..(386): n is a, c, g, or t
  modified_base (480)..(480): a, c, t, g, unknown or other
  misc_feature (480)..(480): n is a, c, g, or t
  modified_base (489)..(489): a, c, t, g, unknown or other
  misc_feature (489)..(489): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaggtcctcatttacngggcatcgtacccgggagtcccggggtccctgaccgattcagaggcaggcgggtctgggacagtactttcactctcaccactcaccacctgcaggctgaagntgtgctagtttactactgtcagactaatactatacgtccctcctctctacggttcgggacggacgggaccagggtgacgtatacaaacgactgnggctgcacntctgtcttcactcctcccgcatctgctacg

SEQ ID NO: 51822 - DNA, 557 bp, Homo sapiens
  misc_feature: GYAE6OF01BMQA3.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctaccgggagtccggggtccctgaccgattcaggagcaggcggtcgtgggacagtacttcactctaccaccatccaaccaacctgacgaggctagaagtatggtggactagtttattacgtgtacagactaacttactattacgtccctcctctcgtacggttcggacgggacggaaccgagggtggaagtactaaccgaaacgacgtggtgtactgaccactcttctcgttccttacacttcccgttcccgactatctagactaacg

SEQ ID NO: 51823 - DNA, 523 bp, Homo sapiens
  misc_feature: GYAE6OF01CJVYJ.18.11.A11.1.454.CMB.1.raw
  modified_base (208)..(208): a, c, t, g, unknown or other
  misc_feature (208)..(208): n is a, c, g, or t
  modified_base (515)..(515): a, c, t, g, unknown or other
  misc_feature (515)..(515): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaaccaggacagccccctaaggtcctcatttactgggcatctacccgggagtcccggggtcctgaccgattcagaggcaggcgggtctgggacagatttcactctcaccatcaccaactgcaggctgaagatgtggcagtttatactgtcagcaaatactatagtcctcctctcacgttcggcggaagggaccaagggtggagaatcaaacgactggtcgctgaccaccgattctggttcttcattcccttcccgaccctattcngacctaac

SEQ ID NO: 51824 - DNA, 545 bp, Homo sapiens
  misc_feature: GYAE6OF01A0HLQ.18.11.A11.1.454.CMB.1.raw
  modified_base (504)..(504): a, c, t, g, unknown or other
  misc_feature (504)..(504): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctaccaacaataacaactacttagcttggtaccagcaagaaaccaggacacgaccccctaaggtcctctatttactgggcatccgtacccgggagtcccggggtccctgaccgattcagaggcaggcgggtcgtgggacagtatttcactctcacatcaccaactgcaggctagaagatgtggactagtttatacgtgtcaagtcaattactatacgtcctcctctcgtacggtcgggacggaaggaccgaagggtgaagtactacaaacgtacgtgtggctgaccaccgtntctcgtcttacacttccgtccccactactctagtactaccg

SEQ ID NO: 51825 - DNA, 543 bp, Homo sapiens
  misc_feature: GYAE6OF01AS0P2.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaaacaataacaactacttagcttggtaccagcaagaaaccaggacagccccctaaggtcctcatttactgggcatcgtacccgggagtcccggggtccctgaccgattcagaggcaggcggtctgggacagtatttcactctcaccatcaccaacctgacaggctagaagagtgtggactagtttacttactgtacagtacaatactatacgtccctcctctctacggttcggacggacggaccaaggtgaagatacgaacgacgtggtacggctagccaccgtattctgttccttcacttccttccccgactacttctcgactacg

SEQ ID NO: 51826 - DNA, 521 bp, Homo sapiens
  misc_feature: GYAE6OF01BL178.18.11.A11.1.454.CMB.1.raw
  modified_base (380)..(380): a, c, t, g, unknown or other
  misc_feature (380)..(380): n is a, c, g, or t
  modified_base (469)..(469): a, c, t, g, unknown or other
  misc_feature (469)..(469): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatccgtacccgggagtccggggtccctgaccgattcagaggcaggcgggtctgggacagatttcactctcacatcaccaacctgcagctgaantgtggctagtttatactgtacagactaatactatacgtcctcctctctacgttcggcggaaggaccaaggtgagatacaaacgactggngctgaccacgatctgttccttcacttcccgttccccgactattctgactacg

SEQ ID NO: 51827 - DNA, 502 bp, Homo sapiens
  misc_feature: GYAE6OF01C87XA.18.11.A11.1.454.CMB.1.raw
  modified_base (496)..(496): a, c, t, g, unknown or other
  misc_feature (496)..(496): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagcccctaaggtcctcatttactgggcactctacccgggagtccggggtccctgacccgattccagaggcagcggtctgggacagatttcactctcacatcacaacctgcaggctgaagatgtggactagtttattactgtcagcaaatactatagtcctctctcacgttcgcggaggaccagggtgagatacaaacgatgtgctgcaaccatctcgtcttcattcctcccgcatcngctacg

SEQ ID NO: 51828 - DNA, 510 bp, Homo sapiens
  misc_feature: GYAE6OF01AQA4N.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcattactgggcatctacccgggagtccggggtcctgaccgattcagaggcagcgggtctgggacagatttcactctcaccatcaccaacctgcaggctgaagatgtggctagtttattactgtcagctaatactatacgtcctctctcacgttcgggcgagggaccaggtggagatacaacgtactgtggctgcaccattctgtccttcattccttcccgcctatcctgcctaac

SEQ ID NO: 51829 - DNA, 530 bp, Homo sapiens
  misc_feature: GYAE6OF01D9ZHM.18.11.A11.1.454.CMB.1.raw
  modified_base (504)..(504): a, c, t, g, unknown or other
  misc_feature (504)..(504): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaggtcctcatttactgggcatccgtacccgggagtcccggggtccctggaccgattcagaggcaggcgggtctgggacagtatttcactctcacatcaccaacctgcaggctagaagatgtggctaagtttattactgtcaagacaatactatacgtccctctctctacggttcggcggacgggaccaaggtggagatacaaacgactgtcggctgacaccatctgttcttacgnttcccttcccgactatcctgactaac

SEQ ID NO: 51830 - DNA, 567 bp, Homo sapiens
  misc_feature: GYAE6OF01BB1VA.18.11.A11.1.454.CMB.1.raw
  modified_base (396)..(396): a, c, t, g, unknown or other
  misc_feature (396)..(396): n is a, c, g, or t
  modified_base (399)..(399): a, c, t, g, unknown or other
  misc_feature (399)..(399): n is a, c, g, or t
  modified_base (477)..(477): a, c, t, g, unknown or other
  misc_feature (477)..(477): n is a, c, g, or t
  modified_base (482)..(482): a, c, t, g, unknown or other
  misc_feature (482)..(482): n is a, c, g, or t
  modified_base (496)..(496): a, c, t, g, unknown or other
  misc_feature (496)..(496): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagaggccacatcaactgcaagtccagccagagtgttttatacagctaccaaacaataacaactacttagcttggtaccagcagaaaccaggacacgcccctaaggtcctacatttactgggacactccgtaacccggggagtcccggggtcccctgaccgtattcgagacggcaggcgggtctgggacagtacttcgactctacacactcaaccaacctgcagctgaagntgngactagtttatacgtgtacagacaatactatacgtccctctcgtacgtacggttccgggacggagggtaacctagggnggaanacttacgaaaacgngtgtcggcctagaccctaactagttccgtagtccttacgactttcccgtcccgactattctccgaataccg

SEQ ID NO: 51831 - DNA, 499 bp, Homo sapiens
  misc_feature: GYAE6OF01EHMF7.18.11.A11.1.454.CMB.1.raw
  modified_base (461)..(461): a, c, t, g, unknown or other
  misc_feature (461)..(461): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggctagtttattactgtcagcaatactatagtcctctctcacgttcggcggaggaccaaggtgagatcaaacgactgngctgcaccatctgtcttcatccttcccgcatctgctac

SEQ ID NO: 51832 - DNA, 547 bp, Homo sapiens
  misc_feature: GYAE6OF01DCZ4I.18.11.A11.1.454.CMB.1.raw
  modified_base (284)..(284): a, c, t, g, unknown or other
  misc_feature (284)..(284): n is a, c, g, or t
  modified_base (495)..(495): a, c, t, g, unknown or other
  misc_feature (495)..(495): n is a, c, g, or t
  modified_base (513)..(513): a, c, t, g, unknown or other
  misc_feature (513)..(513): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctacaacaataacaactacttagcttggtaccagcaagaaaccaggacacgacccctaagtcctcatttacngggcacgtccgtacccgggagtcccggggtccctggaccgtattcgaggaggcgaggcggtcgtagggacagatttcactctaccacactccaaccaacctgaccaggcctagaagactggtagctaagttttatactgtcaagtactaatactatacgtccctactctcgtacggtcggacggacggtaccaggtgacgatacaagtacnggtcgctgaccacctatntcgtcttccacttcctcccgactagtctgactac

SEQ ID NO: 51833 - DNA, 555 bp, Homo sapiens
  misc_feature: GYAE6OF01C3QXD.18.11.A11.1.454.CMB.1.raw
  modified_base (290)..(290): a, c, t, g, unknown or other
  misc_feature (290)..(290): n is a, c, g, or t
  modified_base (326)..(326): a, c, t, g, unknown or other
  misc_feature (326)..(326): n is a, c, g, or t
  modified_base (503)..(503): a, c, t, g, unknown or other
  misc_feature (503)..(503): n is a, c, g, or t
  modified_base (545)..(545): a, c, t, g, unknown or other
  misc_feature (545)..(545): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagcctaccaacaataacaactacttagcttggtaccagacagaaaccaggacacgaccccctaaggtcctctatttacngggcatccgtacccggaggtcccgggtcctgaccgnttcagaggcgagcgggtctgggacagtacttcactctcaccatcaaccaactgacaggctagaagatggtgctagttttatactgtcagactaatactatacttccctctctcaccgttcgggcggaacgggaccaagggtgagtactacgaaacgtctggtcggctcgctaccgtntcgttcgttccttcgtacttcccttaccccgactattcccgngaccttaacg

SEQ ID NO: 51834 - DNA, 628 bp, Homo sapiens
  misc_feature: GYAE6OF01DA815.18.11.A11.1.454.CMB.1.raw
  modified_base (209)..(209): a, c, t, g, unknown or other
  misc_feature (209)..(209): n is a, c, g, or t
  modified_base (290)..(290): a, c, t, g, unknown or other
  misc_feature (290)..(290): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagactccctggttgtgtctctgggcgagagggccaccatcaactgcaagtccagccagagtgttttanacagctaccaacaataacaacttacttagccttggtaccagacaagaaaccaggacacgccccctaaggtcctcatttacngggcatccgacccgggagtccgggtccctgaccgattcagagcagcgggtctgggacagatttcactctcaccatccacaacctgcaggctagaagatgtggctaagttttatactgtcaagtacaatactagtacgtcctcctctcgacggttccgggcgggaacggacccgtaagggttcgggaacgtaacgttaccgaaaaccggtaactcgggtacggaccttacgggacccaaacccgttaacgtcccggtttacggttcccttttaccgaaaccgtttcccccgtttacccccggacccttaaacgtttcccgtacggtaaccttaaacccg

SEQ ID NO: 51835 - DNA, 502 bp, Homo sapiens
  misc_feature: GYAE6OF01A5CGM.18.11.A11.1.454.CMB.1.raw
  modified_base (463)..(463): a, c, t, g, unknown or other
  misc_feature (463)..(463): n is a, c, g, or t
  modified_base (472)..(472): a, c, t, g, unknown or other
  misc_feature (472)..(472): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggctagtttatactgtcagcaatactatacgtcctcctctcacgttcggcggagggaccaggtgagatacaaacgactgnggctgcacntctgtcttcattcctcccgcatctgactac

SEQ ID NO: 51836 - DNA, 510 bp, Homo sapiens
  misc_feature: GYAE6OF01EN5WW.18.11.A11.1.454.CMB.1.raw
  modified_base (284)..(284): a, c, t, g, unknown or other
  misc_feature (284)..(284): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaggtcctcatttacngggcatctacccgggagtccggggtccctgaccgattcagaggcagcggtctgggacagtatttcactctcaccatccaccaacctgcaggctagaagatgtggctagtttatactgtcagctaatactatagtcctcctctctacgttcggcggaggaccaaggtggaagatacaaacgtactgtgctgcaccgatctgtctcatccttccgctatctgactacg

SEQ ID NO: 51837 - DNA, 599 bp, Homo sapiens
  misc_feature: GYAE6OF01BFSVW.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaggtcctcatttactgggcatcgtacccgggagtccggggtcctgaccgattcagaggcagcgggtctgggacagatttcactctcaccatcaccaacctgcaggctgaagatgtggactagtttatactgtcagctaatactatacgttcctcctctcgtacgtttccgggcgggaacgggacccgtaagggtcgggaagtacgtaaccgaaacggtaacgttggtacggacgttacgaccctaaccgtacgttcctcggtttcccttaccgtacgtttccccgtttaccccgacccttaactttcccgttcggtaaccctttaaaccg

SEQ ID NO: 51838 - DNA, 726 bp, Homo sapiens
  misc_feature: GYAE6OF01BBWBQ.18.11.A11.1.454.CMB.1.raw
  modified_base (224)..(224): a, c, t, g, unknown or other
  misc_feature (224)..(224): n is a, c, g, or t
tcagtacgagtatgcacgaccggtgctcgatttagctacgactgcaggggcagcaagatggtgttgcacgacccaggtcttctatttctctgttgctctggatctctggtgccggacggggacatcgtgatcgacccagtcctccagacctcccgttggttgtgtctcgtgggcgaggacggcccaccatacaactgacaacgtccagccagtagttgttttanacagcctaccaaacaaactaaaccaacttacttagtcttacggaaccagcaacgaaaaccgaggaaccaccgaccccctaaaggtccctactaatttacgcgggactactaccgtacccggggacggttccccgggggtcccctaggacccgtacttcgaggacggcgagggtccgggtacgtggggaacctaggtactttccaccttcctaccaaccacttacccaaccctaaccctgaccgaggtcctaaggaagtagtcggtcggtacttaaggttttacttacgttcgtacaacgtacctaaataccttaagttaccgttcccttccgtacctaccgtaccgggttcgggacgggaacgggtaacccgtaaggggtcggaacgtaacttaaccgaaaacgtacgttaggcgggtaccttcggacctaaccgtctaccgtttcgtccctttacaacctttcccgttccccggacccttagtccctagtaaccttaaccg

SEQ ID NO: 51839 - DNA, 504 bp, Homo sapiens
  misc_feature: GYAE6OF01CVD7H.18.11.A11.1.454.CMB.1.raw
  modified_base (382)..(382): a, c, t, g, unknown or other
  misc_feature (382)..(382): n is a, c, g, or t
  modified_base (468)..(468): a, c, t, g, unknown or other
  misc_feature (468)..(468): n is a, c, g, or t
  modified_base (499)..(499): a, c, t, g, unknown or other
  misc_feature (499)..(499): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaggtcctcatttactgggcatctacccgggagtcccggggtccctgaccgattcagaggcagcgggtctgggacagatttcactctcaccatcaccaacctgcaggctgaagntgtggctagtttatactgtcagacaatactatacgtcctcctctcacgttcggcggagggaccaagggtgagatacaaacgactgnggctgcacatctgtctcatcttcccgcatcngctac

SEQ ID NO: 51840 - DNA, 514 bp, Homo sapiens
  misc_feature: GYAE6OF01BI1PN.18.11.A11.1.454.CMB.1.raw
  modified_base (484)..(484): a, c, t, g, unknown or other
  misc_feature (484)..(484): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaggtcctcatttactgggcatcgtacccgggagtccggggtccctgaccgattcagaggcaggcgggtctgggacagatttcactctcaccatcaccaacctgcaggctgaagatgtgctagtttattactgtcagcaatactatacgtccctcctctcgtacgttcggcggaggaccgaaggtgagatacgaacgactgcggctgacaccatcngttctcacttccttcccgcatctgactacg

SEQ ID NO: 51841 - DNA, 510 bp, Homo sapiens
  misc_feature: GYAE6OF01EE9V4.18.11.A11.1.454.CMB.1.raw
  modified_base (465)..(465): a, c, t, g, unknown or other
  misc_feature (465)..(465): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataaacaactacttagcttggtaccagcagaaaaccaggacagccccctaaggtcctcatttactgggcatctaccgggagtccggggtccctgaccgattcagaggcagcgggtctgggacagatttcactctcaccatcaccaaacctgcaggctgaagatgtgcagtttattactgtcagcaatactatacgtcctcctctcacgttcggcggacgggaccaggtggagatcaaacgactgngctgccaccatctgtcttcactccttcccgcctatcctgactacg

SEQ ID NO: 51842 - DNA, 520 bp, Homo sapiens
  misc_feature: GYAE6OF01CJ3JK.18.11.A11.1.454.CMB.1.raw
  modified_base (491)..(491): a, c, t, g, unknown or other
  misc_feature (491)..(491): n is a, c, g, or t
  modified_base (500)..(500): a, c, t, g, unknown or other
  misc_feature (500)..(500): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcaagaaaccaggacacgccccctaaggtcctcatttactgggcatccgtacccgggagtcccggggtccctgaccgattcagaggcaggcgggtctgggacagatttcactctcaccatccaccaacctgcaggctgaagatggtggctagtttattactgtcagacaatactatagtccctcctctctacgttcgggacggacgggaccaagggtggagatacaaacgtactgtggctgccacntctgtctcnttcctcccgcatctgactac

SEQ ID NO: 51843 - DNA, 545 bp, Homo sapiens
  misc_feature: GYAE6OF01CC6HJ.18.11.A11.1.454.CMB.1.raw
  modified_base (208)..(208): a, c, t, g, unknown or other
  misc_feature (208)..(208): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctacaacaataacaactacttagcttggtaccagcagaaaccaggacagcccctaaggtcctcattactggcatcgtacccgggagtcccgggtcctgaccgattcaggagcagcggtctgggacagatttcactctcacatccacaactgcaggctagaagatgtggactagtttatactgtcagactaatactatagtccctcctctcgacgttacggcggaacgggtaaccaagggttggaatacgtaacgaaaacgacttggtacggcttacgacaaccctatccgtagttccttactacttccttccccgactagtcctgacttaacg

SEQ ID NO: 51844 - DNA, 579 bp, Homo sapiens
  misc_feature: GYAE6OF01ESMM6.18.11.A11.1.454.CMB.1.raw
  modified_base (287)..(287): a, c, t, g, unknown or other
  misc_feature (287)..(287): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctaccaacaataacaactacttagcttggtaccagcaagaaaccaggacacgcccctaaggtcctacatttacnggcatcgtaccgggagtccggggtcctgaccgatcagagcagcggtctgggacagtattcactctcacatcaccaactgacaggctagaagactgtggactagtttatacgtgtcagactaacttactatacgtcctcctctcgtacggttcggacgggtaacggaccgaagggtggaagtaactacgaaaacggtacttggtacggccttacgacctaacccgtattccgttacgttcctttacaaccgtttccctttacccccggaccttattcccttagaaccttaacg

SEQ ID NO: 51845 - DNA, 497 bp, Homo sapiens
  misc_feature: GYAE6OF01EDWTX.18.11.A11.1.454.CMB.1.raw
  modified_base (470)..(470): a, c, t, g, unknown or other
  misc_feature (470)..(470): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccagacagccccctaaggtcctcatttactgggcatctacccgggagtccggggtccctgaccgattcagaggcagcgggtctgggacagatttcactctcaccatcaccaacctgcaggctgaagatgtggacagtttattactgtcagtcaatactatagtcctcctctcacgttcgcggaggaccagggtgagatcaaacgactgtgctgcaccntctgtcttcatctcccgcatctgctac

SEQ ID NO: 51846 - DNA, 501 bp, Homo sapiens
  misc_feature: GYAE6OF01AM8NX.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggctagtttatactgtcagcaatactatagtcctctctcacgttcggcggaggaccaaggtgagatcaaacgactgtggctgcaccgatctgtcttcattccttcccgcatctgctac

SEQ ID NO: 51847 - DNA, 604 bp, Homo sapiens
  misc_feature: GYAE6OF01C350M.18.11.A11.1.454.CMB.1.raw
  modified_base (211)..(211): a, c, t, g, unknown or other
  misc_feature (211)..(211): n is a, c, g, or t
  modified_base (321)..(321): a, c, t, g, unknown or other
  misc_feature (321)..(321): n is a, c, g, or t
  modified_base (379)..(379): a, c, t, g, unknown or other
  misc_feature (379)..(379): n is a, c, g, or t
tcagtacgagtatgcacgaccggtgctcgatttagctacgactgcaggggcagacaagatggtgttgcagacccaggtcttcatttctctgttgcgtctggatctctggtgccgacggggacatcgtgatcgacccagtctccagctccctggttgtgtctctgggcgagagggccaccatcaactgcaagtccagccagagttgttttanacagctaccaacaataacaactacttagcttggtaccagcacgaaaccaggacacgccccctaaggtcctcatttactgggcatcgtaccggagtccgggtcctgaccgntcagacgcagcggtctgggacagtattcactctcaccatccacaacctgcagctgaantcgtggctaagttttactaagtcgtactaggactaatacgtaatacgttccctcctccttcacggtttccggcgggtaacggaacccgtaaagggtcggaacgacgtaccaaaacgggtactagggttacggtaccttcgggacctaaccgtacttcgttacggttctttacccgttaattcccgttaccccggaccttactttaccgtgtaaacccgttaaccg

SEQ ID NO: 51848 - DNA, 594 bp, Homo sapiens
  misc_feature: GYAE6OF01BQMUZ.18.11.A11.1.454.CMB.1.raw
  modified_base (208)..(208): a, c, t, g, unknown or other
  misc_feature (208)..(208): n is a, c, g, or t
  modified_base (385)..(385): a, c, t, g, unknown or other
  misc_feature (385)..(385): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctaccaaacaataacaactacttagcttggtaccagcagaaaccaggacacgccccctaaggtcctcatttactgggcatctacccgggagtccgggtcctgaccgattcgagagcagcggtctgggacagtactttcactctacacatccaaccaactgacaggctagaagntgtgactagtttatactgtacagacaattactatacgtcctcctctacgtacgttcggacggtaacgggaaccgtaagggtggtaacgaactacgaaaccgtaacgttggtacggtcgtacgacctaaccgtagttaccgttcggtttcctttacctaactttccccgtttaccccgaccctaactttccgtaccggtaacttaaaccg

SEQ ID NO: 51849 - DNA, 515 bp, Homo sapiens
  misc_feature: GYAE6OF01ENEUR.18.11.A11.1.454.CMB.1.raw
  modified_base (386)..(386): a, c, t, g, unknown or other
  misc_feature (386)..(386): n is a, c, g, or t
  modified_base (458)..(458): a, c, t, g, unknown or other
  misc_feature (458)..(458): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcaagaaaccaggacacgccccctaaggtcctcatttactgggcatccgtacccggggagtcccggggtccctgaccgattcagagcagcgggtctgggacagatttcactctcaccatccaccaacctgcaggctgaagntgtggctagtttatactgtcagcaatactatagtccctctctctacgttcggcggaggaccgaaggtggaanatacaaacgactgtggctgcaccatctgtcttcatccttcccgacatcctgaactac

SEQ ID NO: 51850 - DNA, 568 bp, Homo sapiens
  misc_feature: GYAE6OF01DIBWW.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagacagaaaaccaggacacgccccctaaggtcctcatttactgggcatcgtacccgggagtcccggggtccctgaccgattcagaggcaggcgggtctgggacagtatttcactctcaccatcaccaacctgcaggctgaagatgtggctagtttatactgtcagtacaatactatacgtccctctctcacggttcggcggaagggacctaaagggtcgggaagtaactaccgaaaacggtacgtaggtcggctacgccaacccgtattccgtgtttcccttacctacttccccgttccccgacttacttcctgtacctaaccg

SEQ ID NO: 51851 - DNA, 527 bp, Homo sapiens
  misc_feature: GYAE6OF01D0RME.18.11.A11.1.454.CMB.1.raw
  modified_base (383)..(383): a, c, t, g, unknown or other
  misc_feature (383)..(383): n is a, c, g, or t
  modified_base (489)..(489): a, c, t, g, unknown or other
  misc_feature (489)..(489): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaggtcctcatttactgggcactctacccgggagtcccggggtcctgaccgattcagaggcagcgggtctgggacagtatttcactctcaccatcaccaacctgcaggctgaagntggtgctagtttattactgtcagctaatactatacgtcctcctctcacggttcggcggaagggaccaaggtggagactacgaaacgactgtacggctgaccacctntctgttctctactcccttcccgcctatctgtactaacg

SEQ ID NO: 51852 - DNA, 569 bp, Homo sapiens
  misc_feature: GYAE6OF01BWH5A.18.11.A11.1.454.CMB.1.raw
  modified_base (209)..(209): a, c, t, g, unknown or other
  misc_feature (209)..(209): n is a, c, g, or t
  modified_base (503)..(503): a, c, t, g, unknown or other
  misc_feature (503)..(503): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggcccaccatcaactgcaagtccagccagagtgttttanacagctaccaaacaataacaactacttagcttggtaccagcaagaaaccaggacacgaccccctaaggtcctctatttacgtgggacactccgtacccgggagtcccggggtccctgaccgtattcaggaggcaggcgggtctgggacagactttcactctcaccatccaccaactgacaggctagaagatgtgtatagtttatactgtacagactaatactatacgtcctctctcgtacggttccggacggaacgggaccgtaaggtcggaagtacgtacgaaacgtacgtgngtactcgactaccgtattccgtacgttccttactaccttccgttaccccgactatctgactaaccg

SEQ ID NO: 51853 - DNA, 624 bp, Homo sapiens
  misc_feature: GYAE6OF01DLUKL.18.11.A11.1.454.CMB.1.raw
  modified_base (210)..(210): a, c, t, g, unknown or other
  misc_feature (210)..(210): n is a, c, g, or t
  modified_base (289)..(289): a, c, t, g, unknown or other
  misc_feature (289)..(289): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtcctccagacctccctggttgtgtctctgggcgagagggccaccatcaactgcaagtccagccagagtgttttanacagcctaccaacaataacaactacttagcttaggtaccagcagaaaccaggacacgccccctaaggtcctcatttacngggcatccgtacccgggaggtcccggggtcctggaccgattcgagaggcaggcgggtctggggacagtatttcgactctcaccataccaacccaacctgaccaggctaggaagtgtgtaggcttaggttttacttacgttgtacaggtactaactactatacgttccctcctctcgtacggttcgggacggtaacgggaaccgtaagggtgtagtaactacgaaaccgtactggtacggactcggaccctaaccgtacttccgttacggttcctttacccgtactttaccccgtttcccccggaccttaacgttcccttaggtacccttaaaccg

SEQ ID NO: 51854 - DNA, 625 bp, Homo sapiens
  misc_feature: GYAE6OF01CPG3W.18.11.A11.1.454.CMB.1.raw
  modified_base (212)..(212): a, c, t, g, unknown or other
  misc_feature (212)..(212): n is a, c, g, or t
  modified_base (295)..(295): a, c, t, g, unknown or other
  misc_feature (295)..(295): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagacgggccaccatcaactgacaagtccagccagtagttgtttanacagctaccaacaataacaactacttagcttaggaccagacaagaaaccaggacacgaccccgtaaggtcctactatttacgnggacacgtccgtacccgggagtcccggggtccctgaccgtattcgagtacggcgaggcgggtctagggactagtactttcactctaccaccactaccaaccaacctgacgaggctagaagtgtaggtgtactagtttactacgtgtacagtactaaattactattacgtcctcctctacgtacggtcgggacggaacggaaccgtaggtgaatacgtacgaaacgtacgtggtacgcctacgacctaaccgtacgttcccgttcgttaccctttccgtaacctttccccgttcccccggaaccttagttacccgtacgtaacccttaccg

SEQ ID NO: 51855 - DNA, 763 bp, Homo sapiens
  misc_feature: GYAE6OF01C0QS4.18.11.A11.1.454.CMB.1.raw
  modified_base (225)..(225): a, c, t, g, unknown or other
  misc_feature (225)..(225): n is a, c, g, or t
  modified_base (276)..(276): a, c, t, g, unknown or other
  misc_feature (276)..(276): n is a, c, g, or t
tcagtacgagtatgcacgaccggtgctcgatttagctacgactgctagggggtcggagcaaggatggtgttgcagacccaggtcttcatttcctctgttgctcgtggatctctggtgccgacggggaccatcgtgatggacccagtcgtccaggacctcctggttgtcgtctctgggcgagagggccaccatcaacgtgcaaagtccagccagtacgtgttttanactagctaccaacaataacaactacttagcttggtaccgagcaagaaaccnggacacgccccgtaaggtcctcaatttactcgggcatccgtaacccggacgtaccggggtcctagaccgtattcagaggcagcggtctcgggacaggtactttcgaccttctacctaccaagttccaaccctaaaccgttggaccgaacgggaccttacggaaacgtcgttacggttacgggaccttaaggtttttaacttaccgttacgttaccgaaggtacctaaagttaacccgtaagttaaccggttccccttacgttacttacctaaccgggttttcgggacggggtaaacggacccttaaaaggggtttcgggaacggaacttaacccgtaaaaaccgggaacgttttacggggtacgggtacccttaggtacccgtaacccgttaacgttaacgttaccgggtttacctttaccgtaaaccgtttcccgttttaccccccgggaaccttagtttacccgtacgggtaaccctaaacccgg

SEQ ID NO: 51856 - DNA, 514 bp, Homo sapiens
  misc_feature: GYAE6OF01DG531.18.11.A11.1.454.CMB.1.raw
  modified_base (282)..(282): a, c, t, g, unknown or other
  misc_feature (282)..(282): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgcccctaaggtcctcattacnggcatctacccgggagtccggggtcctgaccgattcagagcagcggtctgggacagtattcactctcacatcaccaacctgacaggctagaagatgtggctagtttatactgtcaagacaatactatacgtcctcctctcacgttcgggacggagggaccaagggtggagatacaaacgtactggtcggctgccacgatctgtccttcatcccttcccgctatctgcctaac

SEQ ID NO: 51857 - DNA, 531 bp, Homo sapiens
  misc_feature: GYAE6OF01BHKIN.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctaccaacaataacaactacttagcttggtaccagcagaaaccaggacagcccctaaggtcctcattactggcatctaccgggagtccgggtccctgaccgattcagaggcagcggtctgggacagactttcactctcacatcaccaactgcaggctgaagtatcgtggactagtttatactgtacagctaatactatacgtccctctctcgacgttcggcggaaggaccagggtcgaagactacgaaacgacgtgtacggctcgactacccagttctacgttcttctacttcccgtccccgactatcctgacctaacg

SEQ ID NO: 51858 - DNA, 766 bp, Homo sapiens
  misc_feature: GYAE6OF01B4FRY.18.11.A11.1.454.CMB.1.raw
tcagtacgagtatgcacgaccggtgctcgatttagctacgactgcagggggcaggcaacgatggtgttgcaggaccccgaggttccttctagtttctctgttgctctggatctctggtgccgacgggacagtcgttggatgaccctaggttcctccagaccttcccttggttgtgtcctcgtgggcgagagggccaaccagtcgaactgcgaagtccagccagacgtgttttatacagctaccaaacaataaccaactacttagcttcggtaccaggtcaacgtaaaccaggtacacgacccccgtaaggtcctacactttactcggggccactaccgtacccgggaggtcccgggtaccctggtaccgagttcgaggagcgtaggtcggtctcgggacaggtactttcgacgttctaccactacttccgaacctaaccgtcgaccgtaggaccgtacggaacgtacgttacggtcggtacctaacggttttacgttaaccgtagttaaccgtaacggtaactaaaacttaccttaaacgttacggttaccctttacccgttaccttaccgtaaccggtttaccgggaccgggtaacggggtaaccccgtaaggggtacgggtaacggtaacgttaaccgtaaaaccggttaaccgttgggtacgggtacgtacgggaaccgtaaccgtaacggttccgtaggtttacccttacgtacctttcccgtttaccccggacttacgtccgtacggtaaccgttaacccg

SEQ ID NO: 51859 - DNA, 500 bp, Homo sapiens
  misc_feature: GYAE6OF01CPP2S.18.11.A11.1.454.CMB.1.raw
  modified_base (208)..(208): a, c, t, g, unknown or other
  misc_feature (208)..(208): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttatactgtcagcaatctatagtcctctctcacgttcggcggaggaccaagggtgagatcaaacgactgtggctgcaccgatctgtcttcattcctcccgcatctgctacg

SEQ ID NO: 51860 - DNA, 509 bp, Homo sapiens
  misc_feature: GYAE6OF01CCEZO.18.11.A11.1.454.CMB.1.raw
  modified_base (283)..(283): a, c, t, g, unknown or other
  misc_feature (283)..(283): n is a, c, g, or t
  modified_base (464)..(464): a, c, t, g, unknown or other
  misc_feature (464)..(464): n is a, c, g, or t
  modified_base (475)..(475): a, c, t, g, unknown or other
  misc_feature (475)..(475): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaagtcctcatttacnggcatctacccgggagtccgggtccctgaccgattcagaggcagcgggtctgggacagtattcactctcaccatcaccaactgcaggctagaagatgtgctagtttatactgtcagcaaatactatagtcctcctctcacggttcggacggagggaccaaggtgagactacaaacgactgnggctgcacctntctcggtcttacatcctcccgactatctgactac

SEQ ID NO: 51861 - DNA, 499 bp, Homo sapiens
  misc_feature: GYAE6OF01ECYHC.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtcctgaccgattcagagcagcggtctgggacagatttcactctcaccatcaccaactgcaggctgaagatgtggctagtttatactgtcagcaatactatacgtcctcctctcacgttcggcggagggaccaaggtggagatacaaacgactgtgctgcacctatctgtctcatcctcccgctatctgctac

SEQ ID NO: 51862 - DNA, 613 bp, Homo sapiens
  misc_feature: GYAE6OF01D4KK1.18.11.A11.1.454.CMB.1.raw
  modified_base (211)..(211): a, c, t, g, unknown or other
  misc_feature (211)..(211): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctcgtgggcgagagggccaccatcaactgcaagtccagccagagttgttttanacagctaccaaacaataacaactacttagctttaggaccagcaagaaaccaggacacgaccccctaaggtccctactactttacgtgggacacgtccgtacccggggagttcccggggtcccctggacccgtattcgaggagcgaggccgggtctgggacagtattcactctccaccactaccaaccaacctgaccgaggctagaagtatggtgactaagtttattacgttgtacaacgtcaaatactatactccctcctactctaccggttcggacgggaaggacccgtaaggtcggaagtactacgaaacggtactggtacgcgtacgtaccgaccgtcttctcggttaccttccgtacgttaccccgttccccgactaaccgttctacgaaccttaccg

SEQ ID NO: 51863 - DNA, 503 bp, Homo sapiens
  misc_feature: GYAE6OF01E4XO5.18.11.A11.1.454.CMB.1.raw
  modified_base (381)..(381): a, c, t, g, unknown or other
  misc_feature (381)..(381): n is a, c, g, or t
  modified_base (477)..(477): a, c, t, g, unknown or other
  misc_feature (477)..(477): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatcgtacccgggagtccggggtccctgaccgattcagaggcagcgggtctgggacagatttcactctcaccatcaccaactgcaggctagaagntgtggctagtttattactgtcagcaatactatacgtcctcctctctacgttcggcggagggaccaagggtggagatacaaacgactgtgctgcacntctgtctcatcctccgcatctgctac

SEQ ID NO: 51864 - DNA, 607 bp, Homo sapiens
  misc_feature: GYAE6OF01D67EE.18.11.A11.1.454.CMB.1.raw
  modified_base (209)..(209): a, c, t, g, unknown or other
  misc_feature (209)..(209): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttanacagctaccaaacaataacaactacttagcttaggtaccagcaacgaaaccaggaccacgccccctaaggtcctactatttacgtgggctacgtccgtacccggggacgtcccggggtccctcggaccgattcgagaggcaggcggtcgtgggacagtacttcactctcaccatcaccactgcaggctagaagagtgtgactagtttactactgtacagctaatactatacgtccctcctctacgtaccggttcggacgggtaggaaccgtaagggtcggaagtacgtaacgaaaccgtacgttcggtacggacctacggaccctaccgtacttccgttacggttccttaccgtactttccccgttaccccggacttactccttcggaacccttaacg

SEQ ID NO: 51865 - DNA, 579 bp, Homo sapiens
  misc_feature: GYAE6OF01DHNSF.18.11.A11.1.454.CMB.1.raw
  modified_base (355)..(355): a, c, t, g, unknown or other
  misc_feature (355)..(355): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagaggccaccatcaactgcaagtccagccagagtgttttatacagcctacaacaataacaactacttagcttgtaccagcaagaaaccaggacacgcccctaagtcctactatttactggcatccgtacccgggagttcccgggtccctgaccgattcgagagcagcggtctgggacagtattcactcncacactcaaccaactcgacagtctagaagtatggtagacttagtttattacgtgtacagctaaatactatacgtccctcctctccgtacggttcgggcggtaacgggaccgtaagggtcgggaagtaaccgtacgaaaacgtacgttggtacggctacgaccaccgtcgttaccgtcgttccttacctactttcccttccccgactattcccgttgaacctacg

SEQ ID NO: 51866 - DNA, 503 bp, Homo sapiens
  misc_feature: GYAE6OF01ERFIH.18.11.A11.1.454.CMB.1.raw
  modified_base (468)..(468): a, c, t, g, unknown or other
  misc_feature (468)..(468): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaactgcaggctgaagatgtggctagtttattacgtgtcagctaatactatagtcctctctcacgttcgcggaggacgaggtaggagatacaaacgactgtcgctncacatctcgtcttcatcctcccgacatctgactac

SEQ ID NO: 51867 - DNA, 502 bp, Homo sapiens
  misc_feature: GYAE6OF01ED9QF.18.11.A11.1.454.CMB.1.raw
  modified_base (208)..(208): a, c, t, g, unknown or other
  misc_feature (208)..(208): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaccaggacagccccctaaggtcctcatttactgggcatctacccgggagtccggggtccctgaccgattcagaggcagcggtctgggacagatttcactctcaccatccaccaacctgcaggctgaagatgtggcagtttatactgtcagcaatactatagtcctcctctcacgttcggcggaggaccaggtgagatacaaacgactgtcggctgcaccatctgtcttcatccttcccgctatctgactac

SEQ ID NO: 51868 - DNA, 542 bp, Homo sapiens
  misc_feature: GYAE6OF01AO22D.18.11.A11.1.454.CMB.1.raw
  modified_base (212)..(212): a, c, t, g, unknown or other
  misc_feature (212)..(212): n is a, c, g, or t
  modified_base (381)..(381): a, c, t, g, unknown or other
  misc_feature (381)..(381): n is a, c, g, or t
tcagtacgagtatgcacgaccggtgctcgatttagctacgactgcaggggcgagcaagatggtgttgtcagacccaggtcttcatttctctgttgctctggatctcgtggtgccgacggggacatcgtgatgacccagtctccagactccctggttgtgtctctgggcgagagggccaccatcaactgcaagtccagccagagttgttttanacagctccaacaataacaactacttagcttggtaccagcaagaaaccaggacagccccctaaggtcctcatttactgggcatcgtaccggggagtccggggtccctgaccgattcagagcagcgggtctgggacagatttcactctcacatcacaactgcaggctgaanatggtgctagtttactactgtacagacaatactatcgtacctctctcacgttcggcgaggaccagggtcgagatacgaaacgactggacgctggaccacgtacttccgtacgttccttacgtacttcccgtttcccggacctaattccgttcgaacttaac

SEQ ID NO: 51869 - DNA, 549 bp, Homo sapiens
  misc_feature: GYAE6OF01CX3N6.18.11.A11.1.454.CMB.1.raw
  modified_base (394)..(394): a, c, t, g, unknown or other
  misc_feature (394)..(394): n is a, c, g, or t
  modified_base (494)..(494): a, c, t, g, unknown or other
  misc_feature (494)..(494): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctaccaaacaataacaactacttagcttggtaccagcaagaaaccaggacacgcccctaagtcctcattactgggcatccgtacccgggagtcccgggtcctgaccgtatcgagaggcaggcgggtcgtagggacagtactttcactctcaccatccaccaaccgtgacgaggctagaagtntgtcgctagtttactacgtgtacagactaatactatacgtcctccttctcctacgttcgggcggtaacggaccaagggtgagataacgaagactggtgcngacaacgtctcgttacgttcttaccacttccgtccccgtactatctagacttacg

SEQ ID NO: 51870 - DNA, 527 bp, Homo sapiens
  misc_feature: GYAE6OF01C0FGZ.18.11.A11.1.454.CMB.1.raw
  modified_base (385)..(385): a, c, t, g, unknown or other
  misc_feature (385)..(385): n is a, c, g, or t
  modified_base (458)..(458): a, c, t, g, unknown or other
  misc_feature (458)..(458): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctaccccggggagtcccggggtccctgaccgattcagaggcagcgggtctgggacagactttcactctcaccatcaccaacctgcaggctgaagtntgtgctagtttatactgtcagacaatactattacgtccctcctctcacgttcggcggaggaccaaggtggaanactacaaacgtactgtggctgacaccatctcgtccttcacttccttcccggacctatcctgtcctaacg

SEQ ID NO: 51871 - DNA, 596 bp, Homo sapiens
  misc_feature: GYAE6OF01CI2C6.18.11.A11.1.454.CMB.1.raw
  modified_base (211)..(211): a, c, t, g, unknown or other
  misc_feature (211)..(211): n is a, c, g, or t
  modified_base (288)..(288): a, c, t, g, unknown or other
  misc_feature (288)..(288): n is a, c, g, or t
  modified_base (325)..(325): a, c, t, g, unknown or other
  misc_feature (325)..(325): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagactccctggttgtgtctcgtgggcgagagggccaccatcaactgcaagtccagccagagttgttttanacagctaccaaacaataacaactacttagcttggaccagacaagaaaccaggacacgcccctaaggtcctcattacngggcatccgaccggagtccgggcctgaccgattcagngcgagcgggtctgggacagtactttcactctaccaccatcccaaccaacccgtgacaggctaagaagtacgtggtaggtactaggtttacttacgtagtcagactaattactactacgtcctcctcttacgacggttcggacgggagggaacctagggtagaaggtactaacgaaacggtaacgtggtacgggactacggacctaaccgtcttacggtacgttccgttacctacttcccgttaccccgcctaactcctacgtacttaaccg

SEQ ID NO: 51872 - DNA, 513 bp, Homo sapiens
  misc_feature: GYAE6OF01ED05N.18.11.A11.1.454.CMB.1.raw
  modified_base (284)..(284): a, c, t, g, unknown or other
  misc_feature (284)..(284): n is a, c, g, or t
  modified_base (424)..(424): a, c, t, g, unknown or other
  misc_feature (424)..(424): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaaatacaactactagcttggtaccagcaagaaaccaggacacgccccctaaggtcctcatttacngggcatctacccgggagtccggggtccctgaccgattcagaggcagcggtcctgggacagatttcactctcacatcaccaactgcaggctgaagatgtggctagtttatactgtacagcaaatactatacgtcctcctcnctacgttcggacggacggaccaggtgaagatacgaaacgactgtgctgacactatctgtcttacattccctcccgacatctgactaacg

SEQ ID NO: 51873 - DNA, 537 bp, Homo sapiens
  misc_feature: GYAE6OF01A883Y.18.11.A11.1.454.CMB.1.raw
  modified_base (460)..(460): a, c, t, g, unknown or other
  misc_feature (460)..(460): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaggtcctcatttactgggcatctacccgggagtcccggggtccctgaccgattcagaggcagcgggtctgggacagactttcactctcaccatccaccaacctgcaggctgaagatgtggctagtttattactgtcagctaatactatacgtcctctctctacgttcggacggaggaccaagggtggatanacgaaacgacgtgtcggctagccaccgacttcctacggtccttcaacttcccgttcccgactattcctgaccttaac

SEQ ID NO: 51874 - DNA, 537 bp, Homo sapiens
  misc_feature: GYAE6OF01DA82W.18.11.A11.1.454.CMB.1.raw
  modified_base (208)..(208): a, c, t, g, unknown or other
  misc_feature (208)..(208): n is a, c, g, or t
  modified_base (219)..(219): a, c, t, g, unknown or other
  misc_feature (219)..(219): n is a, c, g, or t
  modified_base (279)..(279): a, c, t, g, unknown or other
  misc_feature (279)..(279): n is a, c, g, or t
  modified_base (337)..(337): a, c, t, g, unknown or other
  misc_feature (337)..(337): n is a, c, g, or t
  modified_base (423)..(423): a, c, t, g, unknown or other
  misc_feature (423)..(423): n is a, c, g, or t
  modified_base (497)..(497): a, c, t, g, unknown or other
  misc_feature (497)..(497): n is a, c, g, or t
  modified_base (530)..(530): a, c, t, g, unknown or other
  misc_feature (530)..(530): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaanaataacaactactagcttggtaccagcagaaacaggacacgcccctaagtcctcattacnggcatcgtacccgggagtcccggggtcctgaccgattcagagcaggcggtctgggacngatttcactctcacatccaaccaactgcaggctagaagatgtaggctagtttatactgtacagactaatactattacgtcctcctntcacggttcggcgggtaacggaccgaagggtacggagaacgtacgaaacgacgtggtagcctacggcaaccgtntcgtcgttccttcacttccttcccgacacttcncgactac

SEQ ID NO: 51875 - DNA, 583 bp, Homo sapiens
  misc_feature: GYAE6OF01DZDXO.18.11.A11.1.454.CMB.1.raw
  modified_base (211)..(211): a, c, t, g, unknown or other
  misc_feature (211)..(211): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagactccctggttgtgtctctgggcgagagggcccaccatcaactgcaagtccagccagagttgttttanacaactccaaacaataacaactacttagcttaggtaccagcagaaaccaggacacgcccctaaggtcctcatttactggcatccgtaccgggagtccgggtccctgaccgattacagaggcagcgggtctgggacagacttcactctcacatcacaactgcaggctagaagtagtgtgtactagtttatactgtacagactaatactatacgtcccttcctctaccacggttcgggacgggaacgggaacccgtaagggtcggaagtacgtaacgaaacgtacgtggtcggacttgacccaaccgtacgttcgttacgtcctttacacgttcccttaccccgactacgtcttacggtacctagttaccccgg

SEQ ID NO: 51876 - DNA, 569 bp, Homo sapiens
  misc_feature: GYAE6OF01AGIEZ.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaccaggacacgcccctaaggtcctcattactgggcatcgtacccgggagtcccggggtcctgaccgattcagaggcaggcggtctgggacagatttcactctcaccatccaccaactgcaggctagaagatgtgctagtttatactgtcagctaatactatacgtccctcctctcgacgttcgggacggagggaccaagggtggaagtactaaccgaaacgtacgtaggtcggactcgacctaacccgtattccgttcgttccctttacctaccgttccccgttccccggaccctaattccctaggtaacccttaaccg

SEQ ID NO: 51877 - DNA, 627 bp, Homo sapiens
  misc_feature: GYAE6OF01DJN7P.18.11.A11.1.454.CMB.1.raw
  modified_base (209)..(209): a, c, t, g, unknown or other
  misc_feature (209)..(209): n is a, c, g, or t
  modified_base (289)..(289): a, c, t, g, unknown or other
  misc_feature (289)..(289): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagactccctggttgtgtctctgggcgagagggccaccatcaactgcaagtccagccagagtgttttanacagctacaacaataacaactacttagcttggtaccagacaagaaaccaggaacacgcccctaaggtcctacatttacgnggctactccgtacccgggacggtccggggtccctagaccgattcaagaggcaggcggtcgtaggacagtactttacacttcctacaaccataccaaccctaacgtcgacaaggtactaggaagagttggtaggactaagttttacttacgtgtacaagacctaaatactaatacgttccctccttactcgtacggttcggacgggacgggaaccgaagggttacggaagtaacgtaacgtaaaaccgacgtaaggtcggacctcgacctaccgtaacttgttccgttccttacctactttccccttacccgtcctaaccgttctaccgaaccgttaac

SEQ ID NO: 51878 - DNA, 877 bp, Homo sapiens
  misc_feature: GYAE6OF01AV577.18.11.A11.1.454.CMB.1.raw
  modified_base (208)..(208): a, c, t, g, unknown or other
  misc_feature (208)..(208): n is a, c, g, or t
  modified_base (211)..(211): a, c, t, g, unknown or other
  misc_feature (211)..(211): n is a, c, g, or t
  modified_base (288)..(288): a, c, t, g, unknown or other
  misc_feature (288)..(288): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcagagggccaccatcaactgcaagtccagccagagttgttttanacngctccaacaataacactctagcttggaccagcagaaaccaggaccacgccccctaaaggtcctacgtactttaccgngggtaccacgttccgtaacccggggtacggttcccgggggtccctacggaacccgtagtttaccgaacggtacggcgtaacgggtccggggttacgtacggggaacctaacggtacgttttccgaacgttccgtaccgtaaccgtacgttacccgaaccgtaacccgttacggacccgtaacgggtaccctttaaggaaccggtacgttacggttacgggtaccgttaacggtttttaaccgttaaccggttcggttaaccgaacggttacctaaacgtttaaccgtttaacgtttaccgggttacccctttacccggttaccgtttaccgttaacccgggtttacccggggtaaccgggttaacgggtaaacccggttaaacggggtacgggttaaaccggtaaccgttaaccggtaaaaccggtaccgttacgggtaaccgggtaccgttacgggtaccccgtaaaccggttaccgtttaccggttaaccggtttcccgtttaacccgttaacccggttttaccccggtttacccccggaccgtttaaaccgttcccggtttaaccgggtaaccctttaaacccggg

SEQ ID NO: 51879 - DNA, 512 bp, Homo sapiens
  misc_feature: GYAE6OF01A30UN.18.11.A11.1.454.CMB.1.raw
  modified_base (481)..(481): a, c, t, g, unknown or other
  misc_feature (481)..(481): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatccaccaacctgcaggctgaagatgtggctagtttattactgtcagcaatactatacgtccctcctctctacgttcggcggacgggaccaagggtggagatacaaacgactggtgctgcaccntctgtcttcattccttcccgcatctgactac

SEQ ID NO: 51880 - DNA, 510 bp, Homo sapiens
  misc_feature: GYAE6OF01C3NQX.18.11.A11.1.454.CMB.1.raw
  modified_base (382)..(382): a, c, t, g, unknown or other
  misc_feature (382)..(382): n is a, c, g, or t
  modified_base (402)..(402): a, c, t, g, unknown or other
  misc_feature (402)..(402): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttatacagctccaacaataacaactacttagcttggtaccagcagaaaaccaggacagccccctaaaggtcctcatttactgggcatctacccgggagtccggggtccctgaccgattcagaggcagcgggtctgggacagtagtttcactctcaccatcaccaacctgcagctgaagntgtgctagtttattactgtnaagctaatactatacgtcctctctcacgttcgcggaggacaaggtgagatacaaagtctgtcgctgcaccgatctgtccttcacttccttcccgctatcctgcctacg

SEQ ID NO: 51881 - DNA, 520 bp, Homo sapiens
  misc_feature: GYAE6OF01DODIA.18.11.A11.1.454.CMB.1.raw
  modified_base (215)..(215): a, c, t, g, unknown or other
  misc_feature (215)..(215): n is a, c, g, or t
  modified_base (280)..(280): a, c, t, g, unknown or other
  misc_feature (280)..(280): n is a, c, g, or t
  modified_base (382)..(382): a, c, t, g, unknown or other
  misc_feature (382)..(382): n is a, c, g, or t
  modified_base (515)..(515): a, c, t, g, unknown or other
  misc_feature (515)..(515): n is a, c, g, or t
tcagtacgagtatgcacgaccggtgctcgatttagctacgactgcagggcagcaagatggtgttgcagacccaggtcttcatttctctgttgctctggatctctggtgccgacgggacatcgtgatgacccagtctccagactccctggttgtgtctctgggcgagagggccaccatcaactgcaagtccagccagatgttttaacagctccaanaataacaactacttagcttggtaccagcagaaaccaggacacgccccctaaggtcctcatttacnggcatcgtacccgggagtccggggtcctgaccgattcgagaggaagcgggtctgggacagatttcactctcaccatacaccaacctgcaggctagaagatgnggtactagtttatactgtacagacaatactatacgtcctcctctcacgttcggcggaggaacctaggtaggatatacaaacgacgtgtggctgcctacattctgttcttcacttcctcccgctactctagctntaccg

SEQ ID NO: 51882 - DNA, 530 bp, Homo sapiens
  misc_feature: GYAE6OF01B1YS4.18.11.A11.1.454.CMB.1.raw
  modified_base (207)..(207): a, c, t, g, unknown or other
  misc_feature (207)..(207): n is a, c, g, or t
  modified_base (281)..(281): a, c, t, g, unknown or other
  misc_feature (281)..(281): n is a, c, g, or t
  modified_base (464)..(464): a, c, t, g, unknown or other
  misc_feature (464)..(464): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagaggccaccatcaactgcaagtccagccagagtgttttanacagctccaacaataacaactacttagcttggtaccagcagaaaccaggacagccccctaagtcctcatttacnggcatccgtaccgggagtcccgggtcctgaccgattcgagaggcaggcgggtctgggacagtatttcactctcaccatcaccaacctgcagctagaagatgtggactagtttacttactgtacagactaatactatacgtcctcctctcgtacgttccggcggaacggaccgtaagggtgganatacgaaacgtacgtgtggctgacctacgcttctgtcctatacgtcttcccgctactctgataccg

SEQ ID NO: 51883 - DNA, 610 bp, Homo sapiens
  misc_feature: GYAE6OF01AUL2K.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgcccctaaggtcctcatttactgggcatctacccgggagtcccggggtccctggaccgattcagaggcaggcggtctgggacagtattcactctcaccatcaaccaacctgcaggctagaagatgtggactagtttatactgtacagactaatacgtatacgtcctccgtctacgacggtttccgggacggtacggggacctaacgggtaggaacgtaacgttacgaaaccggtaacgtcggtaggtaccgttacgaccgacccgtaagttcccgttacggttcccttaccgtaactttccccgtttacccccggtaccctaaccttcccttacgtaaccgttaaaccg

SEQ ID NO: 51884 - DNA, 506 bp, Homo sapiens
  misc_feature: GYAE6OF01C4VAW.18.11.A11.1.454.CMB.1.raw
  modified_base (449)..(449): a, c, t, g, unknown or other
  misc_feature (449)..(449): n is a, c, g, or t
  modified_base (474)..(474): a, c, t, g, unknown or other
  misc_feature (474)..(474): n is a, c, g, or t
  modified_base (499)..(499): a, c, t, g, unknown or other
  misc_feature (499)..(499): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaggtcctcatttactgggcatcgtacccggagtccggggtcctgaccgattcagaggcagcgggtctgggacagatttcactctcaccatccaccaacctgcaggctgaagatgtggctagtttatactgtcagcaatactatacgtcctctctcacgttcggcgaggaccaaggtgganatcaaacgctgtgctcgcacattcngttcttcattccttccccgacatcngctaacg

SEQ ID NO: 51885 - DNA, 536 bp, Homo sapiens
  misc_feature: GYAE6OF01A7MNI.18.11.A11.1.454.CMB.1.raw
  modified_base (208)..(208): a, c, t, g, unknown or other
  misc_feature (208)..(208): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaccaggacagccccctaaggtcctacattactggcatcctacccgggagtccggggtcctgaccgattcagagcagcgggtctgggacagtatttcactctcaccatcaccaactcgacaggctgaacgtatgtgggctagtttattactgtcagacaagtctatagtcccttctctcacggttcgggcggtacgggacctaaggtggagatacgaaacgacgttgtggtctgaccacgtacgtctacgtccttacattcccttcccgactatcctagccgtacg

SEQ ID NO: 51886 - DNA, 554 bp, Homo sapiens
  misc_feature: GYAE6OF01EW16W.18.11.A11.1.454.CMB.1.raw
  modified_base (284)..(284): a, c, t, g, unknown or other
  misc_feature (284)..(284): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaggtcctcatttacngggcatccgtaccgggagtcccggggtccctggaccgattcagaggcaggcggtctgggacagactttcactctcacatccaccaactcgcaggctagaagatggtcggctagtttattacgtgtacagactaatactatacgtccttcctctcacggttcggacgggtaacgggaaccaagggtggaagtacgtacgaaacgactggtcggctcggaccacgtatcttaggttccttcacttccctccccgactactcctgacctaacg

SEQ ID NO: 51887 - DNA, 602 bp, Homo sapiens
  misc_feature: GYAE6OF01CJXSK.18.11.A11.1.454.CMB.1.raw
  modified_base (212)..(212): a, c, t, g, unknown or other
  misc_feature (212)..(212): n is a, c, g, or t
  modified_base (294)..(294): a, c, t, g, unknown or other
  misc_feature (294)..(294): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctcgtgggcgagacgggccaccatcaactgcaacgtccagccagagttgtttanacagctaccaaacaaataacaactacttagcttaggtaccagacaagaaaccaggacacgcccctaaggtcctctattacgngggaactccgtacccgggacgtcccgggtcctgaccgattcgagacggcgaggcgggtctagggacagtactttacactctcaccactccaaccaacctgacaggctagaagagtgacgtacttagtttactactgtacaagtactaaatactataccgttcctaccttctacgtaccggttcggggaccgggtaacgggacctaaggggtgaaacgtactaaccgaaacgtacgtgacggtctcgactacctagtcttgtacctttcacgttccccttacccgacctatcctacgtactacttaccg

SEQ ID NO: 51888 - DNA, 508 bp, Homo sapiens
  misc_feature: GYAE6OF01DONFD.18.11.A11.1.454.CMB.1.raw
  modified_base (208)..(208): a, c, t, g, unknown or other
  misc_feature (208)..(208): n is a, c, g, or t
  modified_base (377)..(377): a, c, t, g, unknown or other
  misc_feature (377)..(377): n is a, c, g, or t
  modified_base (423)..(423): a, c, t, g, unknown or other
  misc_feature (423)..(423): n is a, c, g, or t
  modified_base (482)..(482): a, c, t, g, unknown or other
  misc_feature (482)..(482): n is a, c, g, or t
tcagtacgagtatgcacgaccggtgctcgatttagctacgactgcaagggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaccaggacagccccctaaggtcctcattactgggcatctacccgggagtcccggggtcctgaccgattcagaggcagcgggtctgggacagatttcactctcaccatcaccaactgcaggctgaantgtggctagtttattactgtcagacaatactatacgtcctctctcncgttcggcggagggaccaaggtgagatacaaacgactgtggctgacaccatctgtcttntactccttcccgcattctgtactacg

SEQ ID NO: 51889 - DNA, 504 bp, Homo sapiens
  misc_feature: GYAE6OF01BJF79.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaactgcaggctgaagatgtggcagtttatactgtcagcaatactatagtcctcctctcacgttcggcggagggaccaaaggtgagatcaaacgaactgtggctgacaaccatctgtcttcatccttcccgcaatctgacta

SEQ ID NO: 51890 - DNA, 572 bp, Homo sapiens
  misc_feature: GYAE6OF01BGYPF.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggaccagcaagaaaccaggacagccccctaaggtcctcattactggcatcgtacccgggagtccgggtccctgaccgattcagagcaggcgggtctgggacagactttcactctcaccatccaaccaacctgcaggctagaagatggtgctagtttatactgtacagactaatactatacgtcctacctctcgacgttcggacggacggaccaagggtcggaagtacgtacgaaaaccgtacgtcggtggacgtgacctaaccgtacgttccgtacggtttccttaccgtaacttcccgtttacccccggactacgttcctaggtaacctaacg

SEQ ID NO: 51891 - DNA, 506 bp, Homo sapiens
  misc_feature: GYAE6OF01E2INO.18.11.A11.1.454.CMB.1.raw
  modified_base (208)..(208): a, c, t, g, unknown or other
  misc_feature (208)..(208): n is a, c, g, or t
  modified_base (482)..(482): a, c, t, g, unknown or other
  misc_feature (482)..(482): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaccaggacagccccctaaggtcctcatttactgggcatctaccgggagtccggggtccctgaccgattcagaggcagcgggtctgggacagatttcactctcaccatcaccaacctgcaggctagaagatgtggactagtttattactgtcagctaaatactatacgtcctctctcacggttcggacggagggaccaagggtggagatacaaacgactgtggctgcacatngtctcatcttcccgcatctgctac

SEQ ID NO: 51892 - DNA, 505 bp, Homo sapiens
  misc_feature: GYAE6OF01D391E.18.11.A11.1.454.CMB.1.raw
  modified_base (375)..(375): a, c, t, g, unknown or other
  misc_feature (375)..(375): n is a, c, g, or t
  modified_base (392)..(392): a, c, t, g, unknown or other
  misc_feature (392)..(392): n is a, c, g, or t
  modified_base (459)..(459): a, c, t, g, unknown or other
  misc_feature (459)..(459): n is a, c, g, or t
  modified_base (471)..(471): a, c, t, g, unknown or other
  misc_feature (471)..(471): n is a, c, g, or t
  modified_base (481)..(481): a, c, t, g, unknown or other
  misc_feature (481)..(481): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctccaacaataacaactacttagcttggtaccagcagaaaccaggacacgccccctaaggtcctcattactggcatctacccgggagtccggggtcctgaccgatcagagcagcggtctgggacagatttcactctcaccatcaccaactgcaggctgaagntgtgctagtttattacngtcagcaatactatacgtcctcctctcacgttcggcggaaggaccaaggtgagatacaaacgactgngctgcaccgatntgtcttactnttcccttcccgacattctgctaac

SEQ ID NO: 51893 - DNA, 737 bp, Homo sapiens
  misc_feature: GYAE6OF01CYZH9.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatagcgactacctaaccaaaactaaactaaacctaaaccttaacgttaacgttcgttaccggtaaccgaacgacgaaaaccgaaaccgaacggaaccgacccgtaaccccgtaacgtcctacttaactttacggcggactacgtacccggtaaccgggtccggtcccggtcctacgtacgtactcgaaggcgacgacgggtcggtcgacggaactagttacttctactcctacaactactaccaacctacgtcgacgagtacgtaagaatgtcggtacggtaacttttaacgtttaacttacgttcgaacaacgtaactaacttacttaacgtccttcccttcctacgtaccggtacgggttccggggaacgggaaccgggtaaacgtaggggtacgaaagtacctaaaaccggtaagtacgttcgggacgaccgttaccgaaccctaaccgttatttccgttaccgtttacccttaactaccgttttaccccccgttacccccgattaaacttccggtaacttaaaccc

SEQ ID NO: 51894 - DNA, 498 bp, Homo sapiens
  misc_feature: GYAE6OF01CCQCN.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaactgcaggctgaagatgtggcagtttattactgtcagcaatactatagtcctcctctcacgttcggcggagggaccaaggtggagatacaaacgactgtggctgcacgatctgtctcatctccgcatctgctac

SEQ ID NO: 51895 - DNA, 569 bp, Homo sapiens
  misc_feature: GYAE6OF01DCHKH.18.11.A11.1.454.CMB.1.raw
  modified_base (208)..(208): a, c, t, g, unknown or other
  misc_feature (208)..(208): n is a, c, g, or t
  modified_base (287)..(287): a, c, t, g, unknown or other
  misc_feature (287)..(287): n is a, c, g, or t
  modified_base (468)..(468): a, c, t, g, unknown or other
  misc_feature (468)..(468): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctaccaacaataacaactacttagcttaggtaccagacagaaaccaggacacgccccctaaggtcctctattacngggcacgtccgtacccgggacgtcccggggtcctggaccgattcagaggcgaggcggtcgtgggacagtatttcactctcacatccaccaactgcagctagagatgtgctagtttatactgtacagactaatactatacgtcctcctctctacggttcggcggaaggaccgaggtacgganatacgaaacgtacgtggtgcgtagaccctaaccgtgttccgttacgttccttaccgtactttaccccgttaccccgacctactccgtacgtaccttaaccg

SEQ ID NO: 51896 - DNA, 590 bp, Homo sapiens
  misc_feature: GYAE6OF01AT6R9.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgtttatacagctccaacaataacaactacttagcttggtaccagcagaaaccaggacagcccctaaggtcctcatttactgggcactctacccgggagtccggggtccctaggaccgattcagaggcaggcggtctgggacagatttcactctcaccatcaccaacctgcaggctagagatgtggactagtttattacgtgtacagtacaaatactattacgtccttcctctcgacgtttccggacggtaacgggaccaacgggttgggaacgacttaccgaaacggaccgttgggtacggactacggacctaaccgtacgttaccgttcggttaccttcgtaaccttcccgtttacccccgaccttacttccttaggaaccttaaccg

SEQ ID NO: 51897 - DNA, 576 bp, Homo sapiens
  misc_feature: GYAE6OF01B3TDE.18.11.A11.1.454.CMB.1.raw
  modified_base (286)..(286): a, c, t, g, unknown or other
  misc_feature (286)..(286): n is a, c, g, or t
  modified_base (343)..(343): a, c, t, g, unknown or other
  misc_feature (343)..(343): n is a, c, g, or t
  modified_base (374)..(374): a, c, t, g, unknown or other
  misc_feature (374)..(374): n is a, c, g, or t
  modified_base (379)..(379): a, c, t, g, unknown or other
  misc_feature (379)..(379): n is a, c, g, or t
  modified_base (382)..(382): a, c, t, g, unknown or other
  misc_feature (382)..(382): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgtttatacagctaccaacaataacaactacttagcttggtaccagcaagaaaccaggacacgccccctaaggtcctcatttacnggcatcgtaccgggagtccgggtcctgaccgatcagaggcaggcggtctgggacagntttcactctcaccatcaccaacctgcaggcngaagntgngacttagtttactactgtacagactaatactattacgtccctcccttctcgtaccggttcgggcggaagggaccgtaagggtaggtaacgataccgaaaacgtacgttggtacggctcgacctaccgtagttcccgtacgttcctttaccaaccttcccttaccccccggactaattcctacggtacctaaacg

SEQ ID NO: 51898 - DNA, 613 bp, Homo sapiens
  misc_feature: GYAE6OF01COEV5.18.11.A11.1.454.CMB.1.raw
  modified_base (220)..(220): a, c, t, g, unknown or other
  misc_feature (220)..(220): n is a, c, g, or t
  modified_base (276)..(276): a, c, t, g, unknown or other
  misc_feature (276)..(276): n is a, c, g, or t
  modified_base (282)..(282): a, c, t, g, unknown or other
  misc_feature (282)..(282): n is a, c, g, or t
  modified_base (336)..(336): a, c, t, g, unknown or other
  misc_feature (336)..(336): n is a, c, g, or t
  modified_base (397)..(397): a, c, t, g, unknown or other
  misc_feature (397)..(397): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagactccctggttgtgtctcgtgggcgagagggccaccatcaactgcaagtccagccagagtgtttaacagctacaaanaataacaactacttagcttaggtaccagcaagaaaccaggacagcccctaagcctnattacnggcatccgtaccgggagtcccgggtcctagaccgtattcagacgcaggcggtcngggacagactttcaactctacaccaatccaacaacctgaccgtaggctagaacgagttcgnggtacttaagtttatacgtgtacaagacaaatactaatacgtccctcctctacgtacggttcgggacgggtaacgggaaccgaagggtggaagtaacgtaaccgaaaaaccggtaagttcggttacgaccgtacggaccctaaccgaactttcgtctttaaccgttcctaaacctttcccgttaccccacgtaacttcgttagtaaaacttacccg

SEQ ID NO: 51899 - DNA, 503 bp, Homo sapiens
  misc_feature: GYAE6OF01D0NDB.18.11.A11.1.454.CMB.1.raw
  modified_base (452)..(452): a, c, t, g, unknown or other
  misc_feature (452)..(452): n is a, c, g, or t
  modified_base (474)..(474): a, c, t, g, unknown or other
  misc_feature (474)..(474): n is a, c, g, or t
  modified_base (492)..(492): a, c, t, g, unknown or other
  misc_feature (492)..(492): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccggggagtcccggggtccctgaccgattcagaggcagcgggtctgggacagatttcactctcacatcaccaacctgcaggctgaagatgtgctagtttattacgtgtcagcaatactatacgtcctcctctcacgttcggcggaggaccaaggtgganatacaaagactgtgctgcaccntctgtctcactcctcccncatctgctacg

SEQ ID NO: 51900 - DNA, 560 bp, Homo sapiens
  misc_feature: GYAE6OF01D1KX8.18.11.A11.1.454.CMB.1.raw
  modified_base (434)..(434): a, c, t, g, unknown or other
  misc_feature (434)..(434): n is a, c, g, or t
  modified_base (489)..(489): a, c, t, g, unknown or other
  misc_feature (489)..(489): n is a, c, g, or t
  modified_base (508)..(508): a, c, t, g, unknown or other
  misc_feature (508)..(508): n is a, c, g, or t
  modified_base (512)..(512): a, c, t, g, unknown or other
  misc_feature (512)..(512): n is a, c, g, or t
  modified_base (523)..(523): a, c, t, g, unknown or other
  misc_feature (523)..(523): n is a, c, g, or t
  modified_base (554)..(554): a, c, t, g, unknown or other
  misc_feature (554)..(554): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgaggagggccaccatcaactgcaagtccagccagagttgttttatacagcctaccaaacaataacaactacttagcttggtaccagcaagaaaccaggacacgccccctaaggtcctacatttacgtgggctatccgtacccggggagtcccggggtccctggaccgattcgaggacggcaggcgggtctgggaacagtatttcactctcaccataccaccaactgcgaggctagaagatggtggtactagttttattacgtgtacaanactaatacgtatacgtccctctctcgtacgttgggacgacgggaacagggtgganacgtaacaacggacttggngtcncgactaaccgnttctgtccttcatcccttcccgctatccgtnacgtac

SEQ ID NO: 51901 - DNA, 501 bp, Homo sapiens
  misc_feature: GYAE6OF01BGXJD.18.11.A11.1.454.CMB.1.raw
  modified_base (344)..(344): a, c, t, g, unknown or other
  misc_feature (344)..(344): n is a, c, g, or t
  modified_base (476)..(476): a, c, t, g, unknown or other
  misc_feature (476)..(476): n is a, c, g, or t
  modified_base (493)..(494): a, c, t, g, unknown or other
  misc_feature (493)..(494): n is a, c, g, or t
  modified_base (497)..(497): a, c, t, g, unknown or other
  misc_feature (497)..(497): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggaaagnttcactctcaccatcaccaacctgcaggctgaagatgtggctagtttatactgtcagcaatactatagtcctctctctacgttcggcggaggaccaagggtggagatacgaaacgactgtgctgcacatctntcttcatctcccgcatnnacntacg

SEQ ID NO: 51902 - DNA, 514 bp, Homo sapiens
  misc_feature: GYAE6OF01A8H67.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggctagtttattacgtgtcagactaatactatacgtccctcctctctacgttcggcggacggaccaaggtggagatacaacgactgtggctgcaccgatctgtctcacttccttcccgactatctgactac

SEQ ID NO: 51903 - DNA, 608 bp, Homo sapiens
  misc_feature: GYAE6OF01EFCVE.18.11.A11.1.454.CMB.1.raw
  modified_base (205)..(205): a, c, t, g, unknown or other
  misc_feature (205)..(205): n is a, c, g, or t
  modified_base (209)..(209): a, c, t, g, unknown or other
  misc_feature (209)..(209): n is a, c, g, or t
  modified_base (290)..(290): a, c, t, g, unknown or other
  misc_feature (290)..(290): n is a, c, g, or t
  modified_base (345)..(345): a, c, t, g, unknown or other
  misc_feature (345)..(345): n is a, c, g, or t
  modified_base (409)..(409): a, c, t, g, unknown or other
  misc_feature (409)..(409): n is a, c, g, or t
  modified_base (411)..(411): a, c, t, g, unknown or other
  misc_feature (411)..(411): n is a, c, g, or t
tcagtacgagtatgcacgaccggtgctcgatttagctacgactgcagggcgagcaagatggtgttgcagacccaggtcttcatttctctgttgctctggatctctgtgcgacgggacgatcgtgatgaccacgtctccagactcctggttcgtgtcgtctgggcgagacggccacatcaactgcaagtccagcagtagtgtttanacancctacaacaataaccaacttacttagcttaggaccagacaagaaaccaggaaccacgacccctaaggtccctactattacnggtcctacgtccgtacccgggacggttcccggggtccctcggaccgtattacganggacggcgaggcggtcgtaggacgagtacttcactctcaccactcaccaactcgacgagctagngnaagtagttaggtaggtacgtagtttacttacttacgtacgtacgactaactaactactacgttccgttacctacgtaccgtacggttacgggtacgggacggtaaccgtaacggtaggtagtaagtacgaacgtaacgtacgtacggtcgtgacgtacctactacgttacgtcttactacttccttcccgtcgtacg

SEQ ID NO: 51904 - DNA, 498 bp, Homo sapiens
  misc_feature: GYAE6OF01BCGJ4.18.11.A11.1.454.CMB.1.raw
  modified_base (462)..(462): a, c, t, g, unknown or other
  misc_feature (462)..(462): n is a, c, g, or t
  modified_base (470)..(470): a, c, t, g, unknown or other
  misc_feature (470)..(470): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccggggagtccggggtccctgaccgattcagaggcagcgggtctgggacagatttcactctcaccatcaccaacctgcaggctgaagatgtggcagtttattactgtcagcaatctatagtcctctctcacgttcggcggaggaccaagggtgagatacgaacgactgngctgcacntctgtcttcatcctcccgcatctgctac

SEQ ID NO: 51905 - DNA, 503 bp, Homo sapiens
  misc_feature: GYAE6OF01EGWLO.18.11.A11.1.454.CMB.1.raw
  modified_base (469)..(469): a, c, t, g, unknown or other
  misc_feature (469)..(469): n is a, c, g, or t
  modified_base (496)..(496): a, c, t, g, unknown or other
  misc_feature (496)..(496): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtcctgaccgattcagagcagcggtctgggacagatttcactctcacatcaccaactgcaggctgaagatgtgctagtttatactgtcagcaatactatagtccctctctcacgttcggcggaggaccaggtgagatacgaaacgactggaggctgacacctntctgtcttcgactccttcccgctatcngactacg

SEQ ID NO: 51906 - DNA, 572 bp, Homo sapiens
  misc_feature: GYAE6OF01D8XVF.18.11.A11.1.454.CMB.1.raw
  modified_base (294)..(294): a, c, t, g, unknown or other
  misc_feature (294)..(294): n is a, c, g, or t
  modified_base (396)..(396): a, c, t, g, unknown or other
  misc_feature (396)..(396): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagactccctggttgtgtctcgtgggcgagagggcccaccatcaactgcaagtccagccagagttgttttatacagctaccaaacaaataacaactacttagcttaggaccagcaagaaaccaggacacgccccctaaggtcctctatttacgngggactactcgacccgggagtcccggggtcctgaccgattcagaggcaggcggtctagggacagtattcactctcacatccaaccaactgcaggctagaagntgtgactagtttacttacgtgtacagctaaatactatacgtccctacttcacgttacgtcgggacggaacggaaccgtagggtagagactaacgaacgtacgtgacgcgtcgaccaacgtctacgttcgtaccttacactttaccttccgtaccgtacctacgtccgtagtaaacc

SEQ ID NO: 51907 - DNA, 529 bp, Homo sapiens
  misc_feature: GYAE6OF01CIIT8.18.11.A11.1.454.CMB.1.raw
  modified_base (514)..(514): a, c, t, g, unknown or other
  misc_feature (514)..(514): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaggtcctcatttactgggcatctacccgggacgtccgggtccctgaccgattcagaggcaggcgggtctgggacagatttcactctcacatccaccaacctgcaggctagaagatgtggctagtttattactgtcagacaatactatagtccctcctctcacgttcggacggaggaccaagggtggagtactacgaaacgactggtagctgacaccgatcttagtcttactacttcccgttcccnctactctgactaacg

SEQ ID NO: 51908 - DNA, 540 bp, Homo sapiens
  misc_feature: GYAE6OF01DX403.18.11.A11.1.454.CMB.1.raw
  modified_base (389)..(389): a, c, t, g, unknown or other
  misc_feature (389)..(389): n is a, c, g, or t
  modified_base (476)..(476): a, c, t, g, unknown or other
  misc_feature (476)..(476): n is a, c, g, or t
  modified_base (489)..(489): a, c, t, g, unknown or other
  misc_feature (489)..(489): n is a, c, g, or t
  modified_base (511)..(511): a, c, t, g, unknown or other
  misc_feature (511)..(511): n is a, c, g, or t
  modified_base (532)..(532): a, c, t, g, unknown or other
  misc_feature (532)..(532): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagacagaaaccaggacacgccccctaagtcctcatttactgggcatccgtacccgggaggtcccggggtccctgaccgattcagaggcagcgggtcgtgggacagatttcactctcaccatccaaccaacctgcaggctagaagntgtggctaagtttattactgtacaagactaattactattacgtcctcctctcgtaccggttcggcgggaaggaccaagggtgagtanacaaacgacgtgnggctgccacgattctcgttctntacttccctcccgacattcgngtactacg

SEQ ID NO: 51909 - DNA, 715 bp, Homo sapiens
  misc_feature: GYAE6OF01B0DXY.18.11.A11.1.454.CMB.1.raw
tcagtacgagtatgcacgaccggtgctcgatttagctacgactgcaggggcagacaagactggtgttgcacgaccaggtcttcatttctctgttgctctggatctctggtgccgacggggtacatcgtgatcgacccagtctccagacctccctggttgtgtctctgggcgagaggccaccatcaactgcaagtccagccagagttgtttatacagtctaccaaacaataacctaacttacttagtccttggtaaccagacaagaaaccaggaccacgacccccgtaaggtcctacgactttacgtggggactacgtccgtaacccggggacggtcccggggttaccctcggaaccgtagttccgaaggacggcgtacggcgggtactaggggaacaagtactttaccactctaccacctaactaccgaacctaccgtgacaggtctagaacgtacgtggtacggacttagttttaactacgtacgtacgaacgtactaaatacttacgtacgtaccttcccgtacgtccgtaacgggtccgggacggggtaacggtaaccgtaaagggtcgggtaactacgttaaaccgtaaacggtaccggttcggtacggtaccttacggacccgtaaaccgtcgttaccgtacgtttacctacgttaccttaccccgtttaccccgaccttaacgtcccgttacgggaaccttaaacccgg

SEQ ID NO: 51910 - DNA, 520 bp, Homo sapiens
  misc_feature: GYAE6OF01D3GWI.18.11.A11.1.454.CMB.1.raw
  modified_base (385)..(385): a, c, t, g, unknown or other
  misc_feature (385)..(385): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaaacaataacaactacttagcttggtaccagcaagaaaccaggacacgccccctaaggtcctcatttactggcatccgtacccgggagtcccggggtccctgaccgattcagaggcagcggtctgggacagatttcactctcaccatccaccaactgcaggctagaagntgtggctagtttatactgtcagacaatactatacgtccctcctctcgtacgttcgggcggagggaccaagggtgagatacgaaacgactgtggctgcaccatctgttccttcacttcctcccgacatctgactac

SEQ ID NO: 51911 - DNA, 783 bp, Homo sapiens
  misc_feature: GYAE6OF01BPQD2.18.11.A11.1.454.CMB.1.raw
tcagtacgagtatgcacgaccggtgctcgatttagctacgactgcaggggcagcaagatggtgttgcagacccaggtcttcatttctctgttgctctggatctcgtggtcgccggacggggacagtcgtgatcgaccagtcctccagtacctccgttggttgtcgtctcgtgggcgaggacggccacatacaactgacaacgtccagaccagtagtttagttttaacaacacgtacctaaccaaaactaaactaaacctaaacttacgttacgtacgtttacggaaccagaccaaacgaaaccgacggaccaccgtaccccgtaacgtcctactacgttacgtacggactacgtaccggtacccgggtacggttcccgggtacctacggaaccgtattacgaggacggaccgacgggtcggtcgtacgggactacgttacttacactacctacacctactacccaacctacgtcgacgacggacgtaagaacgtgtacggtagtacgtttagtttagttacgtacgtacgtaacgaacttaaacgttactaacgttaccgttccctacgtccgtacggttacgggtaccgggaacgggaacggtaaccgggtaagggtaacggtaacgtaaccgtaaaccgaaacgttacggtacggtacggtacctacgtaaccctaccgttacgttaccggtttaccgtttacgttaccccgtttacccttacccccggtttaccccgaccgtttaccgtttacccgtaaccgttaaccctttaaacccgg

SEQ ID NO: 51912 - DNA, 573 bp, Homo sapiens
  misc_feature: GYAE6OF01AFYYM.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgaccccctaaggtcctcatttactgggcatcgtacccggggagtcccggggtcctgaccgattcagaggcaggcgggtctgggacagatttcactctcaccatccaccaacctgcaggctagaagatgtggctagtttatctgtacagtctaatactatagttccctctcctcgaccgtttcgggaccggagggtaacccagggtggaagagtaccgaaacggtactggtaggtccttggacccaaccgtagttccctgttccctttcgtaaccttccccttccccgacctattccgtgtaacccttaaccg

SEQ ID NO: 51913 - DNA, 547 bp, Homo sapiens
  misc_feature: GYAE6OF01CZYUN.18.11.A11.1.454.CMB.1.raw
  modified_base (284)..(284): a, c, t, g, unknown or other
  misc_feature (284)..(284): n is a, c, g, or t
  modified_base (379)..(379): a, c, t, g, unknown or other
  misc_feature (379)..(379): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatgacccagtctccagactccctggttgtgtctctgggcgagagggccaccatcaactgcaagtccagccagagtgttttatacagctaccaacaataacaactacttagcttggtaccagcagaaaccaggacacgccccctaaggtcctcatttacngggcatccgtacccgggagtcccggggtcctgaccgattcagaggcagcgggtctgggacagtatttcactctcaccatcaccaacctgcaggcngaagatgtaggctaagtttatactgtacagactaatactatacgtcctcctctcgacgttcggcggacgggaacctaagggtggagtataacgaaacgtatgtggctcggcctaccgattctagttccttaccgtattcccgttccccgacctaattcctgactaacg

SEQ ID NO: 51914 - DNA, 579 bp, Homo sapiens
  misc_feature: GYAE6OF01BSG83.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaaacaataacaactactagcttggtaccagcaagaaaccagacacgccccctaagtcctcatttctgggcataccgtaccgggacggtcccgggtccctgacccgtattcagagcaggtcgggtctgggacagatttcactctccaccatccaaccaacctgaccaggctagaagatgtggactagtttatactgtacagacaatactatacgtcctcctctcgtacggttcggacggaacgggtaccaagggtcgaagtactacgaaacgtacgtggtcggcgttcgaccgtacctacgttctacggttcccttactaccttcccgtttacccccgacttaacctcgtcgaacgttaacccg

SEQ ID NO: 51915 - DNA, 523 bp, Homo sapiens
  misc_feature: GYAE6OF01EXHJO.18.11.A11.1.454.CMB.1.raw
  modified_base (208)..(208): a, c, t, g, unknown or other
  misc_feature (208)..(208): n is a, c, g, or t
  modified_base (283)..(283): a, c, t, g, unknown or other
  misc_feature (283)..(283): n is a, c, g, or t
  modified_base (298)..(298): a, c, t, g, unknown or other
  misc_feature (298)..(298): n is a, c, g, or t
  modified_base (490)..(490): a, c, t, g, unknown or other
  misc_feature (490)..(490): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaccaggacagccccctaaggtcctcatttacngggcatctaccgggngtccggggtccctgaccgattcagagcagcggtctgggacagattcactctcacatcaccacctgcaggctgaagatgtggctagtttattactgtacagctaatactatagtccctcctctctaccggttcggcggacgggacctaagggtcggaagtactacgaaacgacttggcgtctgacctaaccgntctgtccttcacttccttcccgctatctgctac

SEQ ID NO: 51916 - DNA, 739 bp, Homo sapiens
  misc_feature: GYAE6OF01ANRA2.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccggacggggacatcgtgatcgacccagtcctccagacctccctggttgtgtctcgtgggcgaggacgggcccaccatcaactgacaacgtccagccagtagttagtttttaacacgagtcctaccaaactaaataaaccaaccttacttacgtcttacgggtaaccagaccgaagaaaacccgaggaccaccgaccccccgttaaggtccctactaactttacggtcgggacctacgttacccggtaaccccgggggtaccggttccccgggggtaccccttacggacccgtagttacccgaggacggacgacgggccgggtcgtagggactagtacttccactcgtcaacctactaccaaccaacgtcgacgacggtactaggaagtatggtacggactttagtttactacgtacgtacgaacgtacgtaaactttacgtaacgttacgtccctttccgtccgtacgttaccgggtccgggaccgggtaacgggtaacccgtaaggggtacggaacgtaccgtaacgtaaaccgtacggtggtacggcctacgaacccgtacgtacgttccgttacgtccttaccggtacttccgttcccgtactaccctagttccgtacggtaaccc

SEQ ID NO: 51917 - DNA, 508 bp, Homo sapiens
  misc_feature: GYAE6OF01B6KYO.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtcccggggtccctgaccgattcagaggcagcgggtctgggacagatttcactctcaccatcaccaactgcaggctgaagatgtggctagtttatactgtcagcaatactatagtcctcctctcacgttcggcggaggaccaagggtgaagatacgaaacgactgtcggctgccacatctgtcttcacttcctcccgcatctgactacg

SEQ ID NO: 51918 - DNA, 522 bp, Homo sapiens
  misc_feature: GYAE6OF01CSFDK.18.11.A11.1.454.CMB.1.raw
  modified_base (208)..(208): a, c, t, g, unknown or other
  misc_feature (208)..(208): n is a, c, g, or t
  modified_base (336)..(336): a, c, t, g, unknown or other
  misc_feature (336)..(336): n is a, c, g, or t
  modified_base (353)..(353): a, c, t, g, unknown or other
  misc_feature (353)..(353): n is a, c, g, or t
  modified_base (469)..(469): a, c, t, g, unknown or other
  misc_feature (469)..(469): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctaccaacaataacaactactagcttggtaccagcagaaaccaggacagccccctaaggtcctacatttactgggcatcgtacccgggagtccgggtccctgaccgattcagagcaggcggtcngggacagatttcactcncaccatcaaccaactgacaggctagagatgtggtactagtttatactgtcagtactaatctatgtccctctctctacgttcggcggtaaggaccaaggtggagatacaacgactgnggctgcaccgtatctagttccttacacttccttacccgctatcctagactacg

SEQ ID NO: 51919 - DNA, 658 bp, Homo sapiens
  misc_feature: GYAE6OF01A9U63.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctaccaaacaataacaactacttagcttggtaccagcaagaaaccaggacacgccccctaaggtcctcatttactgggcatccgtacccgggaggttcccggggtccctggacccgtattcaggaggcgaggtccggggtctggggaaccagtacgtttcacctctccaccactacaacccaacctgacaggctaggaagtgtaggtgggaccttaggttttaacttacgttagtacaagacttaaacttacttaagttaccgttcccctacctcgttaccctacgggtttaccgggacgggtaacgggaacccgtaagggtacgggtagtaacgtaccgaaacggtacgttacggcggtcttacggacctacccgtagttcccgttagttcccgttactaaccttcccgttacccgacccttaagtcccttagaaccttaaccg

SEQ ID NO: 51920 - DNA, 514 bp, Homo sapiens
  misc_feature: GYAE6OF01BG384.18.11.A11.1.454.CMB.1.raw
  modified_base (383)..(383): a, c, t, g, unknown or other
  misc_feature (383)..(383): n is a, c, g, or t
  modified_base (439)..(439): a, c, t, g, unknown or other
  misc_feature (439)..(439): n is a, c, g, or t
  modified_base (473)..(473): a, c, t, g, unknown or other
  misc_feature (473)..(473): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggaccagccccctaaggtcctcatttactggcatcctacccgggagtcccggggtccctgacccgattcgagaggcagcgggtctgggacagatttcactctcaccatcaccaacctgcaggctgaanatgtggctagtttatactgtacagctaatactatacgtccctctctcacgttcggnggacgggaccaagggtgagatacgaaacgactgnggctgacaccatctgtcttcatccttcccgcatctgactac

SEQ ID NO: 51921 - DNA, 517 bp, Homo sapiens
  misc_feature: GYAE6OF01C5OG4.18.11.A11.1.454.CMB.1.raw
  modified_base (344)..(344): a, c, t, g, unknown or other
  misc_feature (344)..(344): n is a, c, g, or t
  modified_base (380)..(380): a, c, t, g, unknown or other
  misc_feature (380)..(380): n is a, c, g, or t
  modified_base (383)..(383): a, c, t, g, unknown or other
  misc_feature (383)..(383): n is a, c, g, or t
  modified_base (451)..(451): a, c, t, g, unknown or other
  misc_feature (451)..(451): n is a, c, g, or t
  modified_base (509)..(509): a, c, t, g, unknown or other
  misc_feature (509)..(509): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatcgtacccggagtcccgggtcctgaccgattcgagaggcagcgggtctgggacagntttcactctcaccatccaccaacctgcagctgaagntgnggctagtttatactgtcagacaatactatacgtcctctctcacgttcggcggagggaccaaggtgganagtacgaaacgactgtggctgacaccgattctcgttcttcacttcttcccgactatcngtactaac

SEQ ID NO: 51922 - DNA, 545 bp, Homo sapiens
  misc_feature: GYAE6OF01EG9R1.18.11.A11.1.454.CMB.1.raw
  modified_base (385)..(385): a, c, t, g, unknown or other
  misc_feature (385)..(385): n is a, c, g, or t
  modified_base (396)..(396): a, c, t, g, unknown or other
  misc_feature (396)..(396): n is a, c, g, or t
  modified_base (402)..(402): a, c, t, g, unknown or other
  misc_feature (402)..(402): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctccaaacaataacaactacttagcttggtaccagcagaaaccaggacacgccccctaaggtcctctattactggcactctacccgggagtcccggggtcctgaccgattcagaggcaggcggtctgggacagtattcactctcacatcaccaactgcagctagaagtatgngtctaagtttntacgtntcgaagcaatactatcgtccctctctctacggttggcgggaaggacctaagggtggaatactaacgaaacgacgtggtcgcgtcgacccacgtatcgttcgttccttactacttacccttcccgacctatcctagacttaacg

SEQ ID NO: 51923 - DNA, 493 bp, Homo sapiens
  misc_feature: GYAE6OF01E27L4.18.11.A11.1.454.CMB.1.raw
  modified_base (208)..(208): a, c, t, g, unknown or other
  misc_feature (208)..(208): n is a, c, g, or t
  modified_base (378)..(378): a, c, t, g, unknown or other
  misc_feature (378)..(378): n is a, c, g, or t
  modified_base (440)..(440): a, c, t, g, unknown or other
  misc_feature (440)..(440): n is a, c, g, or t
  modified_base (452)..(452): a, c, t, g, unknown or other
  misc_feature (452)..(452): n is a, c, g, or t
  modified_base (461)..(461): a, c, t, g, unknown or other
  misc_feature (461)..(461): n is a, c, g, or t
  modified_base (463)..(463): a, c, t, g, unknown or other
  misc_feature (463)..(463): n is a, c, g, or t
  modified_base (480)..(480): a, c, t, g, unknown or other
  misc_feature (480)..(480): n is a, c, g, or t
  modified_base (487)..(487): a, c, t, g, unknown or other
  misc_feature (487)..(487): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctccaacaataacaactacttagcttggtaccagcagaaaccaggacagccccctaaggtcctcatttactgggcatctacccgggatccggggtcctgaccgattcagaggcagcggtctgggacagatttcactctcacatcaccaactgcaggctgaagatgngcagtttatactgtcagcaatactatacgtcctctctcacgttcgcggaggaccaaggtganatacaacgatgngctagcacntntgtcttcattctcccgntagactntactcg

SEQ ID NO: 51924 - DNA, 773 bp, Homo sapiens
  misc_feature: GYAE6OF01B256E.18.11.A11.1.454.CMB.1.raw
  modified_base (224)..(224): a, c, t, g, unknown or other
  misc_feature (224)..(224): n is a, c, g, or t
  modified_base (295)..(295): a, c, t, g, unknown or other
  misc_feature (295)..(295): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctcgtgggcgagagggccaccatcaactgcaagtccagccagagttgttttatacagcctaccaaanaataacaactacttagcttaggtaccagacaagaaaccaggacacgacccctaaggtcctactatttacgngggctacgtccgtaacccgggacgtcccgggtccctggaccgtattacgaacggacggcgaggtcgggtacgtagggactaggtactttcgacttccgtaccaacctatacccaaccgaacccgttacgaccgtaagggtcctaggaaacgtagttacgggttacggtactttaacgtttttaacgttacgttacggtaacgaacggtaaccttaaaagtttaaccttaacgtttaaccggttccccctttacccttccgttaacccggttaaccggggtttacccgggaccggggtaaacggggtaaccccggtaaaggggttacgggaaacggttacctaaaccggaaaaccggtaacgttcgggtacgggtacccttacggacccaaccgttacttaccgttcggtttacccttacccgtaaccgttcccccgtttaccccggaccttaagtttcccgtaacgtaaccttaaccg

SEQ ID NO: 51925 - DNA, 576 bp, Homo sapiens
  misc_feature: GYAE6OF01EH4UV.18.11.A11.1.454.CMB.1.raw
  modified_base (380)..(380): a, c, t, g, unknown or other
  misc_feature (380)..(380): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttatacagctccaaacaataacaactacttagcttggtaccagcagaaaccaggacagccccctaaggtcctcatttactgggcatctacccgggagtccggggtccctgaccgattcagaggcagcggtctggacagtattcactctcaccatccaccaactgcaggctgaagntggtgctagtttatactgtcagactaatactatacgtcctcctctcacggttcggcggaacgggaccaagggtggaagtacgttaccaaacggtactggtacggacgtacgaccgtaaccctagttcttacggttccttaccgtaacttacccccgtttcccccggaccttaaccgtccttcggtaaacttaccgg

SEQ ID NO: 51926 - DNA, 511 bp, Homo sapiens
  misc_feature: GYAE6OF01EMI1Q.18.11.A11.1.454.CMB.1.raw
  modified_base (480)..(480): a, c, t, g, unknown or other
  misc_feature (480)..(480): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgcccctaaggtcctcatttactgggcatctacccgggagtccggggtccctgaccgattcagagcagcgggtctgggacagtattcactctcaccatccaccaacctgcaggctgaagatgtgctagtttattactgtcagcaatactatacgtcctcctctctacgttcggcggaggaccaaggtggaagatacaaacgactgtggctacgcaccgtntctgtctcatccttcccactatctgactacg

SEQ ID NO: 51927 - DNA, 707 bp, Homo sapiens
  misc_feature: GYAE6OF01B26CH.18.11.A11.1.454.CMB.1.raw
  modified_base (212)..(212): a, c, t, g, unknown or other
  misc_feature (212)..(212): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtcgtctcgtgggcgagacggccaccatcaactgacaagtccagccagtagttgtttanacagcctaccaaataataacaacttactagcttaggaccagacaagaaaccaggaccacgacccccttaaggtcctactaacgttttacgcgggactaacgttcccggtaacccgggggacgttccccggggtacccctacggaaccgtattcgaaggacggcgacgggtcgggtcgtaggggacagtactttcactctaccaactactaccaaccaacgtcgacgacggtctaaggaagtgttggtagacttagtttacttacgtgtactaacgtacttaaatacgttaacttaccgttccctcctaccgttaccggtacgggttccgggaacgggacggtaacccggtaagggtacgtaacgtaaacgtaaccgaaacggtacgtgggtaccggtacgtccgtaaccgtaccgtacttaccgttaccgtttacccttccgttaacctttccccgtaccccgtacgtaacttccttaaccggaacctttaaccg

SEQ ID NO: 51928 - DNA, 612 bp, Homo sapiens
  misc_feature: GYAE6OF01BPHAW.18.11.A11.1.454.CMB.1.raw
  modified_base (215)..(215): a, c, t, g, unknown or other
  misc_feature (215)..(215): n is a, c, g, or t
  modified_base (302)..(302): a, c, t, g, unknown or other
  misc_feature (302)..(302): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagactccctggttgtgtctcgtgggcgaggagggccaccatcaactgacaacgtccagccagtagttgttttanacagctaccaaacaaataaacaactacttagcttaggtaccagacaagaaaccaggacacgacccctaaggtcctactactttacgnggcagtccgtacccgggacggtcccggggtccctaggaccgtattcgaggacggcgaggcgggtcgtagggacagtacttcactctaccaccactaccaaccaacctgaccgaggtctagaagtagtgtaggtacttagtttattacgtgtacagtactaatactatacgttccctaccttctcgtacggttccgggacgggtaaggaaccgtaagggtcgaagtactaacgaaacgtagtggtcggactcgacctactcgttcgttacgtccttacgacttcccgtcccgatatccgtaagccttaacg

SEQ ID NO: 51929 - DNA, 508 bp, Homo sapiens
  misc_feature: GYAE6OF01E1VIG.18.11.A11.1.454.CMB.1.raw
  modified_base (408)..(408): a, c, t, g, unknown or other
  misc_feature (408)..(408): n is a, c, g, or t
  modified_base (426)..(426): a, c, t, g, unknown or other
  misc_feature (426)..(426): n is a, c, g, or t
  modified_base (442)..(442): a, c, t, g, unknown or other
  misc_feature (442)..(442): n is a, c, g, or t
  modified_base (461)..(461): a, c, t, g, unknown or other
  misc_feature (461)..(461): n is a, c, g, or t
  modified_base (472)..(472): a, c, t, g, unknown or other
  misc_feature (472)..(472): n is a, c, g, or t
  modified_base (496)..(496): a, c, t, g, unknown or other
  misc_feature (496)..(496): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactactagcttggtaccagcagaaaccaggacagccccctaaggtcctcatttactgggcatctacccgggagtccggggtccctggaccgattcagaggcaggcgggtctgggacaggatttcactctcaccatccaccactgcaggctgaaggtgtggcgtagtttagttactgtcgtancatactatatctctctcncttcggcgaggcgagnggagatcaacgacgagtgntgcacagtctntctcctatccttcccgtccacttntctactataccg

SEQ ID NO: 51930 - DNA, 648 bp, Homo sapiens
  misc_feature: GYAE6OF01DFAW7.18.11.A11.1.454.CMB.1.raw
  modified_base (213)..(213): a, c, t, g, unknown or other
  misc_feature (213)..(213): n is a, c, g, or t
  modified_base (297)..(297): a, c, t, g, unknown or other
  misc_feature (297)..(297): n is a, c, g, or t
tcagtacgagtatgcacgaccggtgctcgatttagctacgactgcaggggcagcaagatggtgttgcagacccaggtcttcatttctctgttgctctggatctctggtgccgacgggacatcgtgatcgacccagtctccagactccctggttgtgtctcgtgggcgaggagggccaccatcaactgacaagtccagccagtagttgttttanacagcctaccaacaataacaactacttagcttaggtaccagacaagaaaccaggacacgccccctaaggtcctactatttacgngggaccacgtccgtaacccgggagtcccggggtccctggaccgtattcgaggaggcgaggccggtacgtgggactagtactttcaacgttcacacactccaaccaactgcaggctagaagtacgtggtaggtacttaagttttactacgtgtaccaagtaactaacgttaactagttacgttcccctaccgttctacgtaacggttccgggacgggaacgaaccggtagggtacgaagacttaaccgaaacggtacgtggtaccgcgtacgacctaaccgttacttccgttacggttccttacctacgtttaccccgttccccgtacgtacttccgtacgtaaccttaacg

SEQ ID NO: 51931 - DNA, 670 bp, Homo sapiens
  misc_feature: GYAE6OF01B05S7.18.11.A11.1.454.CMB.1.raw
  modified_base (209)..(209): a, c, t, g, unknown or other
  misc_feature (209)..(209): n is a, c, g, or t
  modified_base (222)..(222): a, c, t, g, unknown or other
  misc_feature (222)..(222): n is a, c, g, or t
  modified_base (287)..(287): a, c, t, g, unknown or other
  misc_feature (287)..(287): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagttgttttanacagctaccaaanaataacaactactagcttggtaccagacaagaaaccaggacacgacccctaagtcctcatttacnggcatccgtaccgggagtccggggtacctgaccgtattccaggacggcacggtcgggtcgtgggacaggtactttcacgtctaccgaccacttaccaacccaacctgaccgaggccttaggaaacgtgttacgtgggtacctaggtttttaactacgttgtacaagtacctaaagttaacttactacggttcccttacttcgtacgtacggtttaccgggcgggtaaacggtaccgaacgggttcggaacgtaacgtaacgtaaaaccggtaacgtggtacggtacgtacgtacccgtaacccgtacgttccgtacgtttcccttaccgtaacgtttccccgtacccggtacccttattcccgtaacggtacccttaaaccgg

SEQ ID NO: 51932 - DNA, 709 bp, Homo sapiens
  misc_feature: GYAE6OF01ESSWY.18.11.A11.1.454.CMB.1.raw
  modified_base (215)..(215): a, c, t, g, unknown or other
  misc_feature (215)..(215): n is a, c, g, or t
  modified_base (300)..(300): a, c, t, g, unknown or other
  misc_feature (300)..(300): n is a, c, g, or t
tcagtacgagtatgcacgaccggtgctcgatttagctacgactgcaggggcagcaagatggtgttgcagacccaggtcttcatttctctgttgctctggatctctggtgccgatggggacatcgtgatgacccagtctccagacctccctggttgtgtctcgtgggcgagacgggccacatcaacgtgacaagtccagccagtagttagttttanacagctaccaacaataacaactacttagtcttggtaccagacaacgaaaccaggacacgtacccctaaggtcctactatttacgnggacacgtccgtacccgggtacggtcccgggtcctacggaccgtacttcgacgacggcgtacggtcgggtcgtacgggactacggtactttaccgaccttctacaacccgtactacccgaaccctaaaccgtgaccgtaacggtacgttaggaacgtgttcggtacggtacttaggttttactacgtcgtacagtacctaagttaccgtacgttacctaccttccgttacgtaccgtaccgggttcgggaaccgggtaacggtaccgtaaggggtacgtaacggaacgttaaccgaaacggttacgtggttaccggtaccttaacgacccgttaaccgtagttccgtccggtttacctaccgtaccgttcccctttaccccggacttacggttccgtaacgtaaccccg

SEQ ID NO: 51933 - DNA, 619 bp, Homo sapiens
  misc_feature: GYAE6OF01CZE38.18.11.A11.1.454.CMB.1.raw
  modified_base (212)..(212): a, c, t, g, unknown or other
  misc_feature (212)..(212): n is a, c, g, or t
  modified_base (606)..(606): a, c, t, g, unknown or other
  misc_feature (606)..(606): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagacctccctggttgtgtctcgtgggcgaggagggccaccatcaactgcaagtccagccagagttgttttanacagctaccaaacaataacaactacttagcttggtaccagcaagaaaccaggacacgaccccctaagtcctacatttacgtggcatccgtacccggtacgtcccggggtccctcgaccgtattcagaggcaggcgggtctgggacagtatttcactctcaccatccaacctaacctgaccgaggtctaggaacgagtgtaggcttaagttttattaaccgtggtacaacgtactaattaactagttacgtccctccttacgtcctacggtttcgggacgggaacgggtaaccaaggggtgaacgacgtacaaaaccggtacgtaggtcggactaggaccacctaagttccgtagttcccttactaccttcccttaccccgacccttatttcccncgtaaccttaacg

SEQ ID NO: 51934 - DNA, 570 bp, Homo sapiens
  misc_feature: GYAE6OF01CXA4A.18.11.A11.1.454.CMB.1.raw
  modified_base (216)..(216): a, c, t, g, unknown or other
  misc_feature (216)..(216): n is a, c, g, or t
  modified_base (299)..(299): a, c, t, g, unknown or other
  misc_feature (299)..(299): n is a, c, g, or t
  modified_base (515)..(515): a, c, t, g, unknown or other
  misc_feature (515)..(515): n is a, c, g, or t
  modified_base (531)..(531): a, c, t, g, unknown or other
  misc_feature (531)..(531): n is a, c, g, or t
  modified_base (540)..(540): a, c, t, g, unknown or other
  misc_feature (540)..(540): n is a, c, g, or t
  modified_base (563)..(563): a, c, t, g, unknown or other
  misc_feature (563)..(563): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtcctccagacctccctggttgtgtctcgtgggcgagacgggccaccatcaactgacaagtccagccagtagttgttttanacagctaccaaacaataacaactacttagcttggtaccagacaagaaaccaggacacgaccccctaagtcctactatttacgnggctatccgtacccgggacgtcccggggtcctagaccgtattcagggggactcgaggtcgggtacgtagggactaggtactttccgacttctaccaccatcccaacctaacgtcgacacggctagaacgtgtagtcggacttaagtttacttacgtgtacagactaatactatacgtcctctctcgtacggtcggacggaggaccaggtagacganacgaacgtagtgacgntacgcaccntctgtctcactcctcccatactngactacg

SEQ ID NO: 51935 - DNA, 545 bp, Homo sapiens
  misc_feature: GYAE6OF01BXXUG.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatcctacccggggagtcccggggtccctgaccgattcagaggcaggcgggtctgggacagtatttcactctcaccatcaccaacctgcaggctagaagatgtggctagtttatactgtcagacaattactatacgtccctcctctctacggttccgggacggaacgggaaccaagggtggaagataacgaaacgtaacgtgtaggctgaccaccgtattctggttcttacacttccttcccgactatcctgactaacg

SEQ ID NO: 51936 - DNA, 513 bp, Homo sapiens
  misc_feature: GYAE6OF01A3EDS.18.11.A11.1.454.CMB.1.raw
  modified_base (479)..(479): a, c, t, g, unknown or other
  misc_feature (479)..(479): n is a, c, g, or t
  modified_base (504)..(504): a, c, t, g, unknown or other
  misc_feature (504)..(504): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctaccaacaataaacaactacttagcttggtaccagcagaaaccaggacagccccctaaggtcctcatttactgggcatctacccgggagtccggggtccctgaccgattcagaggcagcgggtctgggacagatttcactctcaccatcaccaactgcaggctgaagatgtggcagtttatactgtcagacaatactatacgtcctcctctcacgttcggcggagggacctaaggtggagatacaaacgactggtcgctagcaccntctgtccttcactcgttcccgctanctgctaacg

SEQ ID NO: 51937 - DNA, 522 bp, Homo sapiens
  misc_feature: GYAE6OF01BTZ4Q.18.11.A11.1.454.CMB.1.raw
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaggtcctcatttactgggcatctaccgggagtccggggtcctgaccgattcagaggcagcgggtctgggacagtatttcactctcaccatcaccaactgcaggctgaagatgtggctagtttattactgtacagacaatactaatagtccctcctctctacgttcgggacggacggaccgaaggtggagaatacgaaacgacgtgtcggctgaccaccatctagttcttacatccttcccgctatctgactac

SEQ ID NO: 51938 - DNA, 660 bp, Homo sapiens
  misc_feature: GYAE6OF01BPQAV.18.11.A11.1.454.CMB.1.raw
  modified_base (208)..(208): a, c, t, g, unknown or other
  misc_feature (208)..(208): n is a, c, g, or t
  modified_base (280)..(280): a, c, t, g, unknown or other
  misc_feature (280)..(280): n is a, c, g, or t
tcagtacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttanacagctcaacaataacaactacttagcttggaccagcagaaaccaggacagcccctaaggtcctcatttacngggcactccgtaccggagtccgggtcctcgaccgtattcgaggacggcgaggtccgggttcgtacgggactaggttactttaccgacttctacccaacctactaccaaccctaaccgtcgacgacggtctacggaaacgtacgttcggtacggtacttaagttttaacgttacgttcggtacgtacgactaaactacttaacgtaccgttccctccgtactaccgtacggttccgggacgggtaacggtaaccgtagggtacggaacgtacgtaaccgaaacgtacgttcggtcggtctacggaccaaccgttacgtcgttacggttcccttacgtactttcccgttaccgttacgacccttagttccgtcggttaaacc

SEQ ID NO: 51939 - DNA, 689 bp, Homo sapiens
  misc_feature: GYAE6OF01AIKT8.18.11.A11.1.454.CMB.1.raw
  modified_base (212)..(212): a, c, t, g, unknown or other
  misc_feature (212)..(212): n is a, c, g, or t
  modified_base (292)..(292): a, c, t, g, unknown or other
  misc_feature (292)..(292): n is a, c, g, or t
tcagtacgagtatgcacgaccggtgctcgatttagctacgactgcaggggcagcaagatggtgttgcagacccaggtcttcatttctctgttgctctggatctctggtgccggacggggacatcgtgatgacccagtctccagacctccctggttgtgtctcgtgggcgaggaggccaccatcaactgcaagtccagccagagttgttttanacagtcctaccaaacaataacaactacttagcttaggaccagcaagaaccagacacgacccctaagtcctactatttacncggcacgtccgtacccgggaggtccccgggtcctggaccgtattcgagtaggcagggcggtcgtagggactaggtactttccgacttcctacaaccgacttacccaaccgtaaccctgaccaggtcctaagaaggtacgttggtacggtacttaagttttactttacgtacgttacgaacgtacctaaacgttactaacgttaaccgttccctacccttaccgttcggtaaccgttccggggaacgggacgggtaaacggtacgggtagggaccgtaacgtaacgtaaacggtacgtggtccggactaccggaccctactacgttaccgttacgttcccttaacctacgtttacccgttacccgttaccgtacccttacgttaccgtccgttaaacg
